United States Patent 8,781,750 (CELL-TYPE-SPECIFIC PATTERNS OF GENE EXPRESSION) - sequence listing, part 49

SEQ ID NO: 38046 - DNA, 109723 bp, Homo sapiens
cgcgggtgcgttgctgtcctggccgcgcccctgtcccgccgcctcccgctcctcgcctggcggatgtaggttgttggcctgaggggagctacgtagccgaggtttgcgctgccgccgccaggcccggtccggttccagcctctgcccggacgctagccggcctggccatggctgaccgcgggtgcccgctggaggcggcgccgctgcctgccgaggtgcgggagagcctggctgagctggagctggagctgtcggaaggtgagccggaccccgccctcaacccccgcgacccgccctcagcccggtcccccgcgcagcccctcactccgggacccccgcgcggcccctcactccaggacccccgcccttcacccccgggacccccacgcggcctcgcccctgggacctctgcccctcaacgggaccccggttcctctaccctggaacccgcccctcgccccggagacaccgttcctcaaccctaggaccccgcccctcatgtgggaccccagcacgacccctcgccccgagaccccggccccttacccccgggaactcccgcccctcacccccgggacctcctgcccctcacccccggaaccccgcgcggcccctcaccccggggaccccgcccttcaccctgggagccccgcgctgcccctccggactcccgaccctcagccccgggacacccgcgcggcccctcaaaccagggaccactgccccgcctctcatacaaggacccctcccccatacaaggactcctccccccaggcccttcacacctgggacccttactcctcaccccgggacgcctgccaaacttctggagacctttccctatccccagctgctcccccaatgggatccgaccccaaggactggctttgactaggtcgtttggacaggtgtgagaatcttgagaggaatgaccacttttgccccaagctgtgagccccgcttttctcaaggctgtaggtctgggcttggtctgggcttcaccaggatgactgcgcccgttgtccgcaggcagctacttcccttggagctgggagcccttgccgcgcgcctcatactctaggagctgcaccctgtgcctcattttattatctataaagtggggttataccagcactttccattttggattgttatgaggctaaaataccttaatatatgcaaagcacataacacttaggagttgttagccccctcatggaattttttaaagtaaaaaaaaaaagtcgtataaatggttggttgataaaaatagactggagtaatctggcttcagaggtggtgggtggcatttcccatttggatgttatccctttcaaggcctgtgtcctgatattccttttggctgtctttgggaaagagttaagttcttctccagtgtcagaaaggacttgcagtccttgaagaaaagcatgtaattgattcttactctgtttttgagatctaaatgcattttcagcttttagaatccattttttaaataatcttattatccttaatttaagtttcagattgataagattttgctgggtctggggtagttatttctcaaaacatctaaataatatgcactagcatacagtaagtcatttaatccttgccaaccttagggaggtagatgctgttgtgatcttgttttacatataatacaacatgtacttgcaactattttgaattcagcattcagatttttaacaatgttgtgacatgtggcacattttttttttttgagacggagtcttgctctgttgcccaggctggagtgcaatggcgtgatctcggctcactgcaacctctgcctcccaggtagaaatgattcttctgcctcagcctcccgagtagctgggattacaggggcttgccaccacgcccagctaattttcgtatttttagtagaggcaaggtatcaccatgttgaccaggctggtctcaaactcctgacctcaggtggtccgcctgcctcggcctcccaaagtgctgggattacaggcatgagccaccgtgcctggcttgtggcacatttttaaaaatggaagtacaggctgagtacacagtggctcatgcttgtaatcccaacactttgggaggccacgttggcttggagacgggagttcagaacagcttgggtaacatagcaagactctgtctctacagtattaaaaaaaattagctgggcatggtggtgtgcacctgtagtcccagctacttgggaggctgaggcaggaggatcacctgagcactggagcactccagcctgggcaacagagcgagaacctgtctcttctcaccaaaaaaaaaaaaaaaaaaaaaaggaaagaaatggatggatttgagaattcttggtgattagatgctcctaggcagtctgacaaacttaaattaggaatgggtttgacaggatctactgtactgcatttgttaaggctctttagggaaaatcacatatacgcagtttagattctgtgcatttcaaacatatttttgcgtattgctcctaatttctgctccaatgtattcattattccctcaattttttgtgttgtagttgtgtttgagtgcttgctaggcattgacaattgaatcctttcctcaaagaactttataatttgtgcgacagaacacaagtacttaaatgaaagaaatgtttcctatctgttggatccatttatgctattgtcatcttagagatatgtaggggatgtataggtaagtaaaggtataagattatgtaacatggagaggaacctcgaaaaatagcttaagctgagaaagggggtaaacaaaaaaagtattgagcccagaaatggtggcttaggcctgttatgtttgcattttgggaggcccaggcaggaggatcacttgagcccaggagtttgagaccagcctaggcaacatagggagaccctgcctcttccaaaaaaaaaaaaaaattggctgggcatggtggtgtgtgcctgtagtcccagctacttgaggggccgaggtgggaggatcacctgacgaggttgtgagcctttatagtgtcactgcattccagcctgggagacagagtgggaccttgtctcaaaaaaaagtgttaaagggaagacagcagagaacagagtagtagagtggcagccaaggaggtggaagctctggcttcttggcttctttccctgctcctagactggcctgacacttttcttttggccaaaataggtcagtgattacttaggcacagtcacacgtggacctgcttccagggcgcttccacaggttaatgctggcttatgtagtttatgtggtggttgttgttgacgtgggctctccctgttggatttggagatgcttactggtaaggactttgttttaggcagatttttggcttcttcacacagtggtgggcatctggtaaagtgtctgtgaatctcctgtggattacaatgtctctaaacgtgggtttagttagctgtaaaagggggtgaataccagctttattgacattccaggtttattgtcaagattcagtcacatagtgtgtgtgaaaatgcttcgaaactggtaaggtgttttatttatataattaaagggagatattagtaatgagttatagtcctaaaacaaccaacattagtgtttcattgttataatttttatatattgtcaaaatagtgtaacttttttatagcattcacatttatctaagtgagaaattgcctaaaacttaagagttgtcactgtgcttggtaggttggaagaagaagcttaacagtgacaaagatgctgtcttcaacagaaactggtaatgagtgatacctgaataatctagaaaatcctgcatgccttcccctcagcctgttgaaagtatcctctgcctttcttcatacctcacacctggccttattctccagcatcctcactgcattctcatcatcaaccatagtgattggcgttggccctgagggaaggttctggtagaatgctatgatttatttccatagggcaagtttgctgaatttctgttatagattcccaagagggaaataaggcatagctgtgttcttgctccttaacttttctggctgttttgccctcttgacttaggagtctgcttcagattaagatgaagatgaagagtagaagtacatggaaccccactcttcttagaccccctgccccccaatcatgaacacatacagaagaattcatatgtgtggttcctgaaaacctatcaggatgttcattgatggaagtgagatcattagaggtataaccttgatatttaaaaaagaattaattcccaaacctttgtgctttgcctgttgctgtaacaaattaccttggacacacctcacagctgattttggcacaccagtgctgtacgtgtcttggagctattgctgctgaactgctttaaaaacatggacagtggtattttgttctttgttttaatagactacagtgggttagagaggaaattcctacacaataggctacctttatcccattccaattactttattctggttaataggtctattccatagctttaactttagtctttttcttgatttcttatattctaacaatgcaggacttctagtctagatggaataaaatgaaaagggggaaaaaactctgggtatacaggaagagacttctctcacaaagcttttttcctctttaactgtctttaatttctaaaatctgggatatatttgtgtgtgtgtgtgtgtgtgtgtgtgtgtgtgtgtgtgtatattttgagacggagtctcactctgttgcccagtctggagttcagtggcgcgatctcggctcactgcagcctccacctcccgggttcaagcaattgtcctgtcttagcctcctgagtagctgggattacaggcacacgccatcacgcctggctagttttttgtatctttagtagagacaggatttcaccatattggccaggctggtcttgaactcctgacctcgtgatccacctgcctcggcctcccaaagtgctgggattacaggcatgagccatcgcgcctggcccataattcttaattttcaaaatgacagcctgtcattgcctttgtgttaataaacatttgttgtgcttcttgaatattttgtggtatataaaagttctcatgttcagccaggcgcagtggctcacacctgtaatcccagcactttgggaggctgaggcgggtggatcacctgaggttaggagttccagaccagcctgaccaacatggtgaaaccccatctctactaaatacaaaaaattagccgggcgtggtggcgtatgcctgtaatcccagctacttgggaggctgaggcaggagaaccacttgaacctgggaggcagaggttgcagtgagccgagattgcaccattgcactccagcctgggcaacaagagcgaaacttcgtctcaaaaaaagaaaaacgttctcatgttcagattctactcatctgtcaaaggccaccccaaatgctctctatcttagtctattttgtgttgtgtttgtgttctataacagaacaccacatataggtaatttacaaagaaaaatttatttctcacagttccagaggatggaagtccaatattaaggtactagcatctagcaaggactttcttggcctgtcatcccatggtggaaggtgagaaggcaagagaatgtgtggacgagagaggaagggggccaaaatcatccttttgtctggaacgcattcctgataactaacctgtccctgcgataacagcattaatccactgatcatctcttaaaggttctgccgctcaacactgctgcattgggcactgagtttcttcctttttcttaatattcatgtctttttttttttttttttttttttttttcaagaaaacacacaacaaatgtcagaatatgagatagggaagttctcctggaacagcatgtagattattttctagagcactttagttaaatggtacttaatgatgataattcttctgaacacaattcagaatttgaaccaatatttgttgtttcaggaaagcagaatttcctttgaatgatggataagaatggtgaggatctttataatatagaataaattgctgaaaagaaactttgagggaatattcaaagcaccctcttattttgaaccttccttgatcatctctaatgtgactgctttctcagaacttccatatcatttgtcccctcttttggagttcttgctgctttttgtttttgtatttgttttcacttattcagtaattattcagtgtccactgcatcctaggtaatatttcagctgtcaaaagtcagattttggctgggcatggtggctcactcctgtaatcccaacactttgggaggccgaggtggttggatcacctgaggtctggagttcgagaccagcctgaccaacatgacaaaaccccgttgctactaaatataacaaaaaaaaaattagctggtcatggtggcacgtgcctgtaatcccagctacgtgggaggctgaggcaggagaatcgctcaaacccaggaggcagagggagactatttttataatgatactaagatgccatttctgttttcactgtgttgacacttgtactgatggtccaaaagcagtaatagggaaaactgctgggcactttaacgtaaattgaggcagggactccaagtgtcactgatagtcattatattattcgctacctctccacttgcagttttaaaaaaacaaaaagggctgctttcacttaaacagaccctgatgaagcagtaaaaattaaaaaaaaaaattggccttttgtcttttcatgaggaaatgggaagtacatgaattgcttttgctgcacaaagaggtacagtgcctgttttgagaaacagcaattgtgtagtttgagttgcaaagcgaactagctgcttttattgtgaaatgccatttttgcttgaaaaagtgggtagcagacaatctgcagttattgagacttgggtatttggtggacgttttctggaaaataaatgagaggaaataactgacaatttatgaccaatgataatatttgtgctttcaagcaaaaatcaaaattttgaaaaaatttatctgctacagtgagcttgacagtttctcaatagttaacgacttctttgatgagattggtgacaatataatgaatgagtatttgatattatataattaaatgtgtcagcatttggaagatccacataattttgtgaactaatattttccagctcaccattgcaccacgttacaaagtcatagtgcatgggtaaaagattcattcaaaagatagaccaatggattttaatgtagtgatatgaaaagttcactgataagagttatagattctacattataacttttttttttttttttttttttttgagatggagtcttgctctgtctcccaggctggagtgcagtggcgcgatctcagctcactgcaacctctgcctcccaggttgaagtgattctcctacctcagcctcctgagtagctgggattacaggtgcctgccaccatgcctggctaatttttgtatttttagtagagattgggtttcacgtgttggtcaggctggtctcgaactcctgacctcgtgatccgcccgcattgatctcctaaagtgctgggattacaggcctgagccaccactcccggccacaactttttttttttaagagactcccccttgcctggttttggtgttgtatcaaggaagaatgtccacagtgatctgaaaaggctgctgagacaccccacctttttccaactgcatgtctctctgaaaaaggatttgattcatagacttcaaccaaaaaaaccacacagtacaacagattggatacaggagcaggtatgagaatccatattgtcttctctgaagccagagttaaagcaacttgcaaaaatgtaaaagaatacctcttcttactaaatgtttttgttttcagaaatcttttatttttagtaaaaaatattatttaccttaatatctagtcagtttattattaaaaattttaaatgagttaggccgggcgcggtggctcacgcctgtaatcccagcactttgggaagtcgaggcgggcggatcacgaggtcaggaggtcgagaccatcctggctaacacagcgaaatcctgtctctactaaaaatacaaaaaatcagccgggcgtggtggtgggtgcctgtagtcccagctgctcgggaggctgaggcaggagaatggcgtgaacctgggaggcggaggttgcagtgagccgatatcgcaccgctgcactccagcctgggctacagagcgagactccgtctcaaaaaaaaaaaaaaaaaaatttaaatgagttaaatatttaaaaaatttcacagtattagttttgtttgtttgtttgtttgtttgttttttaagatagtgtctcgctctgttgcccagttgggagtgcagtggtgtgaggatagctcactgctgcctttaactcctgggttcaaatgatcttcttgcctcagtctcttgaataactagaacatagtagctgaaagacatggatgtcatcatctatttctttatattttttgtaacattttaaagctattgcctagtttaataattatttcagtttgtgtatgtaaggacaatcaggcatttaaatttataaaacatgtttgaaaatctttaaaagttacacttactgactagttgcttgtctgttgcactaacaaaatttattattcatgtttcgggaataccctctttaggttttgtttgttttttttttcatagtaaattatcccagtacaagtgtctttgtacaaaattttgatttctaagtttctttaaaaatatcaatgccagctgggcccagtggctcacacctataatcccagcactttgggaggtcgaagaggatggctgaggaggttggatcgtttgaactcaggagtttgggatcagcctgagtgacatggtgaaaccccatctctgctaaaaaatatgaaaattagggctgggtgcagtggctcatgcctgtaatcccagcagtttgggaggccgaggtagacggatcacttgaggccaggagtttgagaccagcctgggcaacatggtgaaactccgcctctactaaataaaaaaaaaaattagcctggcatgggggcaagtacctataatcccagctactcgggagactgaggcaggagaatctcttgaacccaggagccggaggctgcagtgagctgagattgtgccactgcactccagcctgggtgacagtgagactgtctcaaaaaaaaaaaaaaaaaaaagctgggtgtggtggtgcacgcctataatcccagctactctgatggctgaggcagggagaaccgcttgaacctgggaggtggaggctgcagtgacctgaaattgcaccactgcactccatgataccctgtctaaaaaaaaaaaaaaaagagagaaaatcggcgccagaacaaatcctacacaagcccacttgtgtcagaaatttaaaatagtcagactcatagaagcagagagtagaatggtggttgccagagactggggtggtgggagaatctggaaggtgttgatcaaagggtatatagtttcagttatacaggatgagtaactgctagagagctgctgtacagcatagtgcatatagttaacaatactgtattgtatatttaaaaatttgttaagagagtagagctcatgttaaatgttcttatcacaaacaggaaaggaagaaacttttagagatgatgtttatgtttatgtttatggtgatggtttcacagggatatacttacctttaaattcatcaaaatttatatattaaatatgcacgagttcttataggttaatcatgtcgatttaaaaaaagaaatatcagtgatttcaattttaatatcctaaaactttaaacatgcttcattgccagctattctgtacttgtttaattcctgtctttctttcaccgcttaagtttaaacttcactttctgttggaggctctgccttctactaaagcccccttctccccaaccttcacagaataaagtgcctgtgctctgtatccttttaaaactcattgtatcactcttgtaggatcataattatttgtttcatgattatttgtttgcttgtcttttctataccattttacagggagcatttcaagaggaaggtttgatctgctcatctttctgtctccagcaccttgcacattttaggcattttaatggatgcttattgagttaataaaagtgaaaacttcacatggtgtttattcagtttcaaataaagaatcctctgtaaatggattcaaacttagcttttttacagcagtttttctaattcagtgaacccatcagcaggatggatctgtgcctcagggagctgttgaatcagagtgtggcctttgttgctttaagtgaccagaaagaaaaaacttaagaggagactgagataagtgcactgttgctcctgtcctcctgtaggatccaggctaagctggagaggcctcactggtgtggagctcgatgacgtacatctaatctaatagtttgtttggggcccatgagggcataatccactgatggcctcatcgccatgctgtgggtccacactaccctcaagctgaggctatgcttcctatagcaggaataccaaggctctttcccaggagtcctgatgagaactttgtctcaaggactcctcattggcctggccggaactttcttagtgctgcctttagtctaagactttttctgtcccacctgccttcctttcctcttcccctggcaaacatctactggttccctccccattttccctcaagggcattttcccacataaatctccctttcacgtagtgtgtcctcagtgagcattagccacgtgtgactgcttctcttatcatcagggcaggtcaggggccaggatacctgttccatcttttgaaaaaaaagatagaattcaagagctgcagttttgtttttcaaatcacatatttaatcttttaatgtattattttggctgatgtgatatacatttatttagtataaaaatgaattcaggccaggtgcggtggctcacgcctgtaattccagctctttgggaggccaaggcaggcggatcacctgaggtcaggagttcaagaccagcctggccaacagagagaaacccccatctctactaaaaatacaaaaaatgggctgggcacagtagctcatgcctgtaaccccagtacttagggaggccaaggcgggcggatcacctggggttgggagttcgagaccagcctgaccaacgtggagaaaccccgtctctactaaaaatacaatattagccaggcgtggtggcacatgcctgtaatcccagctactcggaacgctgaggcgggagaatcacttgaacccaggaggcggaggttgcggtgagccgagatcgtgccattgcactccagtctgggcaacaagagcgaagctccgtctcaaaaaaaaaaagggggggccaggcacggtagctcacgcctgtaattccagcactttgggaggccgaggtgggcggatcacgaagtcaggagttgaagaccagcctgaccaatatggtgaaaccgtgtttctactaaaaacaaaaaaattaggtgggtgtggtggcgcatgcctgtaatcccagctactcaggaggctgagtcaggagaattgcttgaacctgggaaatggagtgagcagagatcacaccattgcactccagcctggacgacagagtgagactctgtctcaaaaaaaaaaaaaaaattagccaggcatggtggtgggcacctgtattcccagctactcaggaggctgaggcaggagaatcgcttgaacccaggaggcggaggttgcagtgagccaagataataccactgcactccagcctgggaaacgagtgaaattctgtttcagaaaaaaaaaaaaaaaaaagaattcatattatttggtcactcttctatgttataactgaagaaaggaaggaaatgaattagggttaagttaatgggaaaactttattctgccagtacatattttgtttatttaatctcgctctgttgcccaggctggagtgcagtagcactatcatagctcattacagcctcaaactcctgggctaagctatcctccgctttagcctcccaagtagttaggatttcaggtgcactctaccgtgcctacttttaaagtttttttttagattcagagtctcaccacgttgcccaggctagtcttgaactcctggtttcaagcgatcttcctgccttggcctcccaaagtcctgggtttacaggcatgagccactgtgcctggccttatttgtttttgttttttaagagcagtcttaggttcacagcaaaattgagagaaaggtacggaactatcccatattcccccacccttatacgtgtacagcctcccgcattatcagcatcccagtaaatcttttaaaactaatttttgctgtgcagtgagcttgcttctgggtagaattaacataatccttgtggctcaatctttacacctttaaattagctgacattttcagtattgcactggtctattaaaaagactaggaagttatacactgcttagcaaagaaaactattgtcagtgaagacacaacacttaaaaatagctgttacttctattgtgtattgatagattatcacttagactaatgtacccaagggtctcccttcccttttcacacaggaaatgcatggcctctgttcttaggatttcctgggttcttgaaggcagcagctaaaattatagctgggagacagtgatcatgcgggggtttcctttcagactttgaattaatcagctataaggaaagaatagaaatcctgtgtcttctttctacactgaactgttcataatttaagagtaccattttggaaatagcagacaaagagcttttacactctttcagattttagaactttttctgcagtatctttagtaaagaacctttaaattaagtctctgaaacaaaaggacacaattgttggtatgctgaagccctaaccccaatggattatatttgaagactggaccttaaggagatatttaagatcaaatgaggtcaagggggtgggccctcatccaataggactggtgtccttataagaagaggaggagacaccagggatatttgtgcatagaaaggccatgtgaagacataggcagctgtctgcaagccaaggagagaggcttcaccagaaatgaaccctctggcaccttgatcttgagctttcagtctccagaactgtgagaaaataaatgtctgttgtttaagtcgcccactctggtattctgttacggcagcctgaacagacggacactcagtgtgtcatcctgttgtttaacaacattcaacagactgagtgccaggaggcttacagtctagcaggggctgaaagacatgtaaacagtggcaatatcatgaaatgtgtacagaacccagtcagcccaaggggagggatcatcagcactgcgcaagctgggccaatagaggaagtacagtttccttgagctttgttttgaaagcatgtgtgaagagggtggagaaggaggagcggggatggacatgaagacaaagggaggtgaaccgaagttgagtgggccaaggaattccaggcagtgttccacaggtagaggaggaaaggcaggggctaacttacagcagggctcacacatcctagtaaggaatttggacttgattctctggagtctagacaagctggttgaaacaaactcaaattcctccctgtagctggttgggtgttgtggatgtgtgaggtgaccaagagtaaggcaggaggggtgctggtacctgttgcctctagaatggcactgtttagaactttctgctacgatgggaaagttctgtggtgtccagcatggtggccaccagccacatgtggctactgaacacttgaaatgtgggtagtgggacgagggaactgattgttcaatttaatttacttttaattaattaaaatttaaccatgcatggctaatggctgctgtactggacaacagcaaagtgtatgctctgcatgaaggcttcctattaacaagaaataccatgaaaatacattttattcctaccactgctctcgacaaaggagagaaaatgagcaagatgaaaatatgtgtacacattcaagaactcagtgaatcttgtaaacagatgtcaatttcctatttttaattaaaggctatggggcaggagtttgagactaccctgggcaacatagggagaccctgtctctacaaagaaaaaaaaattagcaaggtgtgttggtgcatgcctgtaatcccaactatttgataggccgatgtgggaggattgcttgagattgaggctgcagtgaaccgtgattatgccactgcactccagcctgggtgccacagtgagaccatgtctcagggaaaaaaaaaggggggggggccatggcggtggtttttcttgggtgctttatttattttttattttattttattttggagacagagtcttgctctgttacccaggctggagtgcagtggcgcaatcccagctcactgcaacctccgcctcctgggttcaagaaattctcctgcctcagcctcccaaatagttgggattacaggcgtgtgccaccacgcccggctaatttttgtatttttagtaaagatggggtttcaccatgttggccaggctggtctcgaactcccgacttcaagtgatccacccacttcggcctcccaaagtgctggaattataggcgtgaaccactgcgcctggccaggtgctttactttaaacaggtcttctttaataaatgatggagccagcagtacccccacacagccccacctttttaaaaaatgtattaacaaaacatttctgcataatctcttttgtctctttctgtctccctctttgatttagaaagattgttctgcagtatgtgaaaagtagattggaggagtctgaaattgggggacagaaaagttagcttgaaaaacccattgcagtaatccagggcaagagattttgctggtctggacagagctgagccaataggatggagagggcaatcagaagtagagccagcaggcttctgtgtgaagtgcacagtaaaggagggtctagggtgactctggagtttctgaaacacctgtctgggagatgatggtgctgctcacgaagacgtggaacacaaaaggagtgtgaggctgctctaggagatctgagtggtgggacccagagtgcatttggatatatgagtctagtactttctagaaagggctaggctagtaatttggaagtcatcagcacatagatagtaattggagtgaatatgattaccccataaggagaaatgaataatgcaaagagagcctaggaaaaaactctgaggaacccaaatccatacgggaaaggcagagaagggagagactgcagggaagactgaggaaggagacagaacatgtgtgggcatctgtgcagctgaggcagggaaatgtgtgtggaggattttctgggtcagtattcatgaccaatcatcaggcaaagatgactgtacttcctcaaatctcattgaaatggttgaagaggtttttttgttttttggtttttgttttcctaaagaggtgagatctcactgtgttgcctaggctggtcttgaactcttgggcttgggctcaagtgatcatttagcctcagcctcccaagtagctggaactatagctgcgcacccccacatcctgctaggttttcagaattgaaaaggaattcatagtctaggttctgggaaattggaacggtggatcagagcagtgaggattatctgattagggaagatagggatggagcaggtctgcagcagatgtacagtgcatcctctgaacaaagttgtggaggaggatgggaggtggtaatgaggaaaggatatggttttcatcggttttccagagtctgctgatgtattcctgtagaaggtaccaccagttgtttggggaagtgggcactcagcagccctatgtctgcctcaaccagagactcttctccacttaacactcttcctaactgttcagttgaacagaagatgtgcagctgaaaggttggaaaaacattgaagtggataatatctaagttctcctttcagttgcaaggctagtctaagttttctaatcatgaatgtttagtaagaattatttcaccatgtggctttagctcaccaagtgatatttaaaaacattcttccattaaatacctgctattttaaaaggtttattacctatttatacacaaacttgttagccaagagctatatttttatggaagagtcttgttacctttcactgacattgttatctacctgtatgtcctgaatgcatgttcagggtcttaacttctgttagaaggaataatttaaacaagctcatgagtactgtagaaaatatggcagacattcatattgagcaagtactctctggtccttggaaagtgcagtatagtcagccacaggcttcagtttgaaagtcttttaagagttagaaacttctgaatatggaagactgcttcttgtttgatttttctctaattgtgaaatatttcaaacataccaaaaacttgtgtgagtcatgatatatgtacccacgtacctaccacccaatttttaaaaaatgaagatttggacacattagattcatatttgaaccattatagagagagatgactcccattcactctctgattccatttgtcatcttcccaacttctctcctgaatttggtattttatcatttaattgcatttccatatatcctgaaacaatcgatagtgtttttgcatattttaaaactatgtaaatcatctttataaatccttctgaaacttgctttttacctcaatattatgttttaaaaattatgatgattggctgggcgcagtggctcacgcctgtaatcccagcacttcgggaggccaaggcgggtggatcacgaggtcaggagattgagaccatcctggctaacatggtgaaaccccatctctactaaaaatacaaaaaaaaaaaaaaaaattagccaggcatggtggtgggcacctgtagtcccagctactcgggaggctgaggcagaatggtgtgaacccgggaggcggagcttgcagtgagctgagatcacaccactgcactccagcctaggggactgatcaagactccgtctcaaaaaaaaaaaaaattatgatgattatgttaatacatgtagctctggctcaatctgactaactgccgtgtggtattatcttatatggttataccatgttgtggtagtttttttctcccaagtgtatttttgaaacaaatagaggatgagcaatctacagagttggcatcagcatgactccacagtcctcttggagaagagtgcccgaggaaggcgcagggcactagcccagaagcacagatagagactagcatggggaagagctcaggaaaaggagggaaatggagagagccatcagacagggtagtaagtgtaggagtcaatgtgtgctcaatatagaggaagcagatctagggtgttcaaggcagatttgggatgaatctcacgtcttctagtcatagcatcactctattttttttttttttttttggagacagagtctcactctattgcccaggctggagtggtggagtggtacaatcttggctcactgcaacctccacgtcctgggttcaagtgattctccagtctcagcctccccagtagcgagattacaggtgtgtgccaccatgccaggttaatttctgtattttttattagagatggggtttcaccatgttggccaccatggtctcaaactcctgacctcaaatgatctgcctgccttggccttccaaagtgctgagattacaggcgtgagccactgcagccagctcgtagcatcgctcttaatctggaagttgacgtacccctgctaggccgtggatatgtaaaaaggatcatttaatttctctgtgcatctgtcttcaagttttacactggtcaggtatggatcactcctcgttttcttgcctcctcctgctcttcctctgtgtgggcacctccagtaggaccggtccgattgtttgggtaaatctagcaacattgacttaagcttactcctcccatggtaagtcaaggaagcacgtgccctttttcctaatagaatatcaaaactaaagatttatacgtatatatttttatccaggcgtggtggctcacgtctgtaatcccagcactttgggaggctgaggcaggcagatcaagaccagcctggtcaacatggtgaaaccttgtctctactaaaaatacaaaaattaacggggcgtggtggcaggcgcctgtaatcccagctacttgggaggctgagacaggagaattgcttgaacccaggagggtcaggttgcagtgagctgagattgcgccactgcactccagcctgggtgacagggtgagactccgcctaaaataaaaaaaaagatttgtgtgtgtgtgtgtgtgtgtgtgtatttctttttttttttttttcttgagtcagagtcttgtcctgtcgcccaggctggagtacagtgccactatctcggctcactgcaacctccgcctccctggttcaagtgattctcctgcctcagcctcctgagtagctgggattacaggaacgcaccatcacacccagctaatttttttgttttgttttttttttggtagaggcagggttttgccatgttggccaggctggtcacgaattcctgacctcaggtgatccacctgccttggcctcccaaagtgttgggatacaggcgtgagccaccacgcccggccatctttcacatttagatgcgtaattcacctggaatttaatttcatgcgtggtgtgagggaagagtgatttcatttctattgcagttgggtaatcagttgactcagaacatttggaagaggctatccttcccctgctgcttcggactgatttctgctgtgttgttctacttgcttatcttagcacctgctccattctgtcttcatatctggtaaagtctgcccttttaattttattttgtttttcaagcttgatttagctaatcttggccctttgtatttccctatatactttggaatcagcttgtcaatttctatgcaagaaactttcaagaattttttttttttttgagagggagtttcgctcttgttgcccaggctggagtgcaatggcgcgatcccggctcacagcaacctccgcctcctgggttcaagccattctcctgcctcagcctcccgagtagctgggattacaggcatgtgccaccatgcttggctaattttgtatttttagtagagatagggtttctccatgttggtcaggctggtctcgaactccggacctcaggtgatctgcctgcctcggcctcccaaagtgctgggattacaggcgtgagccaccacgcctggcaaaactttcaagaattactcaggctgactcttgtgatccacttggagagaaattacacttcacagtattgagtcttcagattcatgaatgtggtatatcctttcatttctttaggtctttaatttatctcagtaatgtttttataatgttgttagtttctgggtagtggtcttgcacacctttcattaaatttattcctggatttgagatacagtatttttcagtcctagaatttatgtttttttttttaaattcacaatcctgctttttaattccctaaacatattgattatggttattctaaagttccattttctatagctttctattattgtttctcatggattttagtcatagtttcttgctgccatatgtgcctaattacttctgatcaaatgccagacattgtctatatagtgatcatttgtgaccacaaagggcttacttttgcatctggtaggtagataggttgggaatagatgcagtccaagatcactttaatctatatagagagaaagtgatttgaaactggctccagtccttatgagtgctgctctatttttagttcatacccaaggtgtggtccttctgagtcccaacaaacaacctgggatgctttccagggcacctcgtccgtgatgagctcctgcctctctgagtctgtccaagttccactcagttcagctacttggtgattactttttgacttcacttggccctcagttcttcacttctgtaatgtcttcagatttaaagaaaaactttaatgtgatctttttagttgttcccattggaagagttggtctgagtgctataattttgtcagtgccataaatggagttcctatgtgtgtgtatgtattcagtttaatgaacatatttttcatattttattaaaaactgagataaaatatttactacacatttaaaaagcccgcttttaattacaaatgaatgagacagtggacattcaaacactgctgtggaagcatatctatactcttcagcgttaagcataataatttgcttatttttttttaaggtctcattctgctattcaagctggagtgcagtggtgcgatcatagctcaccgcagcctcgaactcctgggctcaagcaatcttctcacctcagcctccctagtagcttaggactataggcatgtgccaccacagccagctaattggttttttttctttttttgtagagacagggtctctttatgttgcccaaggtggcttctaactcttgggctcaagcagtcctcccaccttggcctcccaaagtgctgggattacagatgtgagccaccatgcttggctgcataaataatttaaattgcagtcagataggctctacttttgtgtattagatctgtatatttaagacccctgtgtttggaaactttaaggcttggaaagtgaaatctctacgtgcttatattaagaacgactgttaccagtgaatggtgccaccgtgcaaaatattactcttcacagattttcctcaccttttgttctgtgtcacgagcttggagactgcctgtatttttttttttttttgtgtggcatctgttttcaagttttattatggtcaggtattgtattagtctgttctcatgctgctaacaaacacgtaaccgagacttggtaatttataaaggaaagaggtttaatggacacacagttccacatggctggggaggcctcacaatcatggcagaagatgaagaaagcaaagggacgtcctacgtggtggcaggcaagagggcgtgtgcaggggaactgtccttttataaaaccatcagatcttgtgagacttactatccggagaacagcatggggaaaaacctgcccccgtgattcagttacctcccactgggtccctcccatgacacgtggggattattacaattcaaagtgagatttgagtggggaggacacagagccagaccatatcaggtgtggatcatccctcattttattgtttcctcctgctctgtgtcggcacctccagtaggacctgtctagtcgtggcagctgtgggctttcccagctgccatggcacagagaccttgccttgggatcctgggtaagcttgtgtggcccaagttgggacctagtggactctttggacccgttctttggcagcaagggaaaggccaatacctttccaaaggaataaacactggcagctgtgtccagctcacttgggtccaaggtctctggtgtgtatctgatttctggctggtgcccaccttggaggcggtaaaagtgacctgaccaaaggcagactgtactgtactggattggaacctgccgggcccttggggctcccagccattgtgtcatgccctgttggggtgcttcttccttagccacacttggtccattgtggagtcacccagctgctaactgcctgaagtacttctttgtcagacactcctttcagactccggaaagctgatttgcttgagcccagaagttggaggctgcagtaagctatgccactgcactccagcctaggtggcagagcgagaccctgactctaaaacataataaaagaccaaacaagaaaaagaacagcaccatcatccccaaacactcctcatattatccctttgcagtctcccggtcccccagctgatctattccctatccttatgggtttatcttttccgaaatgtcatataaatggaatcatatagcatgtaacctttcgagaatggctttcttctttcagcgtaatgtattttgaaatttattcacacttttgcaagtatcaatagtctgttcctctttattgctgagtagttttccatagtatggttacgtcacagtctcttcattcacttgacatctgggttgtttctagttttttggtgattaagaataaagtggctataaacaattgtgtacaggtttttatgtgaacacaagtttttacttctctagggtagataatcaagtggaattgctgggtcgtctggtgagtgtttgctttactgtataaagaacttccacactgttttccagagtggctataccattttgcatgcccatcagcaatatatgagtttctattgcttcacagtctttgtcagcacttgacattgtcagtatttttaaagctttagctgtttgaataggcatatagtggtatctcattatggttttgtgtttcctaacagaaggaaaatgataacagcggaaatcagtgaaactgaaagcagaaaaaacaataggaaaaaatcagtggggccaggtgcagtggctcacacctgtaatcccagcactttgggaggctgagacgggtggatcacttgaggtcaggagttctagaccagcctggctaacatggtgaaaccccatctctactaaaaatacaaaaattagccaggcgtggtggcgcatgcctgtaatcccagctattccagaggctgaggcaggagaatcacttgaacccaggaggcagaggttgcagtgagccagttgtgccactgcattccatcctgggtgacagagcaaaactccgtctcaaaaaaacaaaaacaaaaacaaaaaacagtagaaccaatacctggttctttgaaaagataataaatttgataaacctctaacaagaccgacagtgagaaaataccaaagacacaaattaccagtcaggaatgaaagaggccaatctctatagactgcacagacattaaagcatgataagggagtactatgaacaactgtatccatatctggtcatatgcccagtagatgtttcgggcaacgattgaccacatatataacagtggctccatgagatcatgataaagctaaaaattcttaccacctagtgaccttgtagccattgtaacacaacacattactcacgtgtttgtggtgatgctggtgtaaacaaacctgctgtgctgccagtcttaaaaatctaatccatataattaggtactgtacataatacttggtaatgataaatgaatgttactggtttatgtatttactgtacaatttattgttattttagagtatattcctattatattttaaaaatgttaactgtcaaacagcctcaggcagacccttcgtgagctatttgagaaggctttgtcattataggaagtgtcaagcttccatgcatgttattacccttgtgcactactcatctttgttcctgtgacctgtaggggtagttgagtgcttttgagaatgggtttttagaaattgtgttgccgagtgaaggacttggtgatattactagggatttggcatctgtgatcctaagtgagattcttctgcagcagtggagttcagccagagccatattccgtacctctgtgatgcagattaattgcctctcctacacacatgcacatttgaaaattactgccttctaaaccttaaaaagttgtgcacaagttgaaatttaataagtgaaattgtacagttatatcctgaacctgatgaggattgtcactgcagcactgagcatgttggtgtgggtggtggctggctgtggacctgggagtgtgcagtgatggagtgagggggtgaacaaggatgatgtacttccaaggggtacccgggtcagtgcagtgaatcaggtgtgctcattgcattgaggaagggttggttttaaaaatggaaggcttagggaagaaaatagtgatttataatatgatgccattcgggtcaattaaaagtacacagacacaaagcaacatgcattctgcagaatatattctaaaagacactataaaaaagtttctaaaagacactatagaaagaagctataagaaaatatgtctaaaagacactaaatgcaaaaaaaaaaaaagtctgaagagatggaacacagtggggacacagggaataaataaatggaaggacaggcagataagcatgagaggcttgggaggagccaagtgagctcttaaagcagaggctctgtgcagagggcagggcttgggcgcagtgcagggtggagtaggtggggaggttgtggtaggctggtgtggaccagagcagctgcttggcccacaggccgtggctcaggctcttcttctgtaggatggcatattaatgcctacccagaggcttccactgaggcttaacttagatgtcagatattcaacggtgtcagtctgttcacacaacaaatcctacaataaaaaatacatctaaaggaaatactcaattatgtactcaataaatgacatcagcctgtgtcttctgattcacagcagccttactgctttgcttgcttgttttgagagaagggagatcttacaaaacactaaaaactctaccatgttcacccagaggacaagctaatcatgagaattgtaatatgtatttctggtctaaataaagtcttcacatcacacatcccctgttagaacttccaggtatgtgtaggaaaccaaatagtgtgcttacattaagaagtgttttcatgatggtgcatttcctacctcattcctaggtggtttaatttgttttcaggctgtttttccttatgataatttactggaacagccgtcctttttcctcctttcccaaggacaccccttggcctgggacggcttgtgtcccatgggtcccttattgcaatacttgtgaaacttgaacctgcacaggagttactggaggatcttgataaagtgcggatttggattctgtcagtttgggatatggccttagagtttgcatttttggcaagctcccaggggatggtgatcacaatttttaaaatttgaagtgttatttacacacagtaaaattcacccttactcttctacagtggtacagatttttgacaaacgcatatgctcatgtaaccaccactacactcccaacgtagaacagtttcaccaccctcaaaattctcttgtcttttcctcactcccagcccctggcaaccactagctgtatctgacgctatggttgtatcttttccagaatgtcataaaagttgagtattcagtagccttttgagtctggcttctttcactcagcagcatgcatgtgagatctatccaaattgctgtgtgtatcagtagtttgttccttttttattgctgagtggtattccattttatgggtccattatagtttatttgtccagacacttcatggaaggacatcagtgtttccagtttttcaatcataaattgatgtttaattttaaaattttggaattgtagaagaaatgcaattcttttttccattgttgttttaggtgacatcactcaaaaaggatatgaaaagaaaagggcaaagctgcttgcacgttatataccgcttattcaaggtaaggtcaatacactcaggtgttacatagcaattatattgtttcataacatgtgatttttaaattgtttttagagtttaacatttgttagcaatgttaaaccaactttaaacactggtatatgttgattattgattgagacagggtctcgctgtgttgcccaggctggtcttgaaaaatatgcctctaatattaaataataaaatccaaaggcatagattataatttaaagctctggcttgatacagatctcagatctcattcccaaagaggatttattttatttttatgattatgaacaacctggcacaattcttactagggctagagcatctattgtaaagatgtcggttcttcccacattagattgatttgtagattcagtgcattcatcatttcaataggttttgtgtgtgtgtgtgtgtgtgtaacttaacgagttagttctaaaatgtatatccaagtataaaaggtcaagagacccaaaatattttcaaaaaagaatgaggtgagaggattggcccaaccaggatatgaagagttattattaaagccgttgtcactaagacagactggacagctcagacaaatgcatatgtgtgcggactttgcacatgggaatggtggtgtggcaggcatggtgctggcatagttctttatccatatatgaaacacatgacattggagacaaaaatcggttccagatgtattaggcctaaatgtgaaaggtctttaaagcctttagaaaatcttacaggaagattgttgccatctcaagataggaaggattttttgatgtcactaaaggtaccaaaaagcaggaaccataaaggaaaggattgattaattggaccacattaaaattaagaactttttttcaaacgtcatcataaagagattgcaaagacaaactacagagtgtgagaagatagttgtaacacaaataagaagtagtatccagaggccaggcgcggtggctcacgcctgtaatcccagcactttgggaggctgaggtggggggatcatgaggtcaggagttcaagaccagcctggccaacatagggaagccttgtctctactaaaaatataaaaattcgccgggcatggtggtgcgtacctgtagttccagctgctcgggaggctgagacaggagaatcacttgaacctgggaggtggaggttgcagtgagccgagattgtgccactgcactccagcctgggcgacagagtgggacttcatctcaaaaaaaaaaaaaaaaaaaaagaactaaagaactagtatccagaatgtaccgagcagtgctgtccagtagaacttcttgcagtaacggacatgttctctgactgcattgtccagtatatgaaacaccagccatgtatgatgattgcacataagaggcaaggtcttactctgttgctcaggctggtgcacagtggtgtgatcatagctcactgcagtctcaaactcctgggtttgagcagtcctctcacttcagcctcctgagtacatgggattacaggtgtgcaccaccacgcccagcttactgattgagatggggtctcgctatgttgcccagactggtcttgaacttctgacctcaagcgagttttctgcctcagccttccaaagtgctgggattacaggtgtgagccaccacaccttcccttaatttaattagtttaaacttaatagccagaaagtctcccaacatgataagaaaagtctagtagagaaatggatgaagattcaaataggttatttcataagaggaaatccaaatagccaatgagcaaatgtaaagatgtttaacctcactagtaatcagagcaatgcacattgtaaccacagccatctgtcctgttggagaggattcaatcagtaggatgcaggcagctagtattacatagtaaagttgaagaggtgcagcagttcttcaggtacatatttgccctagagaaactcctatttgtttgcaccttattctcttgtacaaaaatgttcattatatctgtaaactgccaagaactcaaatacccatcaacagaattcatacagcggaaagctaaagacctacatgcatcagcaagaatgaatcttgtaaacatcgtgaggatgaaggaagcaattacaaaggcatatagccaatacaagcttaaaaaaagacgccaaaccgatctgttaatatttagagagctggtgtagtgagtccagaaagagaaggaaatggttttcacagaagccagcacaccatttcctcatggaagttaaattggagagggccacagggacccctaaggcactgagtgttttatttcataacctatgtggtggttacattgattgtttcttaataatattcttaaactgcatacatgctttgtattgcctatattggtatgatatattttataacagatcaacaacaacaagaagattgacgaggctctttatatgctgatatttattcacccaaaataaaaacaaactcagagtaaaattgggattgaaggaaactattaaaatatctctaaagcccatttgtccaaaatcaccagcaatcatcaaactaaacaaccagatactgtagccatttccattccaaatgggtaaacagaaatgctggccatgcccattcttattacacattatttgggtggtcacagctgatgcagtgcgatggaaaacaaagcagaataaataaatattagagaacaaaagataatcatctttaaatataggtgatattattttatacctcaaaaactcatgtgactgctcatgtaactattagtaagtgattttggtttgatatgaagatagaaggcaaatatgcggcttttctctagcaatatttctgttttcaaatatgaaaaaatcttattcataatgaaaacaaactgtcaaatgcttattaatgcatttggtaagaaagacagaacctacgttaggatcgtaaaatctatttgaaagaaataaccaagaccctaatatatgaagaaacataccagtttcctaactggaaaaacttaatacatcctataaaactggcagatctcaagttagtgtgtgaacataatgtagtccagtctgaataccaggcctgaggttttcctaaacctaggattggaagtgacccattagaagaggcaaagttctgagagtagcccatcaatttttgaaaaagaacactggtgataaaggactggcatttgagttactaaacctgattgtatatgctttatagtcacaacaggaggatgccagtgtacagagtacacgacccagtcagtggaagaaaagaagtccagaagtgatttgagaggatatgaaggaggaagggttaatttaatagctggtactatccttctgcaggcaagaaccctcttcctcctccccaccattagtgaacataaacttcagaataattaaagttctaaatatgtttttaattataaaaacatacaattcaggagactatttgaacacccctttgagtaggaattgtcttcataggcaagataggagacctgggagctagaacagaaaagatggacaggtgcgataggctccctagaaatgagaacatttcagaatgactgagctgctactcgccaggccacagctctgtatgtgtacacagttcagggtgtccacagcagacaaggagtgaggcttcctggtcttttagtgagggtctttagttgggtaaagtagcagaaatccaaaggagaggaaatgtggatgggcaataaatattaaattatgttcaacctcagtggtagatatggaaatgcaaattaaagggcaccatttttctcttatcacattggcaaaattctagaactttttataacatctagtgctgacagagagtggagaaatggcacttttcatacattgcttgtaggagtgtgaattactgtaacctttttggaaagttatctcttcatatctgttaagttaaaaatatatctactccttcatccaataatttcacattgggttttgtatctatctttgttgaataaatgaatctatctcaaagaataaaaggatgcatattttggaatacaagtgtaaggaagtccgtctgtgtatatgtcactttacagcatgcttgtttatcatccataaggtgtaagactctgtattgtccgttgtgaactttaaagttgttttatccagtcacaaaaagccaaaagccagtagggattctgctcattatgtattttgtacatatatatacacacacagacacacacaaacacacgtgtgtgtgtgggtgtgtgtgtggatgtgtgtgtggatgtatatgtacatgtgtatgctcacattttgaagggctaatactgatttctgtagagagtgttcccattctccagtgctgtataactgaccaccccaaaatgtacacagtacttgaacaacatcagcagcatctgttctgctcataaatgtgcagtgtaggcccagctcaaatgttaccttgtccctgtccacagagccagagctgggtgctcaagtcctgggccaacatcctgtgagggctcctcagtcacagctgtggctgttggggtggggagactcctgctgccgagcacctggctccccacccctgcctgtgtctccctctgtcctcatgtggcccctccactggggggcttaacactctagacttggtgtgtggtgttgcacagagccaggtagagccgtgtcgcctttcacgactagccttggaagtcacacagcatcacttctgccacactgcgcttgttggggcagtcactgacctgcccaggtttgaggcagcgtggactctgcctcttcagggagtggtaagggctggaggagccagcgggactgcaattcctgctggccaattttatgaaacattttgaaacaaaggctaaagctaaatgcatatttttgttgaagcacagctgcaggttttgctttgtgctgtctgcaaatgtcagcaaattggcttcaaatgataccagggattttgttcagtgacttgaacaactgttccccattccttcgctcaccgtaatgtgtcttgagggcatctgtgaccaggggaccactgcccagagagtggaggtcctggtgagggagtgtggagagcagcagcgtgaccttgatctgccctgatttggaggcggagcaagtgggtggtgcggcgagggcagctggcccggcctgagcaggtcccagcctctcagcactttgggccctgacgccatctttctaatgcccctctcgctcttgttttctctgacttttcacttttttcctgtttgtatcagagggctactggtggaccccagtggtggtctggtgagctgtttctcactcagggtttaccgacactgtagaacaatgctggggacgaacagcacggaccatttcagacttggaaacgtaattcagaggtgggctttgggagggctttctaccacggctcccacccctgatgtgagctgccatgtactgtgctgccaagggtacagggccagctgtttgatcatcacccttcatgcggatggtgaatgagaggcagggctgggtgatgtggggagaggagagcacggaagtggatgttgcccttaacccacagcatttatgcgtctatcactgacttccagattaaaggctctttgatagagggtatgcaacagatgagaaatgtaagctgttttcaatggactttttcataattggaaaagcaaattgttcacataaggtattcccataaaattgtgtttcaggaatagacccatctctgcaagcagagaatagaattcctgggccctcacaaaccacggccgctgcacccaagcagcagaagtctcggcccaccgcctcgagggatgagcgcttccggtcaggtagggtcacagcctaggcagtggggaaggtggacgggcctggagcccttggactcttgccatgaagtcttccagttatttttcctttgccacaatatctgccaaagaaattattttcacataagcagtaatgtacatcatcatatttttttcaagaaaaacatttaaccttcacgtaaccacagtctgttttaatgtatggtgtagctttagtggcactttcttaggggatgcctacaaaactctctagagaagtcttcttctcactcttactagaataatttctttaaaacttttgtacactttttactttgaagttgatactaataatttttgtgctttatggagcagctttactgctaggtgcaggtgttttagtatttctttttctaattttggagatttccttccaattagatttctgccactctgtttggcagtgcttttatgaatatttaaatttgtctctgatgttttacttgaatcaatagaatggccattgaaaaaaattcacattttctattatagtttatatattaataacttgagcacgttatctatttaatattttcaccactgtgtggttgtatattttcttcacatttaagctcttttgacaggcctttttcagaaaaaattttaatagggataatggttgttttaagaatactgaaaacaaagattaagattttaaatgttttttcaacagggagtgtaaagaaatagtctaagaaatattcgaacagataatgtcttaccaatttgatacacatttataaaaaactttatcatgtggcaaacagcttcttctctgattgtataaataatatatgcttagtgttaaatatataaaaaatattataccaaatttaaggacaaagttaaaaatcacctgatacccctgaatcctgagatggccgccctcagcatttcactgagcactgttgtcctcatgcctggatgcagatgcacgcacacatgtgtactttccatgagagtggtcctagaaaaggtctcctcctttctgccgctccttattttctacatgtcccagctcttctccccaaccctgttccctgctcatggaagtgatgttaataaactggtttctgcccttgtgaagtttatactaggtgtattctttatcttttgaatacaggtcttttatcataaatatgatttgccaatattttctctcaggctgtgatttgtctttgtgtttctttaaagtatcttttgaagagcagaagtttttaatcctgatgaagtctaagttatcatttttttaaattgatagtgcttttgttcttgtgtttaagatatctttgcctaacccaagattacaaagattctctcttgtgttttcttgtacaagttttgtagttttaggttttttagtgccattttagtgcccttaagtttgtgatctttttttttagttaattttagtgtaagtacaaggtatgaatcaaaagtttacttttttgcatggaggtagtcagctgttcctgggccattccttaagcctatgctttctccagagaattccctttgcacttttttctaaaagcagttgcacataaatgcgcgcatctatttctggactctctgttctgttctattgatctattcgtctgtctttatggcaaaacagtgttctcttgatgatcataccttaataataagtgttaaaatcagtagtgttagtccttcaactttgtttcttatctgtgttctgttgtatctaatgtgtcttttttccttcttgcacctttaagatttttctctttatcactgttctgtgggctcgattatatcctctctgaaattcctatattgaagccctaaccccggtgggatgctatttggagtttggtcctttgggaggtaattaggtttagatgagatcatgagggtggggccctcacggtgggatcggtgcccttataagaagaggcattggccaggcgtggttgttcacgcctgtaatcccagcactttgggaggctgaagcaggcggagaccagcctggccaacatggcaaaaccccatctctactaaaaatacaaaaattagtcaggtgtgatgacacatgcccatagtcctaggtattctggagactgaggcatgagaatcgcttgaaccggtaggtggaggttgcagtgagccaatattgccccactgcactccagcctgagtgagactctgtctcaaaaaaaaaaggaagaaaaaaaaaagaggcactagagcttgctggcccccgccctgccccatcaacctatgagtacaatggttagaaggcagatgtctgtaagccaggaagagagccctcaccggacaccaaccatgaggcaccttgatcttggacatacagtctccagtaagaaaaatttgtgttgtttaagccacttagtttatgctgttttgttatggcaactgagcagactaagatgctggtgttgagtgatttgattatgatgcacgtgggctggttttgtttcttgtgcttggggtttgttgagtatttttggatctgttgatataccctatcaggttgatattatctatatttttagttctaggttgtttttaatctatacttattttcctttttttctaagacagcaataatgtttaggggaatcacagtaacttccaaatccatcacaagggtctcagtttgtttcttgctctcttttcgtgagtgcctttttccatgagtgttttcagttaagtccttgtgtggaaatgcttttcgaaccttgtatgtctgataatatttttattaaatattcatatttaaatgataatttggctggatataaaattctaggtttaacactttttgtcttcaaaactattgcttttttgtgcctggtgttactactgagtattgtcagtctgtttcttgatctttcaaggtgatttacctttttctctggaagcttttagaattgttctgtgtctttgatatccatgaatttcctttatcatatgtctaggtgtgaattcttcacctttcctgagtaggaaaaggtttaacctggccctacaagccatttaaatgtgagatttttaaatgttttcagacatttgttggggaaaattgaagcgtctacaaaactggccatcattgtattatagctcccctggacccatagtcgagctccagaaattctgggccatccatgccctgccttggattaatctatactctacctgcttcctcccttcccatatggtttcatagcaaatctcggatatgttatttcatttagatgtcataatattctcgatctctgtcattttgatgtcgtaatagtcttggtttctgtatctgaaaagattgtatttctaaaagataatgccattttcacaaagtaattaacaataaatacttccttaatagcaaatattcagccaatgttcatatggcttttgctcgtatggcttctaaggaacaagtttatttggacccaggattcaaataagagctacacattgcagttggttggtaagtgttttcagcctctatgaaccttagtttgtaggagaagctgagctgtgtttgtctgatggttcctcttggtgtctctgacatgctttttaggtcactaggtttgatgaaagtcaggttacaacgttcagctgtttacaagactgtcatgggtggccctgtgttcctccaccaagaggcctgttgggcctgactcttggctgttcactgtggtgcttgaaaaccagtgatttttctcagttcttagattgatttcctttgggctgcaaaatggtgaaatttagattctgacattccttcttcactcaaaggccagaatatttccgtaaagagaaacttctgttatttacaacttggtacaggaaagaaagtcaagatgaatatttaattctttccatttatttactagttttcagaacaataggttgagtcactggcctcctccaatggcaaccaattgattgcgtttcctcttttcctttttcttcttttcttctgtcagtatcatatttgatgtttcagtccattttagtatttattcttaccgatattcagattgtcccattcttcgccattgggaatctcttcaaattggctcgagttgtttgaccatttcctggttggctgttaggataagaagttctaggttcatcctgggcatttctcccctgctccagaatctgccatttctaagggttttttttaagtgaggatggtgtttcaagaccacagtctgggcactaggatgctgattgctattgggctgattgttgtttgtagacattttcactgtacagaggtaagacagacttttaaaagacaggataccacatttgtttgtagtgacataatctattcagattcagaactgcagggtctgtacttcatctctctctctccctccctcccttccctccatccctccctctttctctttcgctttttctcttctcttctcttctcttctcttctcttctcttctcttctcttctcttctcttctcttctttctctctctctctctctctctctctctctctctctgtttttgagatggagtttcactcttctttcccaggctggagtgcaatggcgtgatctcggctcaccacaatctctgcctcccgggttcaaacgattttcctgcctcagcctctcaagtagctgggattacaggcatgcaccaccatgcccggctaattttgtgtttttagtagagacagggtttctccatgttgaccaggctggtctggaactcccgacctcaggggatccgctcacctcggcctcccaaagtgctgggattacaggcatgagccactgtgcccatcctctctctctctttcttttcttccttccttccctttctttccttctttttctctttttctttcttgggttctcactctgtcacccaggctggaggcagtggtacaggcatagcttactgcaccttggaactcctgggctcaagtgatcctccagcttcagcttcctgagtagctgggaccacaggcgcatgccactgcacctgcctaattaaacaaaaaaaattgggccaggtgcggtggcttacacctataatcccagcacttacagaggccaaggcgggcggatcaccatgtcaggagttcaagaccagcttggccaacatagtgaaaccccatctgtactaaaaatataaaaattagccgggcgtggtggggggtgcctgtaatcccagctcctcgggaggctgaggcaggagaattgtctgaacccgggaggcggagattgcagtgagctgagatcacgccattgcattctagcctggcgacagatcgagactccatctcaaaaaaaaaaatttttttttcagaaatgtggtcttgctgtggtgcacaggctggtcctggcctcaaacgatcctcctgcctcagcctcctagagcgctgggattacaggcatgagccactgtgtccagcctacctctttcatctacatttgtatctcctctccctcatgagtgtccaagctctagctatggtagaatcagactattaagtgcttttcatttgccatatcccacaggactcacgaagaatctatatgacaatgccttcactgctatcaacaatatgagagagtttaaaagtttttgttcagttatttttgtccttattagatatttctggaagtagaggttgaccagtctaacttcagtgttttaaagtcagctgcaatagtttaaaccaggggtgtccaatcttttggctaccttgggccacgttggaagaagaataattatcctgggccacacataaaatacactaacactaacgatagctgataagctaaaaaaaattgcaaaaaaatctcataatgttttaagaaattttacgaatttgtattaggctgcattcaaagccctcctgagccatatgaggcccatgggccacgggttgaacaagcatggtttaaaccaacaactagatacacatttaggctcatttgtttcactttattttcaattttggggatttctcttttattcagttttgatttataactaaggaaatatttacaagattccaaagttagatctacaaacaaagaaatatttaaagaaatctaggaccaacatgtgaggatagacagagagagcttctattccttttacccccactgaaaacaaacaaaaacatgaaacttaatttgttactttataaacagtcttgtaaaaagtatttttactgctgtccttcctgtgtagatgtccacactgaagccgtgcaagcagctttggccaaatacaaagagaggaagatgcctatgccttcgaagagacgttctgtccttgtgcattcgtctgtggaaacctacacccctccaggtattgataaacaatgtcaagtgtggcttttttttgagtgtttcacaggcctgatgttatcctatttacttcccattgagttggaatatccgtctggcctgtagtatagattggacgcatttggagattaaaaatgtttgcatatgctcgtattccttacctgaaaatctatggtgtacatagtattcttacccaaatgggtacttgctttctataagactttttgtgtggatcttaatttcttttactaagatgctatttatgtcttttagtaaagagaagaacctaaagcactaagaggagcctaaaataagcactaagctaaagcttcctgaattaggaattttacagttattgtcatcttattacctataacttaacaggttgtaaccaggacttatatgcaacagtataagactatttggaaagttttgcggttgattttgttgttgttttattgttggtaccattagaaatgaaaacttttatatgaggtttctctctagcaataatgtattttagtcttcctgttaaactgtacaagatgtcgatagtgtctaatgacttcacattcatgaacttgcattgttgtcatatatttaaagtatcaaaaatagtgacacccatttttggtttgaggtatttggagatactacacaataaaaccaaacacaccagattcgtaagatgatttagtggttttggtaacactttcttgcttaaaagaagtttattgttgaaaaaaatcttagaaatggctgtcaaattattgtttttgctaaatatagctatagacactatccaattttaaaataatgttttaataattgtaaaacccataatgaaacacacagtcatgctgacttgaagaaaccttaatgtacagttaattttgttgtctgaagcaattttctcggagaaggaattgtttttagggctagttcacatgactcccctgaaaggatgcatgtagacagggctgcggttctcccatggccaccatgttgttgctggggccatgcacaggccaggatgccttctcactgcctccaagatgtagggccgggcacaggctctcccctgggtgatgctgactgatgtgtggatatggtgtccgactctgtggacatgcagtgcagcactgaatattcacagaacacccccactgaggtatatgctgaagccgtttaggagatcagaggctgtcttcactgagtgtgtctggtaccctgtggctgagttctctctggggagctgggggctcatggaatcattttccccacagtagggcttcttgcatgcccttctagattgagggtgacctttgagctgactgcgtggctttgggcagagctgtgccaggtgtacagaagcatgctgcacacaggtctgggaggctccagtgtgagtgggaactccgtcctcctcttgactcatcccgatatcatgcctgtcatcgttattttaaccacagacacgtcgtctgcctcagaagatgagggctctttacggcgacccgggcgactcacctccactccgctccagagccattccagcgtcgagccctggctcgaccgggtcattcagggctcgtccacctcatcctctgcatcctccacctcatctcacccgggagggagacccaccactgctcccagtgctgcagccacgccgggggccgccgctaccactgcactcgcaggcctcgaggcccacacccacataggtcagtaataagctgctgcggcccctgtgccagcagagcggggtcaggagtgtccaggacagaggagcagatggagggcacctgagccaggcgccaccctgcagacttagctgcaggcctgagtgctctccaagtgactgaggtcacacaacccagataacccatactggcttatctgcctgagacattaaattgattttgagcttttaataattgcacttgaaagaaatgggctaatatttggttaattcatcattcagattaaatccctaataaccttttgaacaatacagctcagttgcaaattttttcccccatcaagacctacgtatttttcatctgggaaatgtccttttggtaacaaaagtagttgttgatacttctttaatttggcagtcctagtcctttggggcatggggcatttctcatagtcccccagaagggtgtggtgtttctcagtgtcataacaccttcctgctcttgaggggaagctggtgcatgcagtaggtgcaggggtagatggtcagcacacatccatacctgctggtggctgtgatcatcacccttgacctggccgcctctctgttgtctgtgcctttcctcttggctatgtgttcacagctgcaggcccattggttgtctctgtacctggctggaattctgaggttggggtagagggctttcgctcctccagataccaggttagacagcctttggcctgaaaaggtgtcagtcagagctaatcatatgatgcatggatctttcccaaatcatggaatcctttaaattacattcatcttagagatgaaaaaagtgtaaacctttcatcctttgaaattctattttttaactaaaacagcagcatagttagctgtatgtagctggcatgtgaaacccacatacactcttgcacaagtaccttaaaatacaatcagtattgttgaagactcatcttaatcccctcctttttttcccagatgaggaaggaagaaaaaaaagtccagcgattgtaacttgcttgagatcagacagcagccttaagtggtgaagccagggctgataccagttttcttgattcctattcattttctttgctttttgttgcttttctgccaaaactgaaaggtgacacctgtgacacgctggtgtttgtgctggggtccccatgggtgccgagctcttttttgtaagacctcggtcatttggctggactgggggcaagttgggtatgttgggtggcccacagcttctgtctcatcatcctctgtagtgtgcatcactgttgctcttcatgtttttgtttgtttgagtcagcacatctcttgtgtttccattgaacatgtgtccttcttctgaggcgtccgtctcagatgaaagctcacagtgccctgctctgtctccacactgcttccagctcataaaggaactgccaagactacaagggtagcagcaggcagcattttccacagagaaagtttctcttaggaaaacagcctgctcagattgtttctgtagctttcctgggtgttccatggccagaggctgctgcccacctttcctcaaggtggtgtacagtccatatcttgaaaacagcttttgcactgttgtttgccttctctgttcatcgttggtgatttaactttgtagaaatacatagttaactccaattctgaggcaggggcaggaaaacagtagttttaaatgttctgttacctcatttcttctcccagaagctcctttctaggtgagatggtgcaggagagcaaacaaaacatttgtagtttgagtttattagccattgctgagtcatctcaacactgtttccgggtgggttagaaataaaagcttattcagcatgaaaaattagccacagttcagaatgtttaaccgtacagccctcaactttccagtgattgtggggtgtctttaagcaaagcattgaactctaatgtgtgtttgaattagatgttttcattctctgaaaaggacttggctgcaattatttataatgtaggtttattacctatgttggtggaagacagctcctgactcctgcagatgcagctgtaatcatctcttcctttcttgttagtcctagcatcaacattttgtgatcaattctaatacatttaaaaaaaattcttaacttggacttgatttaatactttgcttacaggattgcaattttctacagattgtagctacccacatcctaaatgttggacatagttaatttgaatttctaaatctcaaaaatactcaacttccctcttatgacagaaatcatcctttgttttagtttctaacactagatgtgtcttcaatttaaactaaggaaagaaacatgaaaagaggaagaatatattaagtaaaaaattcgaggtagaacatatcaggtaaagataatttttaaaaatatatcactttcagttttggattaaggaaatcaaatacattaagccttttttatacaaatgtaaatacctatttttaaaagcagtacttttaattatagtagcttcttttaattatagtagcttatttttattttgaatgtagtttatgtttatttttatgcagcttttttttttatttttccacctagagacagggtcttgctctgtcacccacgctggagtacagtggcatgatcataggtcactgcagccttgaactcctgggcttaagaaattctcccaccttagcctcctgagcagctgggactataggcaaatgccagcatgcctagctaatttttaaaaattttttggaaagatggagtttttactgtgttgcccagactgggcttgaactcctgggctcaagtgatcctcatgccttggcctttcaaaatgttaggattataggaatgagccactgctcccagccattatatagctgttttaaaaaactacttgtagtacatgtatgtataccatgtatacctttttttccatatatacttttaaaatcatttattctttttgctagatttggaagagtggggaaatttctttttaaactaaaagaacctcctgatagacatactttaaaatgctaatttgatcagcatcaggctttttcaagggttgtgaaaaatcttaacggtttagattttttcaaaaggtatattctgctatgcagacagtgagtttgtgctttcatatacttcagctttctacaaacctagtaaaaagttactgctttacattgtacctaggagtaccacagtgatactaacaggtaccttcattaaaatattaaacattaccagttgtctctacctaacatagactagtgtttatttatttatttttttggagataagatctcactctgtggcccgggctagagtgcagcggtatggtcctagctcactgtaacctggaacttctgggctccagtggtcctttcacctcagcctcctaagtagctgggaccacaggtgtccaccaccatgcccagctaatttttttttttaagagatgggagctcactatgttgcccaggctgatctcaaattcctgggctcaagtgatcctcctgcctcagcctcccaaagtgctgggattataagtgtgagccactgcacagctagtgttgattttttttttttttttttttttttttttgtgacagggtctcactctgtcccccaggctggagtgcagtggtgcaatcttggctcactgcaacctccacctcccgggttcaagcgattctcctgcctcagcctcccgagtagctgggattacaggcatgcaccaccacgcctggataatttttgtatttttagtagagacagggtttcaccgtgttggccaggccattctcgaactcctgacctcagctgatctgcccgccttgaccttccaaattgctgggattacaggtgtgagctaccatgttggcccctatgttgattcttataaatgggcgagcatctgtgtattcattgttgtggtagaacacaatttctatagtcatatagacacagtgcctttcctagtggtagacccaattataaccataattcctataggaacttacagtcagccagcattctgaacagatagatggactgtaccatggaaataaaacacaaaaatgtacattcagacaatggaaggagtgacttttacatatgttccagatctaatgtctgtttttaaatgttacaccaattctactttaagaacttgattgtggccaggcgcggtggatcacacctgtaatcccagcacttcaggaggccgaggtggttggatcacttgagtccaggagttcaagaccagcttggccaatatggtgaaaacccgtctctactaaaaatacaaaaattggctgggtgtggtggcacatgcctgtaatcccagctacttgggggactgagacaggagaattgcttgaactcaggaggcagaggttgcagtgagccaagattgtgccactgcactccagtctgggcagtgataaagtgagactccatctcaaaaaaaaaaaaaaaaaaggaacttgattgtggtctcttagttttgcagctgttttaactggcagtgggggaagttttaatttctgtagttttattcttttaggactgcaaaggtttggtgtccaacatacttttttgggggttgtagtagtttgtatgatcctggctgtttttttcataatgtaacaaaaaaatgtaccagtgacaattgatttcaaatttgtttctgcttccttgagggaatttcttccttccttccttccttccttccttccttccttccttcctttctttctttctttctttctttcctttctttctttctttttctttctttctttttctttctttctttcttttctttctttcttctttctctttccttccttccttccttctttctttcttttttctttttgagagagagtgtcgctctgttgcccaagttagagtgcagtggtgcaatctcagctcactgcaacctccgcctcctgggttcaagtgattctcctgcctcagcctccccagtagctgggattacaggcatgtgccacgacgcccggctgatttttgtatttttagtagagacggggtttcgccatgttggccaggctggtctcgaacccctgacctcaggtgatctgcctatgtcagcctccccaagtgcagggattacaggtgtcagccaccatgcccagccccttgagggaatttctaaccaaaatctcatcaggccattgtgacaggcaggtttactctgtgcctgcctctgtgctgaagatggtggttctgagtctggatccctttgagaattgagccacccacatgcacgcagatgtctgcataacgtgtctgggagttcatagggtcccagtatgcctttggtcagccaagaaaacaaattaatgaaaataccacactctccccacttagaactcagctagtggagctttagactaacggggtttcaagagcagcttaatactcatttgacttaacagccactttcattttgggtgtgtttttcaaaagcagatctgcattctgcccctcctgatgtcaccacgggcctcgtggagcattcgtactttgagcgtccacaggtggcttctgtgagaagtgttcctcgggggtgcagcgggagcatgctggaaacagcagatggtgagcctgcctctctttctcctcgtgaaatagcagaacacaggttttgtctttgggtattgaacacagctttaatgtattcactgtagcaaacccaagccaaacgtcagttttaatccatgcagataaatagaaaccagtgtgtgcagttaatgttatagaaagcatcatgtggagaaataattggaaatatcaatggaattggtcagaggggaaacgaggagagtggggagggaaaagacttccaaatttagataggatgcaaagggcgtttcgatctgcaatatagtagggaaatgagaagctgtgggaagtttctttatttagattcaatgtggcagacagaatgacttagtcagtgcgagtgcacacacccacctatgacagaacagccccctacactctccatcttcagcagactgtgaaatcggtgcaacagcaatcatggtttcccatgtgcaggctcagagatgtcagtgtaactttcataatgtcctcatttacaccatttctttttgaaacagtcttcaatgtcttttatcaaaatcatgtcaatttttttcccaaaataataatttaaataaaaattaagaggagctcagagctagggcctatcatatatgttggtactcccaaacagagtgtcagattttgttgagggctttcatctccttgtccagaggcagaagaaaaatactgaatcaacatgaagcagtctgtacattggctagacatgtatttaattcaatttattactctttatatttaaaaaaattaagagcttaattaaagggtaattgacataatgaattgcacatatttaaagtgtacagtttcggctgggcgcggtggctcacacctgtaatcccagcactttgggaggctgaggcgggcagatcactaggtcaggagatcgagaccatcctggctaacgtggtgaaaccccatctctactaaaaatacaaaaaaattagccgagtgtggtggcgggcgtctatagtcccagctactcgggagactgaggcaggagaatcgcttgaacccgagaggcggaggttgcagtgagccaagattgtgtcacttcactccagcctgggcgatagagtgagactcctttctcaaaagttttaagacatttgtacagctgtggaaagcatcactacaatcaagatagtgaccatatccagcacgcccaaaagtgtccttgtgttccttggtcctcctctcttcggatccttctggctttccccatacacttcaggcagccaccgatttactttctgtcactatagattagattgcattttctagaattttatataaaaggaatcatacagcgtttacgtttatggtctgccttctaccactctccataattattttgagattcattcatgttctgtatcaatagtttactccttctcattgagtaatatttcattaaatggatgcaccacaatttggctgttcacctgttgatgtgtatttaggttgtttctagtttgggccggttacaagtaaagctgctatgaataatcaatcttgtatacgtttttgcatagatgggtactttcatttcttttgggtcaatacctagaagtagaatggctgaattatattgtaggtgtatttcacctttttttttggagactgagtctcactctgttgcccaggctagagtgcagtggcatgatcttggctcactgaaacctcgccatcctgggttcaagcgattctcctgcctcaccctcccaagtagctgggattacaggcatgtgccaccacgcccagttaatttttgcattttcagtagagatgggatttcaccatgttgtccaggctggtctcaaactcctggcctcaagtgatccacctgccttggccacctaaagtactgggattataggtgtgagccaccatacccagcctattttaactttttaagaaactgccacgctgttttccaaagtgattgtaccattttacattctcattattagtagtgagagtatcagttcctccacaccctttccaacagttggtattatgtttaaaaaatttcagccatcccaataggcatgtagagatatctcattacagtttcaatttgcatttccctaacggctgatggtgtgttgaacatctttttatgcacctatttgccatctgtgtatctcttgagggaaagtatctgttcatacttttggcctatttttttttttaattgtgcttgtttttctttctttctttctttctttctttctttctttctttctttctttcttttcttttctttcttttctttctttcttctctttttttttttttttttgagacggagtttcactgtcacccaggcagagtgcagtggtgcgatcttggctcactgcaacatccacctcccaggttcaagcaattctcctgcctcagtctcgtgagtagctgggattacaggcatgtgccacgatgcctggctaatttttgtctttttagtagagaccaggctggtcttgaactcctcgtctctgcctgccttggcttcccaaagtgctgggattacagtgtgagccactgtggccagccaaattgtgcttgttttcttattgagttttgagggctgtttatatattctagatacaagtcatcccatatgaggtttatcatttgtattttctcccagtctggcttgctttaacaatgcctttcaaagagcagatggtttacatttttatgacattcagtttaccaaatttttttatatattgtgcttttgtgtcatatctaagaaatttttgtctaacccaaggtcacaaatgttttctcctatattttcttccagaattttatagttttagtttttacatttaggtagatagttcattttgagttaattttagcctaagtatcaggtatgaatcaaagtttacatttttgtatgtgggtattcagttgttctagcatcatttataataaagaccattcttttcccaccaagtttccttggcatctttaatgaaaatcggtagaccatgttggagagggaagggtctatttctgggctctgggctctgtgtgttgttccgtttccttatttatctgtccttacacctcgtatagccatgaccactgtgattttcttaaaattcttgaaattatacagtttgagtcctccaactctgctttttttttttaattttctgttcttttttttttttttttttttttttttaagacaaagtcttgctctgtcacccaggatggagtgcagtggcttgattttggctcaccgcagcctctgccttctggtgtcaagcgattctcctgccttagcctcccaagtagctggaactccaggcaactgccaccacacttggctaatttttttttctttactacaggtgcataccagcaagcttggctaatttttgtattttttagtagagatgggattttgacctgttggccaggctagtctagaactcaagtgatctgcccacctcagaaccccaatgtgctgggattacaggggtgagccactgtgcccagccccccattttttttttttttaaatagtgactctgttgcccaggctggagttcactgacatgatcatggctcactgtagcctgaaacttctggactcaagcaatccttccttctcagcctcccaaggagcagggactgcaggcacaagccaccacatccagataattttttattttttaaattttttgtagagacagggtcttgctgtgttgaccaggctagtcttaaacttctggcctcaagcgatcctctcctgccttagctaaccaaagtgctgggattacagctgtgagccactgctcctggctggccaatgactttttttttttttttttttttttgagaagaagtctccctctttcaccaaggctggagtgcagtggcgcaatctcggctcactgcaagctccgcctcccgggttcatgccattctcctgcctcagcctcccgagtagctgggactacaggcgcccgccaccacacccggctaattttttgtatttttagtaaagatggggtttcactgtgttagccaggatggtctcgatctcctgacctcgtgatccacctgcctcagcctcccaaagtgctgggattacagggccatgacttcttaacattaccatggaatagtcgtgacctcataaacttcctgaaagggacttggatgccccaggggtccctggaccatttaaaaaactgcttaggccgggcgcggtggcacacgcctgtgatcccagcagtttgggaggccaaggcaggtggatcacgaggtgaagagatcgataccatcctggccaacatggtgaaaccccatctctactaaaaatacaaattagccaggtgtggtggcgcatgcctgtagactcagctacttgggaggctgaggcaagagaatcgcttgaacccaggaggcggagattgcagtgagctgagatcatgccactgcactctagcctggcaacagagtgagtctccgtctaaagcaaaaaaacaaaaacaaaaaaaaacctgctagcttagaacaagtcctgtttcctggaaggcattcagtaagtgttttctaaatgaattgattccaaaatgactgtccagtggggcccacacttggatggatttgtaagctctgatgcatcgtgtggtttgtccttggaccttacacctgtgtccacttcttcagatgtgtcctggcctcagtgctcctctgtccttcccgtgacaggtgtccctgtgaacagcagagtgtcctccaaaatccagcagcttctgaacaccctgaagaggccaaagcgccctccactgaaggagttctttgtggatgattttgaggaattgttggaaggtaagagttgtccaactttgagcttttctgtttgtatgaaaagggtggccacgaagttgagaaacacaggcaaatgtatattatacatggatattgctatatatattctgtttccagactcagtggtcactgggtgtaatggtgaatttagaatcacatgactgcttcctttatttgagcaggtagaaaatttgctgctcatattcaagtgacttggcatttcataaaaattcttctacggttttatttaacttacattatttaaatgtttaatttaaactttaactctgaaatacttaccttcttgtggttttaaagtatttaattttcagcatagatttggctgcttttcagaattttagcctctcatatgtgaatgaaatacgtatttaggaagaatacacacatattttttaaaagagaaaactagcaagcagaaaccagaaatgaagccagtacaaacatgtgagtgtgtcgttagggccacaggggccccatgctggtcctactcgcagaccttggctgtttgtacagtgacactgctgacagccgaccagcccagagtctcctccacacccgaggattagacatagctttcaggagattatttccccgttgtaatcagatagtgtgtattagtcagggttctctagagggacggaactaataggatagatgtatacatataaagggaagttcattaaggcatattgactcacacgatcacaaggtgaggtcccacagtaagccatctgcaagctgagagcaaggaagccagtctgagtcccagtgctgaagtacttggaatccaatgttctagggcaggaagcatccagcacaggagaaaggtgtaggctgggaggctaggccagtctagtctttccacgttcttctgcctgctttattctggccgtgctggcagctgattaaactgtgcccacccagatttagggtgggtctgcctttcccagtccactgactcaaacgttaatctcctttggcaacaccctcacagacacacccaggaagaatactttgcatccttcaatcccatcaagttgacatcaatattagccatcacacagtgcctttcaaattcagagtttattggtatgaatgcatcttagagcagtgtttcttaccacttgggcaaattttggttatacagctcctagaaaaagattaattctttttaaagtaaaaaacaagattaaagtaatctttttccaggagctatataatcaaataatctttttttttttttttttttttgaggcagagtctcactctgtcgcccaggctggagtgcagtggtgcgatctcgaatcacttcaagctccacctcctgagttcacgccattctcctgcctcagcctcccgagtagctggtactacaggcgtccaccaccacacctggctaatttttttttgtatttttagtagagacagggtttcaccatgttaaccaggatggtctcgatctcctgacctcatgatccacccgcctcggcctcccaaagtgctgggattacaggcatgagccaccacgcccagcctataatcaaataatcttttaattctttttctttgaacatagtgatagttgtttggatccctaggctgaagtggtggttctgcttgctttcctcctgtgtgagtgggccaccaggtcctatctccaggctgtggatacctggctgttcaccgctgtggtgccgggggtagcagaggtgccacagtcctgtccagaagttgggaaagtgggaaccactccaaggtcacctttgtctgtgaggttgtggtcaccaggatggtgggttgtttttaactttatttcacagccgtcatcatccatgactaaagctcctttaatcctttggttagttgtcggtgactgtgatgcaaaaatcgaaacaaattattgtaagcttttttatagttgggattaaaaaacaatattataaactatgaatgcttaaaaacagaatgtgttcgtggtgctctgaattgctgattttaaagttttgattttgcttgtagttcagcaaccagatccaaatcagccaaagcctgagggaagcgagacgagtgtgctgagaggggagcctctcactgcaggtgtcccccgaccgccgtcgctgttggccaccttgcagcgctggggcacaacacagcccaaatccccctgtctgactgccttggatacaactgggaaagccgtctacactctcacctatggcaagtgttaacagaaagcagttgtgcttctgggttagctgtagaatgtcacacacataacacagcatagacatacagcttgataaatattcctgagaaaccagcacagctggcagataaatagaacattgacctataccaggtacccatcccaccggaggggaccactcactgatgcatggtgactgccattgctctgggttcaagtgtttggagcgttctatgtatgcattctgaacagtgtagtttagtttcgtcttattttcaactttgtataaggggaatcaggcagtatgtatttctgtgtgtttgacatcttttggttccatactatgttttttttgtaacacaaatagtaagcatatatacaacctgatgaattcacagagtgaatatggtcctgtaatcagcactccaagcagaagtgttgctaggttcaaagcccctcacaccccttccacacgcaaagggtaactactgtcctgactgcccacactgttggctttacctgcctttaaacaagtgttcttttagtttattctcattgatggtattattttatcgtgtgaatatactggaacttacttacacactcttaagtagatggacatttgggtggtttccactttggggctattgtgtatagtgctgttagggacatgcttatgtgagtttcttggtgagaatatgtaggcatttgtgctaggtataaatgcagaagcagaattgttcagcattaggacatactgccaaacagttttccaaaggcagtgcagcagttttcactcccacaggcagtgagtatgtgaggggttccagttatctcttttctcaccagcttttgatattgtttatttcattatagtctttgttgtaggtgtgttgtagcacaggctaatttgcatttgcctggtgacaaattatgcttttcatatgcttattggttgtttgaatatccacatttatgtactattcaaatatttggctcatttctctgtttgctaatgctttcatctttcttttttattttttttctgagaaaaggtttcactctgtcactcaggctagagtgcagtggtgcaatcatagctcactgctgccttgacctcctgggctcgagatgctcctgcctcagcctcctgagtagctgggaccataggctcacatcaccacacccagctaatttaaaaaaaaaaacaaacaaaacaaaaaaaactttttttttgtagaaatggggggtctccctatgttgcccaggctgatatcgaactcctggctaaggcagtcctcccatcttagcctctcaaagtgctgggattacaagtgtgagccactgcacctggcctcttatttctttgtatgtttcagataggcatctttcctgagatgcatgttttgcaaatgtctcctcactatttggattgccttttaacacttttaattatggcttttaatgaatgaaaagtcttaatgtaatctaacttacatgttgtttttttttcctgtattgtagctaagtttttgtctaatttagaaattttttaccaaacttaaggtcacaaagatattttcctgcatgctcttctaaaacctttattgttttacttttcacatttaggtgtgatgatccatttagaatttaattttgtatattgttggagtaaagttgtatattgttggtataaagttggagtcattttcttatgagtatctaactgactcagtatcatttattgaaaaggcaatcctttccccaaagtactgcagtgttactttgttatatagtgggtgaaaaatgtacttgcgggtctgtttctgggctcctgttggcggggggtgttgtcagtctgttgtctctccatgctctgaatcactgtagcattaggagtcctcttgctctgtgatggttcctcaagattgccttgactcttcttggctctttgtatttccaagtaaactttagaattaacttgtcaatttccataaaaattactactgggatattgattggcattgcattgaatctctagttcaatttgagtagaattaatgttttataggttgagagcatcccaaatatgaaaatccaaaatccaaaatgctctaaaatctgaaactgcttgaagctgacatgatgctcaaagaaaatgctcattggagcattttggatttctgatttttggacttgtgatgcgatgctcaactgggaaataaatataatgcaaatattccaaaatctaaaaaaaaattgaaatcccaaacacttctaatctcaagcatttcggataagggatactcaacctgtattacaattatggaatcttccagtttatgattgtggaatattttcccctttttaaaggcctgcttcaatttctgtcagtaatgtttttatactttggaatacagaagtcttgagcaccttttattagatttattcctgttacaagtgctgtaatttgtaattttctctactgatttgttgcttatatatagaattgcaatctatattattattattttaaaatgatgactttgtgctgggcgcggtggctcacacctgtaatcccagcactttgggaggccgaggcaggcggatcatgaggtcaggagatcaagactttcctggctaacgcggtgaaaccccgtctctactaaaaaaaatacaaaaattagccgggcgtggtggtgggcgcctgtagtcccagctacttggcaggctgaggcaggagaacggcatgaacccaggaggcggagcttgcagtgagctgagatcgcaccactgcactccagcctgggcgacagagcaagactccatctcaaaaaaaaaaaaaatgatgactttgtatccagttatctcactaagttaacttattagttctttgtttactcataattagaagtttgtctatatatcttttgtattacctgtctacaaaaatcacattattggtgaataatgatagtgttattttgtcctttccaatacttaaacttttattctttttttttttttttttttttttggtttttttttttttgcacaagctagaacctccagtacagtgtgaaatagaacaatgttgaagagtgggcattcttgcctgtttttccatctgaggaaaagcctgtggtaattaagtatgatgtgttctgtagttttgtttgcttgtttgttggtagaaactgtcagattaagaacgttcccttctccttgtttgttaaaagttgttatcatgagttgggattgaattttgtcaaatgctttttctgctgctagaaagaagatcatatgattttcctccttcattaatttggtgaattattttgattaattttctaatgtaaagcagccgttcatttgtagaataaatcccacttggccataatatcttacccttttaaatatacacccagatttaatttgccaataagttgtttaggatttttacgtctgttttcattagaaaaattgatctgtaattctttaagaaaggagcccattgccagcctttgatgagtatgcctagctcacagcctcaactgttaaaccagcgttcaaatctaggtcatgctattggcagagcagtccctggccaatggccaagtaaggcagtgggacaagggcctattttctgttagcatggactttccttaaaaacagcattgggcttgtggagactgtcagttctacattgtggcttgacagctcctcctgcccaatcttgctacctgtcttttcctatcacagatttttattctttagtaatccttttgcatgcctgagcctttctcagcgtctgctttgtgaagaacccagcctgtgacacacttcctctttttttttttttatatattctccttggcttgcagtttaagtctgcatttatttacaaagtgtaagatattactaccattgtgtgtatttatttatttttttgagacaaggttgtgttcggtcacccaggctggagtgcaagggcgtgatctcggctcactgcaagctccaccccccaggctcaggtgatcctcccacctcagcctcccttttacctgggaccacaggcacacaccatcatgcttggctacttttttgtatttttagtgtagtcgaggtctcgccatgtggcctgggctggtctcaaactcctgagctcaagcagtctgccggcctccctcccaaagtgctgggattacaggcgtgagctcccatgcccggcccattgttttttgtttgtttgttgttttaatcaaccatacatttttattctttcttttactatatacattccttcctgagattctgtattttcctgggtaatcatttccttctggcctgtagaacttcctgtatgttcgttatactgtagctttgctggcaacttcatttttgaaggttatatttcgtggtggtttatcttctttcagcaatgcaaagatattgtttataggcttttgagaagatgccagaccattgttgctctattgacagtaatgtgtatggccgcttaaaaagtgttctttttatttgaattgcagccgtcttactatgacatttagaggtgatgttctttgaaaatttcctgtgatgttctttgaaattttcaagatgtccacagggcttcttgaatctgtagaatggtgtctttcatctgtttgagaaaaattacagccatcttctcttactatattgcttcttcctcactttttttcttctctccttctgggactccagttacacttatactttttccctgagtcctacatttttaatgttcttttttatattttgcattctttcttatatatacttcaatttgtatattttctattttcctttattcaaattctttaatcttgtcttctgaaatttctttttttttttttttttttttgagatggagtctggctctgtcgcccaggctggagtgcaagtggtgcgatgtcagctcactgcaagctccgcctcctgggttcacgccattttcctgcctcagcctcctgaatagctgggactataggcgcctgccaccgcacccagctaatttttttgtgtttttagtagagacagggtttcactgtgttagccaggatggtctcgatctcctgacgtcatgatccacctgcctcggcctcccaaagtgctgggattacagccatgagccaccgctcttggccctgaaatttctaatctgctgtgaaatcctgatgagttccttattttagatattgccttttcagtttagaattttcatttctttattatagttactattctaatactctggaaaaatttctcattattccatacactttcctaatctttgcttctgctgccttgaatacacacattaattattgtaaatgaaagtctttgttagctaacaccaatatctgtatcacctttgggtctgttgctcttgtctgtgttttctctctctttttttttttttttttttttttttttgagacagagtcttgctctgttgcccacactggagtgcagtggtgatcacaactcactgcagccttgacttcttgggctcaagaggtcctcccaccacagcctcctgagtagctgggactacaggtgcacagcactacgcccagctaattttttctttctttcttattttcttttttttatagagatggggtttcactgtgttgtccaggctggtcttgaactcctgggctcaagtgacctgcctgcctcagcctcccaaagtgctggattacaggcgtgagccaccatgcctggcctttttgattgaatattgtatgttgtgtataaaaacattatggcaggtccagacaatgccatcttccttaagagaaacctctttcccctccaagtagagtagtggctggctggtcgctgcagtccagtcatgcctggcccagccggcctttgctctcctctggctctcctgggctttctgccagtgcctggtgtgtccatgtgtctctttcctctgatggcttcccagccgtggcgttggtctcctcgtggcttcttaacaaccccattctgcttttcagaggttttccacatgggctcttggtctcctgctgcacacagccagaggattcagcacatgtcctgcaggaggtggctgtgctctcgagactcctagcctctaccaaaagctctgcaggtttcttcatgtcctggtgggactgctccaggtggatactcagccccccgtgggggctggaatccctgaacatggacagcgtaaagacagctgcagctcagctcactttccggagggttttccctctctggaatcttaactcctctagttgtctttgctgagcagcaacttgctgcctccaaaagatcatttctgcattttattcagtttttaaactcatcttaggcaggagtgctggtctgccaccagtaccctctcctactcggaagcagagtcttccaccattgtgcttttaaaattcatccatgttattgcgggtagttgtaattcatttatttctgttgaggaatgaatatatcagaatttacttaagcattatgctgttgctggaatacatgggctgtatccagttttagctactagaaacagtgctcccaggaagattctggtgtgtgccacgtggtagctaagcatatgtttctgaaggttgagtacttaggagtggaagtactaggtctagggttatgggcaccttcacattgctgagatggcatcaccgttctccagttcacccttggcccatcagtgtgggtgggccctacctgctccccatcattatcagcacttggtattgtcaggcttatgaattttagctactctcgtgagaatatggtggtatttcattgtggttttaatgtgcattttactgataactaaatagattgagatctttcctgtcattttaacttgctcttttgttaagtaccccttgaatcttttacacattttttctgtagtgaacggctgggcacggtggcttacatctatactcccagcactttgggaggctgagatgggtgaatcacttgaggctaggagtttgagaccagcctggccaacatggcaaaagcctgtctctactaaaaatacaaaaatcagccgggtgtggtggcatgcgcctatagtcccagctactcgggaggctgaggcatgagaattgcttgaacccaggaggtggaggttacagtgagccaagattgcaccgctgcactgcagcctaagtgacagagcgagaccctgtctcaagaagtatatgtaaataaaatgaaaacaagtttattaagaaagcaaaggaataaaagaatggctactccataggcagaccagcagcttgggctgctggactaagaatacttagagttatttcttgactatatgctaaacaaggggtggattattcataaattttctgggaaaggggtgggcagtttctggaactgagggttcctcccattttagaccatctaggataacttcctgacgttgccatggctgctgtaaactgtcatggcactggtgggagtgtcttttagcatgccaatcattgtaagtagtatataatgagcagtgagttcaaccagaggtcacttacattgccatcttcatttgcggggacttggccagcttcttcaccacacatgctgttttatcagtaaggtctttatgacctgtatcttgtgccgacctcctatctcatcctgtgacttagaatgcctaacttctgggggtgcagcccagcagatctcagccttattttacctagcccctattcaagatggagttgctctggtttaaacgcctctgacatatttcccctctctgttttatgagagaagccttaattctaaaggttgtagagggacaaagattcatcttctataacttcttcaggctgaacaggagtgatgacattcctgcctaactattagggtcttttatatttgagaaagaaaggagctaagtcagaaagcatcagtatggtgagggccattcataacgccaagaaaatttggtatctggaagattaataagtgttcagtttaagaaaacattgagtaagcttatcctgcattcctacacagagtacaacagcaatatattccacaacagtaaaacaaaataagtaaaattatcccaagtaaattaaatagggattttcatgaactgggtaactgttggaactaagatgatatgggattgctagctgattccagtgtgcccagaattagaatattgatctagatttttttttttttttttttttttttttttttttttttgagatggagtcttgctctgctgctcaggctggagtgcagtggtgcgatctcggctcactgcaagctccgcctccagggttcacgccattctcctgcctcagcctcccaagtagctgggactacaggcacccgccaccacgcccggctaatgttttgtatttttagtagagacggggtttcaccatgttagccaggacggtctcgatctcctgaccttgtgatacacccatctcggcctcctcaagtgctgggattacaggcatgagccaccgcacccagcctgatccagatttttacattacccatctctcttgtttctctctactttactcaattgttaaaagctgtaaatagctcaaaagagaagttttcttggctctgaaaaacaaaacaaagaatcagcaacaatttaagcaaaaagtcaaaacaagttacttctgttttctactggttctattagtcctattagttcagctcatgtcaaaacaagttacttctgtcttctattagttctgttagtcctattagttcagctcatgcagttaactcctgttcgatattcatgaacattttggctctccatgagagtcctgaaagtttttcctctattctaatgtcgcaacctccaaagttatcagaaacctgcattcaaaaacacctgttagagttctctagttgattataaaaccaccttctaaagaggacccaaacaagacaacaattttgtatggatgacagaatgccttagggcagcctctacaaaagccacaattgactaggaattttgattacttctgtgacatggaacaatttaacataccaattatattaataacatgtactgtcatatcagagttatagaagtttcacacgattttggaacacaaaccaataacatatttatacaaatatagcccaaagaaagccacgcatcatttcatatctgacagtgcttgctgtgtgatttttataccaaataagctgaatatgtcattttttggacttgagaggacctaatatctaaaagattaattaggtcaggaaaaggcagaatttagagtatgatgttggaaagtttgtcaaatattaaaggtttaaacgcttgatattacaaaatagaatcccaggtcaccataagtcattcatttacccaaaatgataactcaaaaatttttaaaaggcaaaatcctttactcattaatagaaggaagacttagctttccaaataatctgtctcctttctttcccttctttttcctatagtttattcaaaaggcaaacaaaaatctttgttttcttttctttttttttcctgagacggagtctcactctgtcacccaggttgaagtgcagtggcgtgatctcggctcactgcaacctccgcctcctgggttcaagcaattcttctgccccagcctcctgagtagctgggactacaggtgtgcaccaccatgcctggctaatttttgtatttttagtagagaccggttttcaccatgttggccaggcttatctcaaactcctgacctcaagtgatctgcctgccctggcctcccaaattgctgggattacaggcatgagccattacacccagccatctttcattatttttttaatataaaaatcctgctcaagggagaaagcaaaatttcaccattgcattagcgcattattgatgtcaaacccaattcttaataaaaccttgtagacaaatctattcaaccataaggtaagattctcataaaccttttataaccctttacactttttgttaaagagcagattcatgctccaagaaaactgttgtgcttttattccagtattcaatttatggaaaaactgaataatacccctttaactttaggccagtgtgttcacacacaatttcttttacaagattaatttttcacaaaccttccacaacttgctcaaaccttcagcattattctatccaactgaaaataatcctttaaccctttaatctaggcaaaaaaaaatccacattcccatgacttcttacaatctttttaccaaaaacacatttcactttccgtgcacatttcacacttgcaggtagaactgcttttcccatagtcccatagtctcaagtgcatgttacattgttaaccgaagaagcagtttatgaccgtaaagcatttagcaaacctaatatctgacctgtctaatttagaccaaatgcctaaatttttgaagatatttttattttaccaatagtctttaaaactgtctttatttcccaaaggttacttaagtcacatgaactaaaaggcattacagttttaatttttctgacaagatatttggtttaaggtcttagtatttttaaaccagttaatcaaagctctttcatatataaacatcacacacataacatgtaaatagacagaagatccaggagacgtaagattttccattttccagtttctaagtttcttaactggattactggcttcagggtggagctctttgctaaacagggctagggaaacatgcagtttctggagcctaataagcagctggaaggcaaagcagattccaaaaatcaaagttctcatttctataccagatactggatcctcaaaaagggaatcagcccatcccccatgggagtgttatctctcagtggggcttgggggacatttccataccttctaggtggccaagagcatgcttctctgatccaaacatgcagagaggtgtgtattcccctacaactgccattagctacccccaaagtatatttcctccctagttattacaccagagctctctcgtcatgtgaaatcaaaaccgtcagataacacagtgctgcaaaacagagcagagccttagattttgagattttaaattttaaattcctggggtttcatgaggaaaacagaggttcttcccaaaatggggtctgtggctcctcctctgtttcccccaaagagtcccaggctgttagaccttgaatatctgcttttaaggtgacttttaaccatagtgctcttttatttttttaattaatttaaaaaaattttttttttgagatggagtcttgctcttgttgcccaggctggagtgtaatggcgcgatctcaggtcaccgcaacctctgtctcccaggttcaagcgattctcctgcctcagcctcccgagtagctgggattacaggcatgtgccaccatgcccagctaattttgtatttttagtagagatggggtttctccatgttgatcaggctggtctcaaactcctgacctcaggtgatccacccgccttggccttccaaagtgctgggattatagatgtgagccaccaatgcctagcttcttatttatttatttatttattttttgagatggagtctggctctgtcgcccaggctggagtgcagtggcgtgatcttggctcactgcaacctccgcctcccaggttcaagcagttctcctgcctcaacctcctgagtagctaggattacaggcgtgcgcctggctaatttttttttttttttttttttttttgtatttttagtagagacggggtttcaccatgttggccaggctggtcttgaacccctgatcttgtgatccacccgcctcagccacccaaagtgctgggattacaggtatgagccactgcacctggcccatagtgcttttttttaaaattccttttaaatctcttattacccaacttcagccaggccttacggccaaaggtaacctcccaggtgaaaacaataaactttagccaataagctacagtattgggcacttggactattcccagaagaagtctagagcatccaattctgagcttgcaaaggcttttaactgctcgagataacctttagagctaactatgatatgaaccctcaaattcctgttcactcggtggaaaccaagagaaagtacctccgcgtggttacaagtcaactcccaaggacatttttcaacatgtggtctctgggcaagatgaaggagcagttgccctgagtaacagaaaagatggaaaagagaaagggagaaaagcattgcctatggcagtatggggaaggtgaggagctcagggaggccggagaaagacccagccattgcggcgacgctgaatcaaaagttcaggcagccgcttgtcagtaatgaagggatcttttccagctgtcccgtcagctctggagtttccccttttggggagaaaaaatgctcccatgttccatgatcctgtacatgcctaaccttgtcacccaaagccgtcagcaaagagtgcaaggcagatgaatccagagagaatagtggttaacattctgtagtgccagatccattcttggccacgagggactttactgaagggggaccctctaaccccttatatcttaggaaggtctctaaccttcccaagttgggcctcgaacccaggtttgttcaagtgcccttgccttttattaagaggggcctttaacccactctgtcttaggagaaactctgactcccctaagttgggactctaacccagttccatcctttaccctggtaaatgcaccccacttacccaaagtcggccaattggtgctgtggtcttatctcctttgggtcgggggtctcctcagtattgtccctttggaattcaccgggaagatgttcccagaaagggatcctattccagaccccaagagaggctccttggaccttgtgcaagaaagaattcagggcaagtcagtgtagtaaagtgaaagcaagtttattaagaaagcaaaggagtaaaagaatggctactccctaggcagagcagctgcaccttttctaatacaggatcatttataggaattttttatattatattctggatcccagccctgtgtcagtaataccttgcgagagttctctccctctttgtggctggctttccactaatggtagcttagtgaacagaagttctatcaatcaccttcttttcttttatgatttttgctttttgcttttttttttttttttttttttttttttttttgagacagagtcttactcttttgcacaggctggagtgctgtggcgtgatcttggctcactgcagcctctgccttccggatcaaacaattattacgcatcagcctcccaagtagctgggagtacaggtgtgcaccaccaggcctggctaattttttgtatttttagtagagtcagggtttcactgtgttgaccaggctggtctcgaactcctgacctcaggtgatccacctgccttggcctcccagagtgctgggattacagttgtgagccaccatgcctggcccgatttttgcttttatgttctctttaagtactgtttcccttggctgagatcaaaacattattccattaatttgggaaaatgctgttgttttactgttcacatttaggtctgccattcacctggaatgtgtttttgtgaatggtgtgggactgggttcccgggttcgtttctaaagaaagataacctactgtcccgttcttgtctaaggaggagacagcccttgccccactcttctgtggtggcacgtgggtcatcagttgagttgtccacacatgggtggatctgttttgctgttctctgttttatttcactgatttattttctatctttgtgcctataccacactgtcttaattgccatagttttataataagtcttgacatctgtagagaaagcctgccatcttgttttcttcttcaaaagtatcttacatgctcactttggcagcacatacactaaaactggaatgatgtagagaagatgagcatggtacctgtgcaaggatgacacacttttgtgaaatgttccatatttaaaaaactgaaaaaaagagtgtcttagcaattcttaccctgtgcatttctggatccactttagaatgagcttatcaggtgtcacagtatacctactgagattattagcattactttgagtcttaagagaattaacacctttgcattattattattattattattattattattattattattattattattattattattattttgagatggagtttcgctcttgttgcccgggctggagtgcaatggcacaatctcagctcactgcaacctctgcctcccgggttcaagtgattcttctgcctcagtctcctgagtagctgggattacaggcgcctgccaccacacccggctaattttttttatttttagtagagatggggtttcaccatgttggccaggctggtctcgaactccagacctcaggtgatccacctgccttggcctcccaaagtgctaggattacaagcgtgagccacccgcacctggccacctttgcattattgagtcttccagcccttggacatctgtccctccattcaaatattttttactttatctcagtaatgtatggttttctgtggggagattttgcatatttcttgtgacagtctcaagtacttagtgtgtgtgtgttttaagcttgtggtggatactttcatcaaaaacgttcattcctttttttttttttttgagacagagtttcgctttgttgtccaggctggagtgcagtggcacgatcttggctcactgcaacctccgcctcctggattcaagcaattctcatgcctcagcctcctgagtagctgggattacaagtgcctgcctccatgtccgcctgattttttgtattttagtagagacagggttttaccatctcacccaggctggtcttgaacgcctcagctcaggcaatctgcccgtctcagcctcccaaagtgccaggattacaggtgtgagccactgcgccaggcctgtttactctgtattgctagtatgtagaaatcaaatggtgtttgtatgttgatatatttagcagccttgctaaattcagttacaaaagattcataagctacaccatcgtgtcatctgcaaataatggtagttatatttccagttgttcagctttttctccctttttgcactggctaagcctttcagtaaaatgctgaaaacagacatcctttacttacttctctcagaggggaagctttcaatatccaaccattaattatgatatttcctgttgggtttctaaagatgccccttatcacattaaggaagtatgtttccttttattctgagtttaagaagaatttcaaaaatcatttaaaatcattttaaaatcatgaatgatttaaactgtttttcttttcttccatctattgatatgattgttttatttttcacctttattttgttaatgtggcaaattatgtgggttttctgttgaacctctttgcattcctgagataaaactgacttggtcatgatgcattattctttttatgtagctggattcagtttgaaattctttatgcattacaattattaacaccttaaactgaccttttaaaataggctaaaacagtggtttgagttgaggttttttttttttttttttttgagagggagtctcactctcgcccaggctagaggacagtggcacagtctcgtctcactgcaacctctgcctcctgggttcaagcagttctcctgcctcggcctcctgagtagttgggattacagtgtgtgccaccactcccagataattttttgtatttttagtagagacagggtttcaccgtgttgaccagtctggtctcgaactcctgacctcagatgatccacccatcttggcctcccaaagtgctggaattacaggcatgagtcaccgtgcccagtctagtattttttttttctcattcatttctcaggtcccacagttcacttatttcatagtgttgcacctgagcttcatattattacacgggaaattgagcgctcatttgcagggcatggctactcaacctgcttgcgttgtgccacagggacttaaagggctcagtgatgactttgtgttgcttctttgataggctgcttggtgagggggtgttaaggctccttcaagtgtggggggttagactcagatttctcagtcttcctgtcccatggtcacccctgcctctgtcgtcctctctagacacccccagtcctctaggcttttcctttctctattgtcctgtcttcctcagtgaagctctcccctattgagtgcttatgagcatagcagctgcgccaggaggggtgtgtggtgggaaggacctcaggggataagagctggttcctgggccctgtgcctggcgtgaggtcctgatggctttccaagtaaagaatggatggcattgatacccggatcacctttggatctgttgctttggtttatattgtctcttgatttttggtcaggggaacttctctttggggatggctggtattttaacatcttaaatttaacatattaaattaggaatttaacatgttaaaacaaagatatgacccatttcatgaattgttgtaaagattaaagaaattatgtgctactcttacaaatgatgtaattgagggatatttaacgtaatgaaaatccatttacaatgcaatattaatttaaaaagtagggtgaagtatctcatttcttgaaaattttacaggcatgtatacgtgtttatatgtgtatagctgtatatatatgcacacatatgtacatatacatatgtataccaaatactgactttttctgcttgctttttttttttttttttttttttttttttttttttttttttagataatgtctttattgcccaggctggctctcactgcaacctccaccttccaggttcaagcaattctcatgcttcagcctcccgagcagctgggattacaggcacacaccaccacactgagctaattttttgtatttttagcagagatggggttttgccatgttggccaggctggtctcaaactcctggcctcaagtgatctgcctgcctcgtccttccaaagtacagggattacaggtgtgagtcactgcaacctgcctctgctggctcttctgtagtccagattttctgtaataaaatcctattttatttttgtattaagaaaaataaatctgtaagctatttttaagagaaaacaatgatgttcattacaacattgtgcagaatagttattagttggaaactacctaaatttccactaatggggtaatggtatatttcggggtattttggtttctacattaaaatgttaattacttgtttcttaaattttacattgcttagtatttttattttgttttaggtaaactttggagtcggagtttaaaactagcttatactctacttaataaactgacaagtaagaatgaacctctacttaaacctggagacagagtaagtaactagaatgtcactttgttggaaggagcaaaagcagggacttaaataatctgtttcattgaaattagtgttctatcatttagttagaattacagcattaatacaagggatttaaaatcagcagtgaggactgggtgcggtggctcatgcctgtaatcctagcactttgggaggctgtggtgagcggattgcctgagctcaggagtttgagaccagcctgggcaacatggcaaaaccctgtctctactaaaaatacaaaaaattagctgggcgtggtggtgcgtgcctgtaatgccagctacccgggaggctgaggcatgagaatctcttgaacccaggaggtggaggttgtagtgagccaagatctcgccactgcactccagcctggcgacagagtgagactccgtctcaaagagaaaaaaaaaaaaaagcagtgaaaaatattaaatatggcaaagtttgtgatgtagagtaaagcagcattctttttctgcactcgttgtttcattgtttgtccactgtttcttcatcttcttttctgtttgacttcatatatgttgatattaaaaatgttagattccagagcttagattttatgaattaaaatctgaaggtctgaaaccctgctgtgaaattctgtatttttatctccttccctattctatgtgtccaggtaacctccttgtacctatctgccaaaataggatgctggagacttattctcttgtgctacactgccctatatggttggcagtagccatttggggctatttaaattaaccaaaattaaataaaataaaaaatttagtttcttggttgcacaagccacatttcaagggctcagtaggagtgtggctagtagctactgtatttatagatcagaggtagaacatttctgtcatcatagaaacttctgttggacagtactactgtaggcaagctggaccagaccggaggaccctggtatactagaaagtccagggtggaaaataggagaacatggtgaaaatcaacataccagtgaaatcccctagtgagaaggtcacctgtgtcagatcacccaacaaggaaactgcaggttaacaagctggcagacagttccaagtagctctttcagtgcctaagtctttaatatgaactattagccaaggacttttaagaaggaaatgtcaatatgagagaaaataccaaaagacaaagaaaagggaagggaagagagggagtgagaaagagacaagaaaagtaaggaagggaggaaagaggaaacaacaaggaaagctagatacagaaaacaatgtttctaaaaagtgagtattaatattcttggaaatcagagatgaagatgtttcataagtcaagaaaaggatgccggtaggaaagactaagagatggagagcggagtaaaataggacaaaaagactcgatcaagaagacacaacacctgactgataactggagtcgagaaagagaaaggagaacagaaagtagaacattttaaatgaaaatagtaattcaggacaatatcccggacctggagagtgtaaacattcaaggatgcacaccaaaacgcatgcccataatattgcataatacgaggggtacagaaaagaatcccagagctttcaggggaaaagtaggatgtacacaaaggattggcaatgacagtggcttttgggatttctcattggtaaaactgaaagagagtggaatgatgcttcagacattcagagggaatataattttaacttaaaattctgttcccagagattcaacagatttgagaatagtatagccattttcagacatgcaggactcagaaacgtttggctcgcaagcactttcttgtcaagttcttagaagatgtccctcagccacatgagtgagtgagtgagtagggtgcaagcaggaggaccacagtggaggccccaggacgatcactggcagcagtccagggggggcagcagagccaccatcaggagaaccaagactccagggtggggtggaatcctcagcacccaccatcaggagaaccgagaccctcagcagtggagtcctcagcagcaggggacactcacggctctcctgagtgggtggttatttggaaaatgacccaccagtaggtgggtatttgacccagctgagggagtattttaaaacaaattagctagagaatacacagaaagcaacgcaagtagaaatggaggtagctgttatcagaaaagaaaggaaatgtgtacttggctataaaaatgtaaacagtttaagaataatactttatgatatgttgtgctcatagatgagattttatgcaacgctttagaatgaattcaagaatcactaattttcttgaaaaacattcttacaaggataaagactttcagattcttgacttgcaagagaatctctttggttaggtgaatcataataaaatggacaaggtcacagtgattgagttgaagaaattggtggcaaattctgcctcctataatattacactttataaaagtgagcacagctcttcctaacaaattctgtaaaaatatactttccataccaaacatctagtctgaaggttataggttacattctgggcaaccactgttaaaaccaaattttgaaggagaaccttgcccttttcaacaaacaaacttgttagaaactaaatttccagacctcaagtacagaatatagatacagcttaaattttgtcttacaaagtcagcacttattggttattcattgttgcgtgttctcaaaggccctgagtcaactgtctctactcagttaaatactatttggacttgtcccttatggtttcaagcacaattattacaatatttggggcttacaaaaattttatttataactagcttttaatttaactagatattgtaaaaattggaaatttggaatattcatttctttgtcctgttgtaggtggcgctcgtgtttccgaatagtgaccctgtgatgttcatggttgcattttatgggtgtctcctggcagagctggttcctgtccccatagaagtgccattaacaagaaaggtagcaaacccatggctcaggtcccgtgtggttcgcttctgaacttgataccagcagtatcttacttccttttcactcatgtgggcaggcagcaagcagctgttttgacagaggagagaaagctagtagtcaacaggctggccaggactcaagagaaatcagatgccgttttgcctgcctctcttcttgttaatgagaggggcactgagaaccgttttgctggtgatgctcccacaccacactcttattaggtggagctgttctatcatctacatgaatttcccaacagaaatgatagccattttttcctctaatgaatagaattatgattcaataagattttgttcaacttttcctcaaaaccatatgtttatagaaaataattattatttcttagggataaatatatcattacagtgatatagctcacttctcagtggcagttttgaataaacgagatggaaattatcttgcatttctgttcacttatatgaccgtaggcagtttctgttgctgataaattattaatgtggggtcttgctgatctaggtatctgtaacatttttgatataactatcaataatatgattactgaaaaaaaatagacaaggcatgaatttgagaaaatcagttttctgtcatcctgtcccagaattcaggcagttgttaacaggagcattatccagaaatattcaagaatcccaaaagtaaaatttgcaaatcaaactagtgtatctcaaagcataatatgtgatgggcaggtatttgaatgcagtggttcttaggagtaaaactagagatttgtcaaatttatatgaagaaaatgacagaatactgctgagggacacagaagacttggctacaaggaaatgtgtttctgtgtggaaataatttaatatcgttggtgaccaggcctctctagattaatttgtaaatttcaaacatgattcaatagaaatttcaatgccattaactttggagtttattaaaaatgcttctaaatgtcatttgtaagaataaactttgagaaattagcccattaaactttatatttcaacacaaatacaaaccaaaattatcttttaaatttaaacatagttgtcacattttcatgaactatttccgtgaaaagatcatatatatcaataatgggactgaattattctggaagttttatgagggatgaaaaaaagatctgttctctgtgcatggcctggagcaccaagggtctggggctgtggctgctgtgagcaccccaccccacacggtcactctgctttctgcaggatgcaggcagccagcaggttgggtttctgctgggcagctgtggagtcttcttggccctgaccacagacgcttgtcagaaaggcctccccaaggcacagacaggagaggtggcagctttcaaaggtgaggcctcccaagggaaggggagtcagtgttctgactgtggtctgtgttaaatgcatggtgttccagaaattaaacatgacagaggtgtctgggtcttcagcaaaagtgatcccttgttcgagtccttggtgaatctcggttttcatctggcttcatgtctcgacctgtactgtctaatgtggtagccactggccggatgtacctttttaaattatataaaatgaaatgagactaaaacttgcactccttattcgctcagtagctagtgctgcatgttggaggcgcaggcttcgagtgtggggagcagatgcctctgactgcttgctgttctgtgtcctgtctgtgtgtcacaggttggcccccgctctcctggctagtgattgatgggaagcatctagccaagcccccaaaggactggcaccctctggcccaggacacagggactgggactgcctacattgaggtaatgactgttcctaacttagagaatgtaaaaacatgtcccacaggcttaagtcttgcttttcataagaatgtaagttgctattcttttttgttaagtttcggcctaagagttcttgttttatctctgccctggaaatacagagtgtcatataaatccttgctcagatccttccaggtttctctctcatctaattctctcctaactggctccctggggatgcagacagttatgagggagcccatggcgcaccattaccctcgggcacctgcccaagaggagccacaacttccactgaagcatcccctcagcggccagggttttgccatgtacctgggctgctggttagaggccgatggttagaggagagacactgaccacttcttcttttgaagattctaccagtttccattctgtctgttgtcacctctagaaataccacatcatgtttttttccttgaaatctttcagtataaaaccagcaaagaaggcagtacggtgggggtcacagtgtcccacgcatccctgctggcacagtgccgggctctgacccaggcgtgcgggtactcagaaggtaagggctctcgggggtggggcggtggcccctccagcctcacacagatacctgacgtacctaatcatgtgactgtcactgcacctgtcaaaaccacccctgggtagtgcctttgcccattaatccgggtcatgccaggtagggagatgcactgtctttagcatgcttacagggtctctgtggttgtgctggccaagagggcacacggtgtctcttagcagagtccagacaaccccatcagggttgttttcagtaaatgcacatggatgttgattttatggaacatggaacctatatcccactgattgatttatacacagtgctgggttcacaggcctgccctggggggctggcttactctgtgacatactgagggtcagggcatttttcattcaaaaagaggaaaacacttttagttttctattactttatctatgactgtagttttgacctcagctgtcatggatataaatatataagtagaatctttatggttatagatgatctgttgataaagtatagtcagcacctgatttacttcaaatgtcagatacttaacttgagatatctttaaattaatattatttaattgataagtactaattgtatatatttatggggtacactgtgacaattttaaaaactgtaaaaatggactcagtagttttcttacattgtaatactagaattgaacaaaactactgagtgaaattgaatggtatgtctaaatatctaaaatataggtgttcaggccaggtgcagtggttcataccagtaatcccaccactttggtaggctaaagcaggaggaacacttgaggtcaagagtttgagagcagcctggacaacatagtgagaccctgtctctacaaaaaaagggagaaattttaaatagaatttttaaaaaagaaaaaaatataggtgtttaaaagcaagggtataagttgagggcacagctaaagcttttacttgagatttggaaagtgattttaggtattttttaagggctttattaaaaaagttagatctttcagatcaagccccgtgactttctttgtcttcagctcagagctgatcttacatatgtcacctacaatttgggttctttagccaggcgtgatgatgtgtgcctatagtcccagctactcgggaagctgaggtaagaggaccgcctgagcccaggagttttgggctgtagtgggctgtgctaaccaggtatctgcacgaagtttggcagcaacatggtgaccttctaggagtggggaaccaccagcttgctaaggaggggtgaaccgacccaagtaggaaagggagcaggtcaaaactcccatgccaatgagtaatgggattgtgcctatgaatattcactgcactgcagcctggcaacgtaataagacctcgtctctaaataataatgataataatttgtgttcttaaccaacagagaaagggtgtttatagtactgttattcatggtgcaacagcatttcctggcacacaaatcaaacctctcctgtttgcctttggagtgctgtggcctttggcgagaagccaggtctgcccacagccccaggctctgtcctttctgcctgtgcaaggtgggagccggatattagagaagacttggccaggggctctgagcagagagctgtgctgggaaccctcaggacccctatccactccagcttcctaagatgtgttagctgcatacctctgggtgagaaaacgggcagaggaagagtgactttccgaagggtgatgcaaaccaccagctcttacagaggggagatgccggatcacggcctctgggtgtgagaattgaggagatgtggtgtagagttgagaagtaagaatatccctgacagtttttcatccccacctcttgattctgagaagaatacccactcaaaaatatctgatgagaagatgtggagaggccgagtgcggtgacttacacctgtaatcccagcactttgggaggctgagacgggcagatcacttgaggtcaggagtttgagaccagcctggccaacgtggtgaaatcccttctctactaaaaatacaaaaattagccaggcatggcagcgcatgcctgtagtcccagctactcgggaggctcagacaggagaattgcttgaacctgggaggcggaggttgcagtgagctgagattgctccattgcactctagcctgggcaacagagcaagactctgtctcaaaaaaaaaaaaaaagaagaaaagacaagctgtggtgacaccttgtatagcttcttcagtatgtgatgttcctgtgccttctgattagtgctcagcgtggttctctgtgttagttccatgaccttctacttttatgtgtttccagtaatttgaatagataaccaggattattattaattggtatgtggtatttggaaatgctgtatctgttcctgaaacttacatgttgatgacgtactcacctcagaatttctctagaaaatgcatagggcttattgagagggttgctcagtggtgtcaccttctttgtccacttgcagctgaaacattaacaaacgtgctggatttcaaaagggatgctggtctgtggcatggcgtgttaacagtgagtgttgtttgctgatgactaactgttggaacaagggattgagatgaacccaagcctctgcctgaaatgttgttgggagagtacatcggttttgttttgctttttctggtgtggctcgggcccactcgccctaagcatgtgtgctcccccacagagcgtcatgaacaggatgcacgtggtcagcgtcccctacgcgctgatgaaggcgaacccactctcctggatccagaaagtgtgcttctataaaggtaacggataccatggtcagggccttcacccttctttagggaaatctctttgaactgacctttggtgcttaagaaaaaataaagctgacatgtggaactgcagatgtaggctgaagagctgtgggacgtctttcttggtcacacccctgcccaggaatatgggggctttctctgcctctggcatggccctcagggtttcgtgggtgatgtggtaagtagggccacttggtggggtctgggccttacttctctcaacggttgaggtgcctcctgggaccaagcaggaggccccagcatggccacacctgcacagttggcagtctgtgtctctgccctgtggagctcagtggcacttctaccagccactgaggcactggatcacctgggtcacccatgttgccttgttctacctactgggctgtgcccctctagacatgtctcagagcagtgtggaggggcagctctctctgtctgtcctactttatggagggaaactgaagcttgggtaggggtggggggattgctggattccacatgctagccagtgcaggggccagactgaggcctgagaccatctgtttagcttctggggtcctcacacttctcagccagcaccaggggtttggggaaggacaacatgagatgaagcgggcagataggaaaagagcaatatggagcttctaagaaaaaattaatgttggaaatggatctgaggttttgatgtctaaattgtacctcagagttgatttttgtggaaaaagctttgagggtttgttagactgcatgtgagagacggctgcagagagcttgtgacctgggagctaagtgttgtgtctgtctgtgcatgtacacctctctgtgggatgaggtacacgtgtctgtaggcgtgtgagggtgccagtccttgtgacgcagggatgtctgtgccatcctctctctgcagctcgggccgcgctggtgaagtcgcgagacatgcactggtctctcctagctcagcggggccagagggacgtcagcctcagctcactgcgcatgctgattgtggccgatggtgccaacccgtgtgagtgagcctgtgtgcccggcgcataccccacacagtgtcccctcctgcaaaccaaagtagaatacactgagaagcaaaatggaggcattttcactgccattgtcatatagatacacatgtcccatcgtttctatgacacggaacatcttggtgattcactggtttatcccatgcatgtttattaggccactaaatttaaaagcaattttaatatgcttgatgaaaggtacatgccttaatgagagtcatctttcttaagaaattaccagattgtgctgtggcctggggttcctgtttctctttaggcctcatccccaccctcctgccctttgtcctggtgcccccacgtctctggcttctggcttcacttctcccaccaggacccaaccattctccctcctggtttgcctgggtgtcccccacatcctcccaggaggagctccctatggctgctgcctgaccacgtagggcctcctgcgtacggtggtctgaatgggaactgctttgtcaaggctgcacacgtgagctctggggcccaggactgtccagggtctgactcagtacctcctctggggaagcctcaggtgatgctggtcacacaggggctcctgttgcagcacacacctgttgaccaggtattaggggttttcttgtttgttaacctgcatcattgtctatgcactggagactaccctgcatcagaagctgatgtttcatcttatcccctctccagtgtggccgacaccccatctcttgggaggtcaccccacctttgagcacccccagagcctctcattctcttggtccacacctgagccaggcagggcctgcttctgggttctgcagcactgctcaggtctctgcgtctccaccccaggcgcaccgccactccgtggtccccatggtggagtcagagtgtgcacctcctctccagtgcctcttcccatggcactcccctgttgctgcacctgatccttgcagtgccgtgcagcttgtctcccaccacatgcagcaccttcctgtccctagtgatgccccttctgccctttggagcaccagaccatccatggctgtctgatttcctttaaagataccatcttccttgaagaacatgaagtctgagggtacctgtgaaggggccccttccttctgctgatgcagccctgtggttccgatggccgcaggctgcgctaacttgagcatgtccagccaccccttccctgctggccccccagttagtgctggcgttccactcttgttgctctgtgcagggtcgatctcctcctgtgacgccttcctcaacgtcttccagtccagaggtctgaggccagaggtcatctgtccttgtgcaagttctcctgaggcgctgactgtcgccatccgcaggtaaccttattccttgctatgtctcatgagcacttagttgaatcttctgcatacagctgagttatcctggagctgtgcctgtgcctgttaggatccaggcccatttgtgcagtagtaccttggtgcctggccccccacattttgccggcttgggtttgtgtggagaattgggtaggaacttcctgggccatactctggattcttgcagaatgccggcttgcgattttcctgagtgcttcccaaattagaaaggccttgtcatctcgtctgtagctgtggtaaacattacaacctaggaactctttcttactctgaggcaggtgtcggtcagccgtggagtctgtgggaaccactgacctgcctggagaagcacccggcctggtgcttagtgcccggccacccacctcccgggaggcctgtgctgctcctgtggcggtttccctcatgtcatgtttctcagcctagagggcatgttgagcctgcagactgccctgagtgtccttgtgtgtgggtgcggggctgctggtccttcctgtgctcctcactcccctcctgaggtttcctttcccctcttctcacctgccccactcccagctccatcctgtgggtagaactcagtgtgctcacagctgaggtgtcttagcctcaattgtaatcttgtattatagtcatatattcataaatggtatgtgtttccatatatggaactaaccctaagtttttaaaagtaaccctaacttggctgggcacggtggctcatgcctgtaatcccagcactttgggaggccgaggcaggtggatcaccttaggttaggagttcgagaccggcctggccaacatagtgaaaccccatctctactgaaaatacaaaaaattagccaggcgtggtggcaggtgcctatagtcccagctactcgggaggctgaggcaggcgaatcgcttgaacccaggaggtggaggttgcaatgagccaagatcatgccattgcactccagcctgggcaacaagagtgaaactctgtgtcaaaaaaaaaaaaaaaaaaaagttaccctatttaatcacttaacattaaaaaaacgctattgtcgtctacaaactataaattattcttcattcttttgttctatggtgatttgttttgcacaactgtgtaatttttttcatattggaggaaacgcctgttgctcagtattccagttactattgttgtatcacaaacaacaacagtcattttattgtctctcatgctttctgtgggccaggagcttaggaaggcctctgccaggtggttctggcttgcaggagatggtgtttggagggagcggtgaggggctgagacagctttgtgtgtgtacatctcaggcccccacctggtctctcagagtgagctgctctgggcttccttgcagtgcagtggcctcaacaccgtccttctgtttgccgggcttcacagggctccaggcgagtgtcccaagacaatcgggtagaagctgaattgacgttactggcctgcattggaagtcacacagcatcacaaccactgtagtcacaggcccttttcccactgagtggagtgtcgacgtcacattgcagaggggcatgtagtttggagacattgcagcatctttagaacatgcgtttctcacaagtctgtaacatggagcagtggctttggtgcagaatcatgctgcaggcaaggtgggcccacctccctggaatttcatccccctcgtcagttaaacccatggtggttttattttctaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggaggtaagagacataaccagagtgggtctttgtccatgactgattgaggtaacgaaaagggttttgttttgttttgagacggagtcttgctttgtcaccaggctggagtgcagtggtgtgatcttggctcactgcatcctccgcctcccaggttcaagcgattctcctgcctcagcctcttataaatactccaggcttcatagtagtgctctagaagcaagcatacaagtaaaagatttctcaagaatgtttttcagtgtaaattggaattttactttgtaaaatatttgctcagttttttccctccctttgtgctaagtttaaagatgagctaaaatataaagatgtgtatatggcctatgcaactcacttacagttctttgatatttgggaagacggtgataatagctcactgtgttccaggcacaggcttcatacttcatatgtgttgaagcatttaaccccatggcaaccatgtgaagtgggcagctctgaggaaaatggtaatgtttgtgaataacttgataattaggttatctaagtaagttctagcaagcatgtgttagatagaagcctcatggaagcttcccagaaattcctcgatgtcagaaaggcctatgtgaactcttctgcagaagttggctctgtaggcctgaccgtcatgttagatgttggaggttttccttgctggcctgaggcagaatctggcctgggaggccctggtgacattcgagtggggacactgccacgtggtctgaggctgccctccttgtagccaccccacagctacttcagctttcctgcctccctgtgatggcccttctggggttcacgggcagctgtcagggccccttttggtgacttctagaggcaggaccccatctgtcagtgcagtctccccccttccaatgcggccctgactgtgttaggggttgcaggcactgcgagaggctcagcgtcctggcccttgtgcctgcaactctgcctcttgcaggcggctgtgctaaccggctgtggctgctcaggtgcagaccctgtctgtgggtggtgctggcagcccagccatctctaacctggagcctggggccagctggtgcctgatccctgtgtgtgcacagatgctgggtcctcattgaataagactgaagtatttcagcctgtgtttctagctctacttgttactcatacaaatggcatcatttttttcctgtaattctactgagaaatagaacagtcagtcttgcacggtgcttgaacctgtcgtaaaataattctcctgagaaatagaacagtcagtcttgcacggtgcttgaacctgtcgtaaaacattttcacagacagcaatcattggggtgtcacttatttactcatggggaaaatacaggtaagtgtttaaacttccctggaaaatcatgatgaggtcatgattctgaatgaatcttaggaacatctgtagttgtgcgcgttttatttgtaaaatgtggattaggacaggacatgcgtgcacagcgctcccgtaggcgtgcacgcagcacacctcctcccccgggcgtgcacacagcgctccaccagacgtgcatgcagcgcacccccctcccccaggtgtgtgcatgcagcgctccccctctgccaggcgcgcgtgcaaagcgctcccccaggcactcccccaggtggacccctgtttcccatgaccctccacagcccccgggctgtaccccttgttgtgggactgagccccatggtgaatcctacgggtgatttgtttgcagcagtttttcagtctgccctgtgtaggcctgtgttcactactgtatcaagtgtgtatgtggtgctttgtggcttttcgtgaccttgccccatctctgcatgtgcttgtaagtgttgtgtggcactgatggctgcctggatggccacctggaagcacagacaagcaccaccttccacatcagccaagcaccaccttccacatcagccaagcatggctgcattctctctgcaaagtcttttatctgatttgtggcaaaaggaagcaaatatctggttgtctctctctttctttttactgtctttggagatgagaatatattagaaaaaaactcaagaagaggcacagaaggacagttcctagctgacccaatgggttaattgattgctaagtaaccaagtttcatttaatggaccacagcccattcatttgtgcatctcatgcttttgtgtgaggctgtttctggaggcctttctgtggcagagctgaggactaggcagatgagatcccttgtgggaggcgaaggcagcaggtcaccgagagttgggtagggtgcacttaagtaaaaacagaactgggtgatggggctgtgggaggagtcacactgaggcctgagacatcgtgctccatgaaaaggcgcacatgtacaaattggcccccaaatgcggaaaggccgagaaattgaagaacgaggcagacaggtcgtttgtcagtagagggtggttcattggggaacttacagatagaatcctggtcttgagtggctgcaagacaggtagatctctgcaccgcaaccctccagacccagggcctttgtcttggggaaaaacatctgcgctctggaaagaatgtgcacatggctgagggagtgccctgggcctcatagcctgtagtgtgtgcagcagcatcaaggttgttttggaagttaggcagaacttaaaatgaacaggtatttctccatgaagatatcctagaggcactccttgacttaagattagtctggagtcacatggcagatttgcatttaaaataaggttactagaaagggggcaggcatgggcagagttctgtcaggctctggagcaggagatggtgtcccgggctcgtgtgtggtggtgatggtcaggagccagggccagcagcaccccatgtggacccgagagggcagtatgacaagaggaggcacagggtttatttatcgtagtacaggaaatattttgtcagccggggcttattacatgaaggatgtgttgtactttctggtcaccttacattgattataaaaaatattacatataaaatataaagacttacagctaggtagcatgtgtatcatctgtgtcataaaactccttataagaaggtgctgtgtatataacatcctgtttccataaccgcacatacagcagcaaggagatctttgtgagtgatccatttaaacacgttcttgataattttgagttttttttctcattttagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggtttgtcccttttcctgactttcatgttgaagttaagttgcatgagcactcatggggtcccaggtgtgctgggtgctgggggattgcagaggctgcggggatggtctccttccacacaggcgctgctggggctgttggcacatggcctgcacacccctgtgtgtcctcccagagtgagggcaaggccagtaccaggaccaggcatgctgtggagggctgggagtcagcgtgcttcccacagtcctgcatgggaggagggtgtgtgggtgcggcctggtggccaataggaaggcactcaccgtggccccagggaaaccagccctctgctatatttgcattgttgtgatgtgagttgttcaggacaagtctagggaggccaggcacccagagcagaggtaaaagggatgcttgtttcctgcctcaggaggcctgcccaggagattgagcagccaggccacagaaactgggcctatgcagggccagcctcctttttccccctggccagcaggcgcacacgtggtgctgagcctcctgccgcctgctgggtctttttggccagttggttggttgtccacagcctgatcgtgcccctctccactttgtgcaggcagttccggtcaccacaggaggagcacccatctttgacaggccattcaccaggacaggcctgctgggcttcatcgggcctgtgagtatgtcctcctgtaccagcactggcagtcagagaaggtagggggtgtggctaagggacacctcgttgcagccccacccttgtcctggccgttcctgacctcccatgtggccttggtcggtggcgctgacctccctgcccatcaccctacctgtgtgcagggccatccacacctccgagactggtgcacagtcctgcacacaggcctgagtcgggggtccccggggtggatgaggatgttttgctttttatatggagtggcaggtttgtgagtattcattatatcattctttaccattttggatgtctaaactattcaaaaataaatgcttctatttgtaacatcttggcccagtgtttctctcaactgggcaattttgccccttccctcccaggggacttctggcaacttttgaagacatttttgcttgtcacaactcaagggaggggagtgctcctggcatctagtgagtacctagaggccagagatgctgctcagtgtccaacctaagcacaggacagcacctgcgatggtattgtcagcccagaaggtccctggtgccgggtttgggacccctgcccttagctcagcagttttcagtccttcacaaactccacccacaactcgtttcccacttgtgagcctttcccatgctgacgctgccccagcagccccactttctttcacatagcctgcccctttcccatgttgcctcccttcctgatgctgccccaccagcccccattccttccacacagcctgcccctgttccaggcctagcttgtcacagggcctgcgttgcagattgggtctgtggggcattgacccgtttgcaaggcgctagaggctcctgtgctgttggccccttcttggggggcctgaccatggtcctggcgcatccagcttctgcccgtgtgggtggagtcttgacgcacaccctttccctcaggacaacctggtcttcatcgtgggcaaactggacgggctgatggtcactggagttcgcagacacaatgcagatgacgttgtggccaccgcactggccgtggagcccatgaagtttgtctacagaggcaggtgatgcgctgcggacccccacgccgggagtagattccttcatttgcagctcgggaagtctttgtgcagtagatggaaagcccagcaaacttgaattcacaaagcctaaaaattgttgtacatcagaaaactcctaaagtaaaaggaaaatatttgcagcaatgataccagagttaatatccttactgtccaaagagttccttggattccttaagaaaataaggttttgatgtaaaatttggggcaaaggctcaaggggacaaatcagggagggaagaattgagtaaagcaaaggagaaatgggtctaagttcctaataaccttggaatgtgaattaaaacagaaaagtgccattttctctgcgagacacatgacaccctccattgcctctggaataaaaatcaactcaacttttctacatgtgtaaagcaaggaccttagagattctcttgagcaaataatagacctctgggcctatgcccctgggcacaggggccaggaagagaattttgcttcttctactcccaagctccttgtctgggaggaagctcttcccctaactggtccactcaaccagctgcctttttaaattttatttttctcaagggggtgccttttttttttttttttttttttttttaaagatagggtctcactctgttgcccatccaggctggagtgcagtagtgtgaccataactcactggagcctctacctcctgggcttcaagcagtcctcttaccgcacctcctgagcagctgggaccacagacatgcaccccacgcctggctaattttttaatttttttgtagagatagggtctcactatgttgctcaagctgctctcgaactcctgggctcaagcaatcctccctccttggcctcccaaactgctgggattacaggtgtcagccaatgtgcctggccaaggatgtgccttttgttactcaaactaaggtacttgggagccaggtcagaccctgcctttgagtagcccttaaagcaatcgtgaggggattctgcaaagtggtgtgtcatcatggttagtcttgaggaaaaagcccagaggatggacaacagagaaggtgggagattgctcagggggctgggaagggcaggctgtgctcatgcatgtgtgcgtgtgtgtgtgtgtgtgtgtgtgtgtgtttgtgtgcgcctgcgtgcagggggagggtggcacagccagggtcatgacccccctcacagcagaaatgggggacacattgggcaggtgtccttagggataacatcaaggtagcccaaaccctgctttgaggtggagcagggagaccaccccctcgcagggccacctgtacctgatggtgactgcgtctgcaggcaggatagcctccctgtccccactagggaagagctgaggaatacaggagcttggaagtggaaccacaaccaattgagagtatatgtgccattggaagaagagcaatagaagatttgcaacatgaactaagatcaagaaatgctaacaaagtaattgttcaaagaacacagtagatggaatacataaaatggatacagctagagaacaagtagagaaggtggaaagtcagattagggaactactctggaagtaaaataggaactttaaaggaactattaagagagatgggagagaataagggctggtgtccagatagcagactcaaggagaagggatatgtttagtggtggttagggattgtctgaggaagcaggtggttggggttctctggactgggaagtggtccacagagggccccatggcatgttgagcttatctgtattctcaccatggaccacacaaaagccaagcaaaacacatcagacttccccacagtggaactggcacaagataacagtgcacccaatttatccaaattgtcactttattgtgcagttgtaataaaaaatatttttaagcatgtaagtttcagaagttttaacacacagaggtccgtactgaaaacagttttggtcaagatactaagagaaataaattcaagatgtgctataagatgtatgagagtaaggagaactcagtactaggtgaggtctgttgtgtaaattgtgtgtgtgtgtgtgtacacacacaccagtcaagtcaaaggaaaggacaagagacggtatatccataatgtcccagagtcagaatggtagacatcctaacatgatgggtttggtggggagaccatcttcttactttatgaaagaaaagacaaagatatcaactcaaagtctaaaagaaggaaaaggcaacacagaaaaaaggaggacatgttgaaatttttaagatagtaaaaacacgtctaaatatactaatcactataaatgtcaatagactaactctagtaaaatagagatgcgatctgttggattaaaaaaatataataaatagaacttttagacaaagatttgtgcagaaggaaatttacatcagattaaggaattttttcttgtaaaaatgtgtgtctttggagctgttttgctttgtcctgaagtcctctgttttttgtgacttgagacacatttcaaccatcctcgaggagattagaatgatgagttactttttgaatgtgcagcaggtagccccatttgatagactgcattttaaatactaggacagtctgcctcttccatcgtgagggtgagaatgcatctgtgtcttgtttggcctcttgccgtgtggccatttccatgtctcatcccgcaggatcgctgtgttctctgtgaccgtgctgcacgacgaccggattgtcctggtggctgagcagcggccggatgcctcggaggaggacagcttccagtggatgagccgtgtgctgcaggtgggcgccccggcacggcctatggttcggtgaatctcccaagctggcacccccactccactccaagtgccaagtggttggcttgtcccgcccggtcctccctggctccagctttgtttatctgtatttttcattgcaaattgacaaattacagctgtatgtatttacgggatacaaagtgatgttataatttatgaatacaatatagaataattaatatatccatcacctcaatatttatttttttctgatgagaacatttgaaatgcactctcacagtgattttgaaatgtacattattatattcaccagtctgtgcaatatatctcaaagaaaaaactttcctcctcctgtctaattgaggctttgtgccctttcaccatcatctcctcattgccccatccctcagcctctgatcacagatttgtggacatgtgtacacaaatacagtgtgtgtgtttcccctttctgagttaaatggtagaaaactgcacacacttctcttcatcttgtttcctcatttaacaaagtgtccagagggcattccatttcctggcctggggaacaggtccacagaggggatgttcctgtcccccacccagcatctccccagcctcaagttgggggcctgtgccaaacagggtccttccctttcaggccattgatagcatccaccaggtgggcgtgtactgtctggccctggttcctgccaacaccttgcccaaggctcctctcggagggattcacatttctgaaaccaaacagcgctttctggaagggacgctgcacccgtgtaatgtgctgatgtgccctcacacctgtgttaccaacctccccaaacctcgtcagaaacaaccaggttagttgaacctaacaacaggatgctctctagtctaacagtggtaacagcggtgcttgtggttagggtgcggccctgctagacctccagtgccaactgcccacgtctttggggctggggtcaagagccagagcgagtgtgcaccccagaatggtgccacctcccgccttcctggaaccagccacgcatgggggaacttaaccacatcacctgcatggtggtttccacctgcctgttaggaaccaattttaatgataaactcaaggatggcatcttagctttgcatggctaggagatggctccctagggctagaaatgctgcccaggatcatcctggagctggacgagctggacacatcacatcacccagtgtctgtgtggcctcggaaatctctcagcaaacggccaacttgccttccctcattttatacatttaaaagctaattttagagactggtttaactttaatgcaatttttcatttctttggtcctgttgatttttagtacatgccaaagtttttttttattaattattgaacacatatcactaaatacatttcatcaggaagatttaatttcctgatttatacataaagtacagtaaaacaaaatatgttaagaattttgctgtgactgaggccaaatcgtatcctctgagatgcgtcgtgtagtaaacttctcaataaggcgtagtttatgttcaagagagaaattctctttgtcacttagcataaaccttgtagctagctttctgaatatttgtatctcagtagaagagttaaatgcctcattcaagtatgttttcaaaataaaaattgtaaataaaatcacgtgatgtttatatatgagaagtcaccagcttttcattcagagttcccccgtttctagaggttggaccagcctcaatgatcgtggggaacctggttgctgggaagagaatcgctcaggcttccgggagagagctcgcccacctggaggacagcgaccaggcacggaaggtgacaggccagttccggggacgggtggacgggtgtctgtgccccggaggcgccagtgagcaagtcgccctctcgtgcagttcctgttcctggctgacgtgctgcagtggcgtgcccacaccactcctgaccacccgctgttcttgctgctgaacgccaaggtgaggcagtgtcacgcccacggggcttggaaacacctgtgggccggtggagccctttgcttgtctagttcatggtgccagtgtcctggttgttctcatgtttagagaacagggtgcctgtggactcagcccccgtcctggttgttctcatgcgtagagagcagggtgcctgtggactcagcccccttgtctggtgcggttctcgctgcctgccctttcctttcttgttttccacacatttcacacaatagtatttctattgattttgtgtttagcaggaaaatttttatcagctcaagtttttaaaattaaaaacagtatacatgtaaatattcctaagtttgtgagctaaaaggaaatgtttattttgtaaaaaattagccatttagaatttctacatttggttacagcttttaaatgacaaatgttgcttcctgccctgctcctgctgctgatttggaaattctcatgtgtttcaagttcctgttgtgtgcattccactgtgctaggaacattcaggatgtcaagaaggagaagctgtaatcttcatattcaggttgtgggcaggaatgcgaaatgcggaaacacagaaagttaaataacttaaaaccctgcaaggcttcctgtcccacgcaccatacaagctgtaagaactcttaagctttggtgtcgtaaagagtaggtcactgtggcttagaatatgctcttctagctcttggtgctgctcattcgaattaaaaaaatacttaatgatgcctacaatgtgcacagtgcacagtaataagattaaaaggacccctactctcaggaggcttaaaatcagtctttcctgctagaaaacaagttccgtaggagagagactttgtttttctggtgtattggaagcatctagaaccatgcccagtaaacatttattttatgattgattgagttctaaagcctacaaaccagccagtgatttatcattgaccaaggtaaaatcagcttatggtgtgaacctcagtatcaatacagtggagtgatgtaacctggagtgctggggagggggctttgaatggaactgggtagcaggggctatgaagaatgatgcccagtggctcaaggcaggaaaggaggccagtgtggtgggggccaggtggtcccaggtaggggatgcagataaggctgggggtcgctgggttttccctaaggatgcagtgggatcccagaccttgcgggctttgagtcccagtccagatctcaggttctgtcctgatggggccctgactcatatggactggcaaagcttccgggatttggaatctcaggatctgcccagcccttgtgcctggacacagcacataagtgcgtccactggtctctctcttccactgccttctgtcagtagaagccaccaatcgagaaacagggagttttgatgttacactggtctgctctggagttttatatttattagactgaattgcactttttatcttcttaagaaggactaaaaaagctgcgaggcctggcaggggatcagggaggatgagtgtcctgagcagagaggtagggttaccaggtatttctgtttgccttgaactggtcacatagccccagtgcccctcagcagagagacagggtgaatgaaggagctggtgtagtcagtcctagaggagacacacagatgcctctgagaaagccggttgcagatgacacacgcccaggctcagtgcaggtgacctgtgggcatggaaagtagtacaattcagggatgtttgcttatcgcttattatgtatttataatggtgtcgtatggaatattttattgaaaaggccagaaaggtcttctttacccacgtgtttctggctctgccctgggtgaatggagtgcccgcatctctccctcttagctgggaccacacaggagatacttgcatgcctgtcccttcactgctagtgagagagtacagatggtgagaaaagacaccagtcgtggaccatgtgcggtggcttatgcctgtaatcccagcactttgagaggctgaggcgggcagatcacttgaggtcaggagttcgagaccagcctggccaacatggtgaaaccccatctctaccaaaaaaaagacaccagccgtacgtctaggactgacacattgtcattatcatggacgctaatcacaaggtgtcgtgtgcagtggcgtgcaggtggtgtgcacgcagatctgcgaacagcccacctgcacgcaccagcatacagatgagctcaaagatcgctttcctagggcaccgtcacaagcactgcaacctgtgtccagctgcacaaaagggctgagagagtggccgcggctctgatggagaagggaagactgagtgttggggaccatgtggctctggtctacccaccaggtgggctcactgtggggctgtccacctgcagctctttgtaagcagcctcctatcctaagcagccccctagacactccctccccgaagcatcttccaaaactaagctcagcccctcctctctgcatgtgtctgcctcctcagctcagctacccctgtggaaacccaggagtcacccatgcccccccagcaccacctcccctcctctctcgcaggaacagtgaacagaggctggtgggagcctcttgcggccggcctcctcacagccagtccttgtctccacaggggtggacctcattgccgcgttctatggctgcttgtactgtggctgcgtgcctgtcaccgtgcggcccccgcaccctcagaacctcggcaccacactgcccaccgtcaagatgatcgtggaggtgcgcctacctggcccgcgggtcagagtctgtgagtgggaggctgcaaggctgccctccgctgcccccttttctgggcagcttgagaggccccgcccacccacccttggcccctcgccatgcaggtcagcaagtctgcatgcgtcctcaccacgcaggctgtcacacggctgctcaggtccaaggaggctgctgctgccgtggacatcaggacctggcccaccatcctagacacaggtgcgtgtcctcgcactgcccaggaccagtcccttttcctttctttgttgtaggtgtggtgtggcctggctgccgtccaaaaacacacgtgaggcaagagcagtcctggcaggagcctggctgacagcagggggtgccccgggccctggtggggagtaggggtccctgtcccatgtgtaaacccacgctccactcagcccacagcagccgcacccagtcccaagtggtgtggagcacagccttgcccctctcacccgcctcctactggcatgggggctggcagctctctgaggctttctgcaaacgctttgaggacacagctcccaccgcatgccgccactccagcatccctgtccccatcattggtgaatgctgtcatgccccatgaaatgctgagggccaacagggtgagggtcagaaacccccctggctcccctctgccgtggacctgtctcagcctgggctggatggggctgggccagggcagctggtgtaggggagggcaggctcagagccaaacagctggccagggccccaaagcctcacgggcttgcctcaaggggagcggtgcctgccctgctgagcctgtgtccagttgcacccagggaggcagtggtgtctggctcatggggccacgagaacttgatgaagcacgcagaacccagagcccgtccacagctattcttgctgtggtcgggactcggctcatctgggctttgccataggctctgtgacttttggcaaatccctagtcctctaatctttcctactggtcagtgacgtgatgcctcccctcttcgccctgcctcgtcccccatccccacaggctcagtgtggtcttggtgggaccgggtagcgtttccatgaagaatgaaatacgctttcctgagcacgcacagcctgcatcgtcacggccccactcccgtctgagctcactctctgcaggactcccaaggacaaatcatgtgtcgcctcttgcctgtgaaagcccagagcgttcagaatacatgtgggaacactaatgttgctggtgtctcctgtttaacagatgacatcccaaaaaagaagatagcaagcgttttcaggcccccctcccccgatgtcctcgcatacttggacttcagcgtgtcaaccactgggatattagcgggagtgaaggtaggtcctctgaaatcttgtttgcttcagcccctagaaatcaggaggagtggacagaaaggatgtcagatgcagatttaaactgacaggtccttcttatgcaaagcacaaagcaacaattttgcttcttaagatttgtgttaaataccaataaatgctaagatgtgattagcctgagagtaatgcgttttctgatgcattatggttatgtctaaactttctgatttatgactgtctagcttacaggaactggtggctttgaagaatctcttaccttgctgggagtcaatagctcaattaaaatttttcaggcggggcgtggtggctcacgcctgtaatcccagcacttcgggaggccgaggcgggtggatcacaagatcaagagatggagaccatcctggccaacgtggtgaaaccccgtctctactaaaaatacaaaaaattagctgggcatggtggcaggtgcctctaatcccagatactcaggaggctgaggcaggagaattgcttgaacccgggaggcagaggttgcagtgagccgagattgtgccattgcactccagcctgggcgacagagcaagactctgcctcaaaaaaaaaaaaaagaaaaaaattttaaaaattcattaccctgaaattttgtttcaaagatttttagtgtaccatttcttgggtattatttaggttatatggggatttgagccaaccgtcttttaaggaaataaatatgatgtttggtagttcggagctatggtctagccatgtgaacagcggacactgccatccaccctctcccctcctgaatttcatttcactttttttttttgaactttattttactcttaagatgtcgcacgcggccacaagcgccttatgccgctccataaagctgcagtgtgagctgtacccctcgcggcagatcgccatctgcctcgacccctactgtggccttggttttgccctgtggtgtctgtgcaggtgagtgcagggcccctgctgcctgccaggtgggagcagctcgtgtggctcttaggaaccttggccttctaaggcaccttttctgggtgctcaggaagccgatgagatgtgtgtgagtgggtttgtttggggatgaagtgggttggagtctgagtctgaaattgagtgaaaatacatttttcattaaatacactgtccgttatcagtacttgggaagaatctgcttgattccttcaaacactagaaagtggcgatccgtctctagaagtgaatgcctctggagtggtgtccccggatcctctccaagtgttcggagcagagctcagaaccccgtgcctgccatcccccaaccttcaccctgtggcatgttttccaccaaacccccccacttggcgtcagaacagaaatcatgcccctgttgtggctggaaaagaagtgttcttgaggaagggaagagtggagtgcccagggtgctgggtgggcgggcggagcctcacgagccttccctctcgcagtgtctactcgggacaccaatcagtgctggtgcccccgctggagctggagagcaacgtgtccctgtggctgtcggccgtcagccagtacaaggcccgcgtcaccttctgctcctactctgtgatggagatgtgcaccaagggcctaggcgcacagacgggtgtcctcagggtgagtgcccagacccgggcttctgagtgtgctgcagaccacagccctgggaagtttaaaaacaacaaaacaaaacaagactcccaaggcccctccctgcagttggaggaagtagagaaaaccctttcccactaggggccctatgtacacatctgtcctcccacggcccacctgtctctgcagctccacaccccgcaggagaggagggtggggggtagggcagggtccctgcgagatagcggggtggaagtctggccgcgtgggagggcaggtgtgggatgcaggtcagatgggaatcgtttagcgcatccacacgtaggattctgtggaacagacacagcctgcggagaggaggttggtgtccagctccacctctgtgtgcccacccggagatttcccaaaacagtgcccagggccctggcaactcactgagctgtggccgtggcctgaccgctcacccctcccgcagatgaagggggtgaacctgtcatgtgtgcgcacgtgcatggtggtcgccgaggagcggcccaggattgcgctgacccagtccttctccaagctcttcaaggacctgggcctgccggcccgcgccgtaagcaccacgttcgggtgcagggtcaacgtggccatctgcctccaggtgaggtgcctggggctgcggttctcgaaagctggctgttggcagcatggagacccagtttcccagttgttaatgtgccgttttgtagccgcctgatctatttctccttctctgggcctttgatatctcatttccatgtaacattttagcttcaagggttttatttttaaagatgttctattctagttggagaaaggcttatttggaaaaaaaacacattgtttttgaacagtgactaataactgtaagactctctaagttagatataaaacacagctaagttcttaaagcaagattgaacttactgttttaagatatctagcaatattaaattgaaacattaataaatgtggtaatttgtgttgactcaaattcatttctgaaaccatgaaatgtcttattaaaaggaagcaccaagtttcaggccaggagtggtggctcatgcctataatcccagcactttgggaggctgaggcaggcggattacctgaggtcaggaattcgagaccagcctggacaatatgatgagaccccgtctctactaaaaatacaaaaattagctggctggtggtgcgcgcctgttgtcccggctacttgggaggttgaggcacaagaatcgcttgaacctggcaagaggaggttgcagcgagccaagatctcaccactgcactccagcctgggtgacagagcgagaccctgtctcaaaaaaaaaaaaaaaaaaaaaaaaaaaacataggtagcaccaagtttcagagattgaagagctcacggcagttctgtttattgcttcctcagatagctacagctgttgcccagattttgtactagtatctcaatttcatttctttctaaaaacatcttaaaaccaaatggctttttagataaccctacatattgaacgccttattcacccacatagtacaagaatagctggaaggaaatggcacctgtccgtgccagagcagggctgagtgcaggtctgtctctgtttccaaagtgtttgcttggccttgtgcctccccatcacagtggcagtgcacgcagggcagggcgggggctctgctcacaccctcttcaccacaaaaagacccctgaccactcaagcctcagacccttgtcacgcagcagaggagatcgggcgggagccttttgtgagctcgcttcctgtgtaggctgtggctgagcgtgggtgccggcctttgtgttagcggctctgcgtctgcaagcctggggcctccttgctagacgtcggaagggtatggatgccacacatgattgcagaaatgatgttaatgggatgttcacgtttgctctttaagatacagaggtgggttttgctctctctttccctgtgtttctcatgtggctgctgcttctgtgtgtgtttcctgtggctgtctcctccctgtctcactctgctgcctccttggcctctgtcagcccaacaggctgggaaagctggctgagcaggtatgaccttgaccttgaccttgttggtgcctctgtgcttccccctcccatgagttcatgtgactttctcgtgaattctagacaaacatgtttcttttgctgtcttactttgttcacagtggatattacttgacatattacaaaagctcccttgtaaccaaatttaaaagtaaaactattttcaaaaaatgttaatgctcatagcattgccttgggaggaagggctgtgtttagttccagtgcagaggtgtttaattccagtgcagacacaggttatgttgtctgggatctttaagggtgatgttgatcagagtactcatttaattgatgttccttattgaataaaatgacacataatgtcctttagtcgggattaatgttaactgtaagattcagaaaggaagagagtagaaaggtgaaggctgccatccatctcacctgagtgagtctcggctgcgagcagtccccggtagaattaggctggttggtgagaggcaaggccctgcctgacagcatggtggaaatgcccctcaaatcctaatggtgttttcatcacagcaagagaccagtgggaatagaaagttgttagaactgaaatgtaaagtggcatgatttggtgttttcagagtcattgagtgtttcgctcaatattatcaagctctgtggatgtttggatggaaagcatcagactgcctgggggaccttgaacccctaggcggactcactgcagggagcagagctgctaccttcttgggtgtccccgggggccagggaggagctgccatgcagctgtacctgtagaaacaagatgttaagtgaggcccctgaacagaagttcctctgctgctctccttccagggcacagctggcccggaccccacaaccgtctacgtggacatgcgggcactgcgccatgacaggtaatgctcccagcctgcctgggccccatggatacccagtggcaaagtgatgcaaaccaggtctgcactgactatgcacccccgggacccaggcattagaggacggcggggccaagtcaggcctaccgggacacctggatgggcacatgagaggacagctggctacattgggccatctgcaccaagaggaagaggagagctgtgtgccccactccgggcgtgcctcccaggggagctcagtgtctatctctgtgcgcccgtgtccccagggctgcagttaacatccctttatctgtcacacaaccaggaagaataagagtggcccctgtgacatttggttctttagagggacagggacagagagaagacaagtaacccatctactggcaagaacgtttcttacccgatgacccatgtgacatttggtttttagagggatagggacagatagaagacaagttatccatctactggcaagaacgtttcttacctgatgctgtcataggatctgacttagtttcatcttgatgaacgatggtggtgcatacagtgtgtgcttgctggtctgtggtcagatgtgtatcagggcccctcccagctttgaagctcagatcccagtcctggattctcaagtatggccacactgtagcttgatgtaaacactaggtttagcttactgggtgccaggggcttgctgggttcagggaggacctaaacgaaatgtagagtgagctgctgtgagcacatggggtgggtggcgagtgcatgcgggtggcggcacttgggaccgcagcgtggttggggtgtccctgccattcatggcaggtgtgctgtggaaaggttgacatcctgactgttgtcaacagaccctcagagtgatcatttccaacgtcatgatctgccctttcagacattactacctgtgtagtaaattttgtactgaaattgttcccttaatttttagggttcgtttggtagaacggggttctccgcacagcctgccattgatggagtctggaaaggtagtggaaaccaagacgcgtgcattctgagtcgcgtctgagacctttgtctgaagcatcaccccgtggagggtgctgggggctgcggctctgatgaacacaggtcgacttctggttggggtgggctcggctgctgcagaagtctccttccctcctttgtggctggtatatagaattacttagttatgtttttaaacacacatctgagctcaaagccaagaaagggagaagttcaggtgcaggaataaagaactcccgctgggtgggtggcaggcctcaggcctctggggccagggccatggaggggggttccggcccacccacacatttagagttaaatggagtggccctggccctaagttggagatggcaaaatctcatgccctagtttagggtgtcagcagggaagaggcccccagaccctgtcggggatctgggggatcctgagatggcccgaggactcccaggaaaaaactgagatgctgcaagaggtcagcagacataggcacagaacagcatcctctgaaccaggaagggttcaaaggaaggaggaaaagccacacagcccaggaaggcagcatgaagagtaagccaggcttgatatgagtcggggaccctggtgccttcacaaccgcagaggcaagggaaggagcttggccaccctgactccgttcactgccatggccacagccacctgtggggagtcagagaggggtccagagagggacccagccaagccatgtgatgtccaggatacagactcctgcagggcagcaggggtgagactgcggacagaaggcacagctgctgtgagggtctcgaggtgggagctacagggaggccagtgggactgggctgagtgtggggagcagaaggagtgcgtgagtgagtgaactcacatgcaggtgcaggggcttgaaaagctcccttcccgtgtcccctgttacagtcacttcaggcggtagaccagccgagagtggagtcgggtgagcttagtggacagcacatctgtgggagccgtgggctgctgcacgtcctcccttctctgagcacagggacatgtgagccgccatcgcacacagctctgcatcatccttggtgtaaactcagcgggtttccctgggtcatggggcctccacgtcgctcttttccctgccctgccatgtacagccgcactgtaattgtttagctcacccccttttattggacgttctttcctattttgctgttacaatcacttgggcctgataggtttgtgtcctggaaagagctctggttttggggctcagctgggacatgcagggagaagatggaggctccaacagcatctggggaaacagaacagtcccactccgccggggagggtctggcggtaaccgtagctcacacctccctgtggcccgtcgtcccctcctcttgcctgccctgagcctgcagtgtcattgcccccatttcatacgtgaggaaactgaggacacagaacaagcatccaggccttgtgcagtcaggtggtctgacctgagcccagtgagggaacactgggaccgggcctgggaggccaggtaagagatggtggcctcttgccgtcctgaattggcacagagccagtgctcagtggttggactgactcggagtcacgggcaggaagaacttcctcatggtcaggttcctggccaagaactaggacagacatgtgcctcctgcagggctgggcacagcagggtcactgcacccctggatggatgcccatcaggtgcgctggcatcacctggctgattgtctttgtaggcttagtgaccctctgcccctcctgacacccagagacgggatcccttctcaggaactggagtcattttgcttatttctattaacatctcttatttctttcaaaattcaaagtcaaatttggagcggcctctaaacttcctgacctgacatgagcacatcagtcctgcaggccagcttctgagggacgttattttaatgtcactgaatcaagagagtctcgtgtcatgttttctttaacaagggacatagctctcctccttccagatcctccccggcgtgaaggtcatcatcgcacacaccgagaccaaaggacccttgggagactcacacctgggagaggtgagcaggggcccatgggaggggcttgagctctccagcctcaccagcttcaccttccttccctttttgcttcagattttggaattctaaacttgcctttgggaatctaccagaaaccatttggcccttgccccgtgtacctcccagacccagttcctatgtaggattttggggtactgtgggacaaactgcctcatccctaggttgacctaaccaagagaggggaacccctaggtttgagggcactgacaggtgagaggagctgcacaggaaccagtggcagtgtggaaaacagctaccttgtgcaggacccagcagctgctacgtaaacgtggtccctggcacccaggcaggagcacagacacggggaactggcaatagggaactctgcaccagaagagttcagggcctccacctgcagctgggaggtttggggagctcagagcccttgtcctgaggacacagtggagggtgcgggtctccctgagaacacagaggctatacaggaatccgttgggttgaaatgtctacatgtattgcacgtacatcttgctgtaatttgggacaggcatgactcattatttacaggcagtggtggcagcttgacgtgcagtcccgaatgtgcagattgatctgttgtcatgggagcataaggactcacgttcctagtcctatcctcttggggaatgtgctgtcaaattgatgtcttcaaaccaggcgggcacaggcatcatttgtgagctctgctgtgaagccagactgggggcttccagcaagccgtgcccagagggaaatcactcagcctcagctggcttctcctgactgggacaagggtgtgagcgtgcgggccctcaggtggtcttaccgtgtcctgatgggaaggtgtcctgggtcccaaccctgagtgtggctggtgtgagggaccctcccctcaaccgtcccacttcctgcacagccaaacccaggtctgtaagtcaagggtgtacccccaagaaatggagagtctgagccaggcatggtgacccacccttgtggcagatgctcaagggaaacgcccctattggccaccccgttctcctctttcagacgctgccatgcaggggcgtcttagagccagtcgaactgaccgtgggttctggacggactctctctagaagggccccatgacacttggtcctgcaggcacaggcctctggtcccttggtctctgcatggatgcacaaaatgcttacgtgtgtagatatgagggtgcacacaaacacgtggacaggtggatacacacacgtgaacacggatagcggacgcacacacacgcgcgtggggctgacgttaaccctgggatgtgccgtctgttttcagggcctctgtcttactgtgagtctgagcagctgcacgctctccactctgtaagaaccctcattccttcagcctgtccctgttgtggaatgtgggttgctcccggccctctcttattaccaacaatagttggatgtgaggaaggtggaattgcccctctcgacttacccacgtaggatagagtcctacagatgacattcttgggtcaaaggaagaaacacagtatttaaggagagaaaagttctgtttgctttctgtgcctgtaatttaacttagttcataaaataagagacaatgaatattatccgccccgacttcgttcagtgttttctggagcattattcttggccagtggatgtctcgtgacagaatctgaactcggtggttggtaacacatcacattcttgtcctctgggcccaccagatctgggtaagcagcccccacaatgccaccgggtactacaccgtttacggggaggaggcgcttcatgccgaccacttcagtgcccggctgagttttggagacacacagaccatctgggcaaggaccggctaccttggcttccttcggcgaacagagctcactgatgccagtggaggtgaggggttgtggtgaagccctgcgtgagtgctgtgcggggaggacctgggctccccaagagcttagtcacctgctagcacacctcactccttgctgtggtctggtattgctccttgtggggggaagatgttctgacagcagttttctctgaaaatactgttttccctccatgactgcccctcactgtccttgggcccttggcctctgctgagggcgtgggggacggtgttggtgataaggctaccaggcttctccccgaggccagaccggtctctctgccgctgtgtctttaccagtggcttccccatgcacaacccatttaaggttgtggtcaatgtccagaggactctgtgcagccaccacaagctggccagataaggcagaacttttggtagctcctatagatggtgtcccgttcacagagataagttatttttaataatacgctcacacttgctgtaactttcctgaggtggttccgtgctgcagagataacagcctgctctgccaggacctccatcaccctttctgcacgtggtgtgcgacctcatgatgtttcagttgagacctccctgtgcctgagagcccctggttgggctcagaggatacgaatgtccagactctgcatgccttggctttctgggcacgtgtaaacacacactgttcacagggcggcacgatgcactgtatgtggttgggtctctggatgaaactctggagctcagaggcatgcggtaccaccccatcgacattgagacctctgtcatccgagcacacaggagcatcgctgagtggtaagagcccaggtggagggcggcttcacgtggtccctccagcccttcctctgggcatgagtgctgtgcatcggttggagcagagcaaggactgctgggccctgggcacaggcctcctgcattgtcaccctggtctgcagtggagctgggtgccatgtagatgagccctatctaccttgggcattgccagagagggctgaggacttcttgtgggttctccctctggatgtactctgcaaaacatggtgccagagcacacctcactgcctgtgtttgggtttggcttgtttttttatctgtttccttatcagtggtaagctaagagattgtccccaaatgcacaggcaaaatgtagatttccacaggtctcatcctgaagtgtttctacttttaatatgagtttctcacatggttgtgactcctgattccttcacctgtagggaacttgtgttgggacaggtacagctttcagcatcagataatgctctgattctcagtaaaagctttagttggaatagacatcctgtaaaatggatctggcctgatctttagattgtaaatggccttaaatagctgtgtgacattggtgggcttcactcttctttgtgccaccctttcccaagcattcattggcccctgtgacctgtgcctgtatccatgtgacccagtctgtcttctctctgcagtgccgtattcacctggaccaacctgctggtggtggtggtggagctggatgggctagagcaggatgccctggacctggtggccctggtgaccaacgtggtgctggaggagcactacctggtcgtgggagtggtggtcatcgtggacccaggggtgatccctatcaactctcggggtgagaagcagcgcatgcacctgcgggacggcttcctggctgaccagctggaccccatctatgtcgcctacaacatgtgagcgcagcacaccggcccaggtgccggagatgaatgagccccagcagtccaaggtgtgatgtgggaagacaccgcagagctcactcaccgggactcgcccttcctgtgctcttacagatccctctcaacaatccccgcatctccttttagaaagcacttcctgaattatttaaagaaatattttgaatctgccaagtacatttacaaaaacacggatgctggtattttaacagatggagagacaaggaaaggaaaggaaaggcctggcatgggcattgtgaggaatcacaggcaccgaggttgttctctgctgtactgcaagtttgcactttctttaggctaaaaatatagttcctgatttttaaaattcagttatttattcccacttcaaatgacaagttcatatatagaatttacgggagaaacttgagaccatttacggggagaaacttgattctgggaagatagcagagtacaaaccagctgcctcacttctgtttcacagggaggctgatggaaaaaggaagcaagctggacccatcctccctgctcacagagggcactgtggtcacacacagtgcctcctctgccagttcctttattgaaagaggtgtgctggctggccacggtggcttacacctgtaatcccagcactttgggaggccgaggcgagcagatcacgaggtcaggagaccgagaccatcctggctaacatggtgaaaccctgtctctactaaaaatacaaaaaattagccgggtgtggtggtgggcgcctgtagtcccagctacttgggaggctgaggcaggagaatggtatgaaccagggaggcggagcttgcagtgagccgagatcacgctactgcactccagcctgggtgacagcacgagatgccgtcttaaaaaaacaaaaaagaggtgtgctgcttgtcagcatgtattgtcacggacactcaataagtgccattttggactgtcaaatttagatgctttgtttcagaaagataagccagcatttagttttaaatcactttcctggtttgtaacttgatgctgtttagttaaattg

SEQ ID NO: 38047 - DNA, 32111 bp, Homo sapiens; identical to SEQ ID NO: 35657

SEQ ID NO: 38048 - DNA, 74900 bp, Homo sapiens; identical to SEQ ID NO: 37038

SEQ ID NO: 38049 - DNA, 3214 bp, Homo sapiens
gttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggaccgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcaggtaaacggggctgaggggaccgcgggaggcggggcggggcgcgcgggaggcccgggcgacctcacaaaggtccgcggcgaagcacgtggtgcgggcccggacggggcgggggtgcacgccgcgtctcgcgaccctccggccaccccgcgagcttccgccgtctgcgacccgggagtggccggggtgtgggcggcgcggggcggaggaccccgcctcgcgactggggaaatggcgtctggcggcgagataatggcggcctgggcgggagcgcgcgggcggggccggccccgctgcctggaattaaccccgctgtgcttgctcgtcccgcccgcagccctaggcggcgtcgccgcagccgatcccggagtcggagtcgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatggtaatgtctgggaatccgagacacataaccctaattcataaatgggatttggggtaggtctttttgagtcgtgttaatgtaagaatgactcctatcattaggagtgctgctcggaggttactcacctttgggagtaatactgaagagaggggtctgcagaaaggatgtgtatgaagcttagataataatggctgtttcgtaaactgtttgagacctattaatgaaaatgactatttcttgctgtttttatccaacgtctgcattttccccctttaaagctgcggtctcctgtttgataaaagaatattggccagtattgcagattttaactgatttggctgatcctccagggaccagtttctgtgggcgtgtattggagcaggtttgtctttaaatgttaaagatgcactatcctcttagagaaacaatcagttcaactattgttgtactgactgggacttcatattctaatggatgtggcaaaagaattgcaataagaagcagtgaacatttggaaccccaaaagaaagttacaggtattgcactgggtggggaaaggatagtgtgtctttaactcttaaattgtttggtcctattttttaaaaaggaaagggccctaagtagctcagatattaaagtagtattctcaattaccaaatgtttcatttgaaacaatttatcttaatgaaatatagaccaattctctgatctcgagttgtttttgtttggatacagcccttttttttttctttttttttcttccccttacctttcttcaccttggttatttggccaggaatacgtaaattcaaacttgtacatgctgatggtagcctttgtgaaattttcctaattgggccttttaaaaacatggctgggtggaacatttctgtaccctactggtttgaccagagccttagtaagtacgtgcctgaaactgaaaccatgtgcactttaatggaaggtaagctgaacttctttcttttcaaacctagatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcagcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctcag

SEQ ID NO: 38050 - DNA, 27251 bp, Homo sapiens
gggccgcctgagctgggccagccgcgcggcgggcgcgggcgcgggcgcgggcgcgggcgcgggcgggtggggagccccagccccggggccgcgggggcgcgtgaccggctgtctgcgtggggcccgcgcgcggtgcctctgcctgacggtgcccgagcctagcgcggagcctggcgcgggggctgcgagcacaggcccggggctgatcgtaatcgggtgagtctcatccggcagcagggctcgccttctggccgctctgcaggcgatgtgcgcggtgttctccgcccgcgggccggctgcgtctggcccgggcttccctgcaggcactcgggaagcgtcaggccggccccgggcatggctcacgcggggaagcgttcgccgccaaagggactccttcgtcactgcggtcgctcctgggacttgctggtgttgggtcagggcggtgtgagtgttccgtgctgaggagcggcttcccatggccaccctggagtgcccctgtgtgtccccccatccagaaaaccagcctgcattttaacccgttcagagtacagtgcttatgtcagacagtcctgtcaactaggaatagaaaattttgaaagctgctgtcactgacattagaatttctacaaagcagtgtggcagaggtttgtgggctgtcaagaagcaacctaaaacagtaactctggatgatgattttcctgacagctggaatggagtcatggagattggaactcacccttaacctccatgcgccaacaaatgagtgcagtctagtttagtgactgcacttcagtccaccctacgaagacctgtccccaaatcaacagccttgctctatttaaacagtatggacaggaactagtatagaacttgcatgtctatgtttagaagcttcatggacatgccaccatattcaagttttaaaatacctgtgggatgcatcctgtaagttgtgtacactttcttagactgtgtaggatacagaactagtccatagtttataggggattaaagaggttcaacattatgcatgagggaccagtaaccaatccttggttagagaacagagaaaccaaagaaccaaaacaagatgtgaaagagaaaaaaaaaaagaaaaagacaagaaagggattttgtaggctctgctgttaattcatgatgttagtaacttgtgccactggagagacaggcaggtcagtggcctggttcctcgaagaaactctgtccctatcttctttgtgctcttgggcaatcattgagttacggacttaaattcctgttcacctcgtttttttgtgaattgtgtggtcaagtttgtatgttattacactgaactctgaagctcaagaaattgcttaaaaggagatacagaggggaaggtcagagaggaaaaaagagggagaaatggcatggagtaggggagttttaaggcacctaattcgtaataattggtgtgactgttacccaacttcccatttccccctgccctgcatcccaagacctcctgggctcagctctgcgtccaagacagtgggaagcctggtcctggaaaggatgtggtgtgatgtgaagagagatgagttcctccgttttgtaaataattttctccttaatttgaaaagagcttccaccctttcccctgaaaaagagtgaatttcctagaggaataaattattcattgaaacaaactcgcatgcgtcccattttgaatttggcttcaaagttgcacaaaagcaggaggaggagctagaagcaggatagaccgtcttgagcagagcagatgctccgtttggcggtgaaaaccatttgggggaatatcagctgcccaaagaagagctgtgactttttaacgagtaaaacgttatccaatagtgtcttgaatctggggaatattttcatgtcaggtcacgatgtaatcctatgtttcaggcataaacattcagagtaattctgtagtgaaaatgagttccgcatttgagttgctaatttcgtcttcgccgtttgagtctttcaaccgagggcatcttttgtgtgacgagtgttatttcaggtgcttagcttaaaagatgaataaggtgtcaaggtcacaacaaaaagttaaaatgtgaaaagatctatataatacaaaatgctatgggaggtccaaagaaacaagaacacagcatcttcgtagagtagcaggtgatgatgataatagcagtgagaggacagtgcggtggctcatgcctatagtcccagcagttttggaggccaaggcaggaggatcacttgagcccaagagttcaagaccagcttgggcaatatagtgagaccccatctctacaaaacattaaaaagttagccaagcatggtggtagacacctgtagtcccagctactagagaggctgaaggtgggaggataacttgaggcctggaggtcgagcttacagtgagctgtgatcctgccactgcactctagcctgtggagcaaagcaagaccctgtgtcaagtaataataataacataacaataataatagcagtgagcaggtaaacccgatttatgtagcactgactgacacttcatatactttatctacagatgtggacactgaattcaggagaggaaaagttaacttgcttaaagcctcagtggcagagcaaatttgaaccccccattattattctgtagatatgtatcacaaaagaacaatgttttagctaattcatcatgctgagttttaaaattatttctcagtcatatattaactcctataccagtatgtttttcttagtgttcaaaacaaatctatttgatgtaacttttagttgttattttatgtcattagtatttgtatgtttacctaaaaagttactgagtcacatgtaaacaagaaataattaatggcttgaaagcaactgaagagggctaaaggtaaagcagtttgtcagcataaagcgtgtcctttattcttttctctggggccctttctttaacatctttatcctcagagttacctggttgtccgtaagatacctaagcaacaaagagaataaaaacaatcatataattctattattctctcttgcatgagacgtatctatggaaggtagatgttctcgccaatctgtacatggtaattactttgttttaaaaattctctttgttggctgggtgtggtggctcatgcctgtaatcccagcactttgggaggccgaagcgggtagatcacttgaggttaggagttcgagaccagcctggctaacatggtgaaaccctgtctctactaaaaatacaaaaattagctgggcgtggtggcaggcgcctgtaatcccagctactcaggaggctgaggcaggagaattacttgaacctaggaggtggaggttgcagtgagctgagatcaattaggtagccttataatcgaaagcaaaagcaaactttttaaaaatgcattttagagtggtgttctaactagaaatattgaaagttgaagtttttcctgattcatgaccatatcttatgttaatatatgttttatttgtaagggaaaataagatttctattgaagaacagaagttgttgattattaaacatcaggaagatattttgactagaggaagtaaatgttttaagcggttcattgaaaggacatttcaatgattaacaggaactgtgctacaccagttaggcttaatagtttatttaacatctagatatttcttctgttttagttcttcattaaattttaatatcttctaactcttgaaaactcagtatacccacaaacagcaatgctagattaaagcaagttaggtgtctgtgtggcttctgagtctaaagaatttgatgtttcttaattaatatgggattaatgatttttttactggaggagtggttgggttttgtaagtaagtcccttgtccctggtcaagggacaactgggacctgaaatccctgaaatactgtgaactgtttggggcaacttttccttctctggctgagtcacaaaaagttgatgttgtcttcagttcacataaaggtacatataggttaatggcaaccttgattttaagaaaaagaaaaatgatgacatcctaagtctcagtttcatcaggatggggtgtgtgtgtgtgtgtgtgtgtgtgtgtgtgtgcgctcatgcacaggtgggtttggagggatgtggcagaacgagaggagcaactttgtataaaagagaaattttaaaagtcttaatgaataaaactatattattacattagggagactcgtcatgttttattttatttccagaagaggactgtcagaaggacgtagaaggcacggttttactgtgaggagcaaagattctttacctacgcattttacaagaaatgtgcagaaagccattgataaatatacctggtaagaattcaccttgcttcagattacaaaatcacaaaatgcccgtaacaaatgtgggaaggaagttagtgactggccatgaatttctaaaagtaagatgcagttttatttttaacctagtgtaaacatcacactgtaaaaatatttcaaaattagtatactgtgaaattaataaatatatttaatgaaagaaagaggaagcaggctcagaaaagtgaagccacttagccatccaagcccttccagcaaatgtgatttctttgctcatgttcattcctgcagcaaatccttgtcatccttttcctccagcggaagccatacacccacgggagcccacacctcttggtctgggtcggccacacagagctctaccaccggctcatccacggagaggggctccgtttattcctggagagatgacgtatgtctcagaatattttggataatcttgtaattacagtttatagtgaagagttgcttccttatattcaaaattatttttaccaattataaaagcatgacctattgcatacatacatgtacatacatgtaaaagcatgtacatgttacatgtgaaaataatagatcacgaaccgtggaggaaaacagaactccctcgtgaccttctggccccgtcttagctgcccgcagttttcttgtttccaccctgcagccggctctccgggtgtgtgctccttgtgacttcttggatggtatccatggccggaaattcaggacttgaataagaaagaaatgctggaaaagtaaaagctgtggcagccactgtgattagagaactccccgccagtattcccagtcggatatttcaccttcaccccctaccgctgggggcgctgttgcctctgaactgcttttgtctgtgtgagcctgggattctggctgggcgagctctgcctccactgctccagcttgctcaggagctcactggctccagtctcctccctccccctccctccaagggtctccgtggatcccaggacacagccctcctttttaaggcccacctggctgcagcaccttgggtgttctgttttacctcgtttatgctgggtgttttgttgttgttgttgttgttttttgcttgcttgctttctctctctctctgtctcttttttttttttttttttttttttgagacggagtctcgctctgtcgcccaggctggagtgcaggggcgcgatctcggctcactgcaagctccgcctcccgggttcacgccattctcctgcctcagcctcccgagtagctgggaccacaggcgcccaccaccacgcccggctaattttttgtatttttaatagagacggggtttcaccgtgttagccaggatggtctcgatctcctgacctcgtgatccgcccgtctcggcctcccaaagtgctgggattacaggcgtgagccaccgcgtccggccttttctctcttttttttttttaagacagagtcttgctctgtcactcaagctgaggtgcagtggtgccatgtcggctcactgcaacctccgcctaccaggttcaagcaatactcctgtctcagcctcccgagtagctgggattacaagtgtgcaccgccatgcccagttaatttttgtatttttagtagagacggtgtttcaccatgttggccaggctggtttcgaactcctgacgttgtgatccgcctgcctgggcctcccatggcatgagccactgcgcccagcctctttgctttctttaaaagtggttccccactcccactgcacatgggaatccgcttctgtccgcagctgtgcagctgtgattctcaggggagccggcagggcaggtgcaccgagggggtctgaaagggactcagctcagcactgctaggaggacctttcacgcacgcagctcccttacttaggggcagctgcctccttcctctcccttacgcccactcaccaccatccctcaagcccgccttccttggtagaaggctgagcaccactgctttactctgtccaaattctaggattcttttagtacaacgtttaatggaattaccagggaaattcgtataacttccattaatactcaggcctcaccctaataaccacacttcttaggataactaaggatttttttttccagttcattgatttaaggagattaatggccttttctacaaaagtaattttcttttctgtggtatcaccagaagaaaaaaaaatcttgtattttgcaggtgtgcttaggtgtgtcaggcacagctctgtgaggagctgcctgtgtttgcagacatacagatgtggacgtgtctgtgtgtctacgctgatgtctgtggcagtatgaacacgtccatctatacctctatctatgcaaattcttgagtctcataacttccgtggcagaagttttctctatttaacagtaaaagaatccgaggctcagaatgagatggcatttctcagaaaggtaacagctagagcacaggtgtgtctgactgcaaagccaccatctttttaccaagtgatgcaccctcctacatagtgggtgacagtaaatgtataagtagcgttgatccagaagcccgcagttctgtaacttgcagtgttgtaaccaagtgtgcatttctgtttaggaatttgacgaagccagttcacagtcagtgcagcggttactctgggaggtggaggaaatgttatttgaagggaaagtgaaccctcagacccagagtctgctggccgaatgcggggagtggacaagaagatccctccatttgaggtgggaccttggtggtggaagttctctggggtgggttttccaagcacccacccctgacctgcctcgatacattcagtacatttggtgtgaaagtgcctgcccagtcagaatatggatgcagagcgcagtccttcactgagagatcactttcctcttacggcgtctgaggaaatactgagacattccagtactcaagcgccttttaatttgtgagaagcaaattcaggccatcctgagaagggcatgacacatatacgaatgcaagaatggtggaggccacctcttaccttcacattcactgtgtgtgagcagcacatgtctgtcttcatcacagaacacagcgagggtgggcagagatgatttgctgaacggctggatagatgggtcttcccatctcacccattccttatgtagggaggagcatgtgttacttttcatatcaaagatggagaatatggattgggtatgaaggcaagcttttcttttctttttgctttttttttttttttttttttttgagatggagtcttgctctgtcgcccaggctggagtgcagtggcgcgatctcagctcactgcaatctcagcctccttggttcacgccatcctcctgcctcagcctcccgagtagctgggactacaggcacctgccaccacgcccggctaattttttttatttttagtagagacggggtttcaccgtgttagccaggatggtcttgatctcctgaactcgtgatccgcccgcctcagcctcccaaagtgctgggattacaggcatgagccaccgcgcccggccaaaggcaagcttatctttcagtcactcagccaacgtactgggggacagtttatcaaagttacctgagttcctgtggattctgtctggggagaatgaatcagaacactcatgtaaatgtggctggatttcctggttacattcactaggtaacttttacagaaatcttgaccaactagggttgtttttttttttcttttcaacccttaataagccacctgccctaaagagtatgatatgtccactagatactagttgtggatactcacttttctggggatgatcactcaccagaaattcgggagctcacacttattcttgtcactgctgtcttacatcattgatagaaatggagggaaggtgggaaaagattgtcaggtacataagccaagtgtgcatatttatatatttgtattcttgttatgtttgtgtttaactgtgtattagttaatatgtatggagggcttctttgtgcccagtgttgccttagacacctgagtctgtcatatatgatctctaagccattcatcagccctgcaaggtaaccattattatcctgttttgcaaatgaaagacaaacaaatgaaattagcctgagaaccttgcctgagactgagtcagtggaagaacagtctggcctaaactctcaaagtcacacttctgtgatgcgtgatgcttcccacgttcccatacacatcttatcatacacatgccttcaaaatcattgtctcctacttttaaaatctccaaacattttccctttgtctgatcaaaaatgtcagtagcttctctttgacctcgcagagtattaggaagacagctgatcctgcccactgacaaaggcgtccagcatttccagggcagcactcctgcctccgcagtccacagacccccgctcagtgcctgcggacacagcagcaacatcagagagtatgttcagataagtgactctcaaaaagtattgttagctgtattttagttatactttttcatgtttatctcatctataagccttggctccacccattttggaaatttagattctgatgaagggcaggtacagagaacaatttttataagaagcttttgattctgaattgatgataggtgtatatgtgtgtatatagagagatgtgtaatatatatatggaacacacatgcacacacatggtagttaccttccatgtttgttccaaaggcgctgtgaaaggtggactgggtgcaggatggaaaccgcctcactgtgatggattataagcctccaggcggtggcagcaggagaaatgaagctctgtcctgtcgtttctgttcactagcagattttgatgactctatgccattcacacatatttggtgtgccgtgacacaatgcagtcctttcactgcaaccaaagagggtacaaactcatagaataatttaggcttttaagaagcccttaaaatgtttaatgatgcctgtattaaagtgtttttaaggacgtgagttttgtccaatgtaatattcaaccgttttgggagggggggattctgtactttacagataattgaaagatccgccatgatcgtttaagcattgcgttcttggtgttctataaactcccatgtagaatctgtttttttcccataggttgtgcatttctggctctcaaatagtcccagcagcactctcagcctctgccctgccaggccctgatgacacaggggttgctgacctaacggcacgttcatccctggaagaagaggtttaccatgtggatggaaagattgaggagtatttcgcttttgacagaaaagaggagtaaatagaatcttatttgacattgacctcataaaataatattaatttatttgacatttattgttatcgtatgctcattaagtgttttgtgtattttttactcacccaaaagatttctgttcttttgagagtaatgtactccccagagcttttggattcctagccagcggtgcacgtgcgggagcagcgaagagggtgttcagtgcccttgtaaaagcagacaaggctcctcgcagccctggtcctgggggctccaggttccccagccctggctgcccaaaagggcctaaggggagttcctgcctctgtactaaattcgtattttgttctttttttttttttgagacggagtctcgctctgtcgcccaggctagagtgcagccgtgcgagctcggctgactgcaaactccgcctcccgggttcacgccattctcctccctcagcctcccgagtagctggaactgcaggcgcccaccaccacgcccggataattttttgaatttttttttagtagagacggggtttcaccgtgttagccaggatggtgtcgatctcctgacctcgtgatccttctgcctcggcctcccaaagtgctgggattacaggcgtgagccactgtgcccagccttgtattttgttcttaatcaaaaactacaactattacatgataaaactttgccccgtgattgaaaattggcacattaaaaagtaacactgataaaacaagtcttaacacatttgagaagactgaaatcaagcatcttttctgatctcagtggtacaaaactgaaagtcaataacaggaagaaaactagaaaactcacaaatatgtgtaaactaaacaacctgctcctcaacaaccaggcagtaggtcaaagaagaaacctaaagggaaatcaaaaaatataatgagacaaattaaaatggaaacacaacatattaaaaccaaacttatggggtacagtagaagcagctctaaaagggaagcctatggcaataaatgcctacattgagaaaaaagacatatctgaaataaacaacctaactttatacttgaaggaatgagaaaaagaacaaactaagcccaaacttagtagaaggaaggaaataacaaagctcagagccgaaataaatgaagagactagaaaaaaaaagaaagatcaatgaaaccaggagttggtttcttgtttttattcatgtgtaatggaaaaaaattatatatgttaaaaaagaacgatgctgtttaacaaagaatgtttattaatatatgtatacatgtacatacgtgaatgtgtgtagatagaattattttaactctaagcattgatcttttagtaattggagtgggtttttattcttagtgatgatgaatgtcttgaacaaaaaccagctcagcccggtaggaaatggcgcaaactcggacttcctcctgtttccccgcgtgactgtgtcaaagatgccgtggcagcagaagtgtttgatcacgtctggacaaatatggtagaacttttggaagagctgattagaaaacactgggaaactacactcacaggtacttacatgcagaatttagcttaatgaaaagaaaaagtccctgttcttcggccctgggctcctgctccccagcttggccagacctagaacgtgaccagtgagaagacaagtgggtgttctgactttactcatgagtgctctttagtcccttcaaaaaggacgctattgttttttgtgttataaaaaataatgcagggctggctgggtgcggtggctcacgcctgtaatcccagcactttgggaggccgaggcaggtagatcacctgaggtcaggagttcaagaccagcctggccaacatgatgaaagcctacctctactaaaaatacaaaaattagccgggcgtggtggtatgtgcctgtaatcccagctactcgggaggctgaggcaggagaattgcttgaacccaggaggtggagattgagattgcagtgagcagagatcacaccactgcactccagcctaggcaacaagagtaaaactccatctcaaaaaaaaagaatgcagggcaggcatggtgactcagaactttgggagaccaaggcaggagaattacttgaacccagaggttcaaggccagctcagcttgggcaacatagtaacaccctgtcttttcaaaaaatacaaataaaaagttagccaggcatggtggcacatgcctgtaggcccagctactcaggaggctgagatgggaggaccccttgagctcaggaattcagtattgaaagtgagcactccatcctgggcaacaaagcgagaccatctctcccccaaaaatagcagtgcatatgcagtctggaaaacacacagatacacaagaacaaggctagaagtcatgttttttgttatagtaaaaataatttacctaactactctctaataatgagatatttgtttttcattgttcgtgacattatctgtaatgtaaaatgtaaacattgctaattgaatcatgctttaatcctcttacatacaaaatattctctaaacttaacattgaacaaaaacaaatcataaaaatgtcagtgatggacattaatgaccagttttattaatcaatttgtacaataaggcaataatcacgttaacctaaatcctgttctttttccagtatttaaggaattagttgggctttatcatgtgctgagaatctgtattgcccactgtgtgatctgcttctccaagccctgcaaccacagttccagcagccagttgctccacaggggtctctgccctccgtggtaacatgtggagtggccgtagcatgggctcgtggtagctcaagcacacatattctctttcaagagtgaattttaagtatttgtattagataatctgatgtttcttgtaatattgattcttctgttgacacagaagggaaaaaacagagagaaacattgaaagtggctggaaacagatttccgcacgtcctcgttccacacgctcacgccgatggagccagtggccccccgtccggacacgccgaggctcacggcatctccctggcttctcgtctgaacccgccccaggtcggtgctttcacacccttctccctcttgccttcactctgtgtgtctgtcacctcagtttgtcgttctgttaaactgcagtactgagatatttggggctgctttccacgctgcccgcagaggggtccatgcaggctttccatggtaacttaaagggaaaccttcacagtgtcacaatgcctggagacctggacgtcctgcctatgaaggacgaggatgtgctcaagttccttgcggtaggagcccacgcaggcggcaccacccttggcttccagatggagcagtatatccacaaaaggacggaccagcgatggcatctctgtcataaatctgaagggacctgggagaagctgctgctggcagctcgtgccattgttgctgttgaaccctgctgaggtccctgtcttgctccaggaacactggccggcaggctgtgctgaagctcactgctgccaccagagccactccagctgctggccgcttctctcctggaaccttcactcgccagacccaggcagccttccgggagccatgtctgctggtcccaggcgaccaccagcctctcagagaggcgtcttggctagcccacctcccattgctctgtggaacacagattctcctctgtgctgtgtggaagtcgccatcccgtgcaacaagggagctcactcagtgggcctgaaggggtggctgctggctcagggagttctgggcatgcgtgacaccatcccccaggaacacccatgggagtccacgcctgacctctgcttctgcagagaccctgaagagattgaggtggaagagcagcctgctgctgatgcagctgtggccaagggggagtttcaggggaacagattgctccagtgcctgctgagcattgccgcccagcccgaggctgcagacccagcccctgcacacactgccgcccaggttgagggtggagacccagcccctgcacgcactgctgctcagcctgaggctgcagactgctctgaaggtgcaggtaccccctgtgcctattcagccgtccctactgcagactggagcactcagcctgccaggcaagcctgttctgcagctcccaatgctcaggcccctgaatgaggaggatcaaccactgagcggtctcaagctgttcttccacaggccaccagcaagatggaaataaggccgatggaaaataaacatcagtttctatttaaaacaatgatattcgggtctgtttgcaatgtgattatttcatgaagtttaacagaattaccacatggcactgctctgagatgtgaagctgttttctacattttgggagattaaaaaaatgctttcccctaatatttcgagctagtttgaaaattataaatgttctcctttctttccaccaaagtgataaaagaaccaatgagtatacattgggcttactcagcatttattggttgtagttgaggcgttttgaggagatacagaggtgaatcctagtgatacaaaagccgtgacacagggtcaggtgcaatacattctgtgagggtcgcgcaaaaaaaaacaaaaacaaaaaaaaccttgtagaagaatcaaagagagagtgatttgttctgattacaggagggggattggtcttttacattgaaggtaaaatttgagcaggaatgagcaaggctcttgtgggagagaactctgggtgggccatttcaggccaagcaaaggcgtggatgagtaaaagatggggcctgtttggggactgtgactgggctgagtttaggggataagaaactggcaactgcagcatagtggcaagaacaggggattaggaatcgagaggcctgagaggagtattcttctggatatgttgtttagcttttctgaactttagtgtccttagcttataatgagattattatcttgtccaagggattattgtgaggataaaatcatagaaatacccaagagctcctactacagggtccagcacatactgagcgcgtaataaatttttcttgaattgcatttttattgagagatgtggtcgcaggtgaggctggaaaggatacacttgttcacgcgaggcctgtagtggtgccaaggaggttgtttccactgcccaccttgtggggggagcagagaacacgggtaaggcaggagtcctagtcctgagctacacagaatttatagtatagttggagggagcccagccatgtcaaacaacacacacacacacacaccacacacagacacacaccacaccactcatacacacaccaaacacaccacacacacacactgcacacatccccccacacaccccccacacaaacacacaccccacacaaacacaccacataccatacaccacgcacacaccacacaccaaacacataccacatacacactacacacaccacgcacacacaccacacaccaaacacataccacatacacacactacacgcacacacaccacacaccaaacacataccacatacacacactacacacacaccactcaccacacacaccactcaccacacacaccactcacacacacactgcacacacccgacacaaacacaccacacaccaaacacacaccccacacaaacacaccacacaccaaacacacaccacacacaaacacaccacacacacagaaaatacataccacatacacacacaccactcacacacacactgcacacaccccccacataaacacaccacacaccaaacatatatcccacacaaacacaccacacaccatacaccacacacacaccacacactatacaaacacataccaaatacacacatacacacacactacacaccacacgcacaccccacacatgcacacataccacacacaccacatatcatacacacaccacacacatacaccacatgcatacacaacccacaacacaccacacatgtacacaccccacacctacacaccccacacatacacacacaccttcacacataccacacacactaccacacaccacacacacacctcaccacaccccacacacaccacaccacaccacacacacaccacatcacaccacaccacacacacacacacacacacatctccccacatgggagacagtctagctgatagcagagtgaaacttgcgtatatagactactagttctgggcttgatgtctgcatttaatactccgtgattgtaaatcagtccctgtttctcaaaacctcaatttcctgatttatgaggtaggaagctgtgagaattaaaggagataaaacattttgtgtagtgtctggtgtagagtggacgttcaataagtgttaccttttgttataatcagatgctaattatatattaatagtctatataatcctttgtaattagatttttgtgtaattttttaattagatgtaatgttttgtaattatatatattttataatgagatgtgttttggatcataagtcctctgggagtcagaagaaaaatatacttttcacagagtagggtaagatatgaaccaagccctaaatgacaggtgtgattcgttaacatgagaaaggaagggaggctcttcaaagcaaaagcaaaactgcacctggcgtgggagcttctaaacccgcgatctttgtgagactgaagggacacaggcctgaacagaacctgtgcttcggggagcagtggggagaacagagcgtctcagaggcttgtttcactctctagtgtaagtcttctgtgccttttctgttctaaagaaacttttggaattgctacctgcttattgtatttttttggtctctttaaactgctctgacaagttcaatacaacatttcccacttaaaaaaaataggcagtatgaatatcacacaaagagcagtggatgagcctttaaatatcaggcaaaataaacagaccagaaaaatatggacattctagaagctgaggcattttttaaatagctgttttgtttttataattactttgtttggataaatgttaaaaaaaaataagtggacagcaaagttaacagaataaaaatagagcctgctttgaaatactcaaggtgttctagttctaattatgaaagctcttaagttattcctctacatatgattgtggttgccacatgtgctcatgaactagaacagaattccagtcccagaaatcctgttctcctacatctaaatatggttatttgaaaaaatttttaatttactttaagttctgggatacatgtgcagaatgtgcaggtttgttacacaggtatacatgtgccatggtggtttgctgcacctgtcagcctgtcatctaggtaaatattattttaaatcctagttggtcatattgtgggactgaagagggagttaagaattacttagcccttagctcacgctttctgtcatctcatttaattctctcaatagctctgtgaagtaggtatgatttttccccaacataaagatggggccattaaagctccaagaacaaagtaagctttccagaattacaaatcaggaagcagttagagctggggttcagactgatgctttcgagggtccaggccatctcaccgcttctgggaagagaacccaggcaagtgtggagaggaggagaggagaggtcccaggcaagcaggacaatgaggagccatgatgcccggcctgtgcttctcccagttctctctctgccttcctcaccctggagttaccagaggctgatacacgttgaccacaccagtgctcccttgccctccaacctccgggatctcagagcatggggggagactgaagcacggctctgcttccctgcagcctccctgccaggtcaccctgggctggtggcgttcctaccccgtgcagctaccctctccgggtgcaggaacctctctctcacttctggccactttgggccaggtgtgctcaatgtccccactgttaggagccttggggaattaaccaattcgttgttaatgtctcagcccacatctttataaaatatatcccctttattagtttttcctccagttagctggtgagtgtgccgggtgtttcctgctgatttcggacaagcatcagtcattggaacggcactgggcatttgtaattctttttttttttttttttttttttactgttctcagattcatcacttctccagcagtttttatagtgacatgaatggtgtcatgacaattcaagcaaaaccgcttcagcggagacctgcctattttgctgacagaacgcagtacgtatcagaatcagtagtagttacccagcctcttccctgtgctgcaaacactggagcactgaagactgcaggggacatgagatcacgaaggtcccatttaatcccgtgcttcagatgtgcctgagcacgtctggaagagcagaaacagaccctttagtaccaaccacaaaacagttactatcgtgtatttggtagggagagatggggaaaggggaatgtagtcctgaaattcttaatcttgtgggcttgactgtttgattactgacagggaaaaccttagccctctgcctgtggatgattcttcattgaaacagaaacagaaatgatgggtcttttcattcattcaacccgtgcttaggagtatgttctaggtgccagactgttctaggcagtgctcaactaagcacagacaggtgcgttccctgttatcacagcactcgcagctgagtagctcacaggatttccttcccaggaatgagaaggaggacaaagcatcgggtggaggggcaggtgctctctcctccgcaccgcacagactgggacgggcctcagacactcatggattatcaccttctgcaaagaaaacaccagtgccctggaggctgccttctcttgcttcagattcacagagactaaaaactcccaacatctatagtgacgaagttcttcggggaacaaaactgtgagtctcatttctttcatagtaaactaaaggccacggaggacctagatgcttctcagttagggtttatggatcatcctggacaaagcatccctacctagttttacatagatgcttttctaatgagttcattgagcatttaacattccgcttgctccagtggtctacttagctgtatcctaggacacaaggtcaggcaatgtccctgtcacacaggcggaatgagcctctgatgctgggggaccttgggtggatttcagtggcctcatctgtgaaacaaataattagctaatgcctttcaattacataattaatacttttcaaggggaggtttaaataaaataatgtatataaaatgctataaaaataaaaggactgtgtccctatcggattatctttaaggatgcatttttctctatgtgggagtttcagcaaagctgttgattgcaggattcacatcccgtcatggcctcgttagaaaggtgcctgtctcttgccctccagctaacttaccagtatcggccaatacttacattgataataatagctaatgtttattgatcactttctttgttatcagcgccaggtaaatgaattacatttatgatcttatttattccccaccacaaaactttatattgttgggactcatactatcccaaatctgagatgagggaacaggctaagcctgccggagatcatccccgccaggaagaggcccagccggacacacccacaagtgctctcaggctttagagaccacccactggacccccggcctgcaggggagctgttatcaggagccgagctcaggagcgggcggctgccaacgcttacctggcacccagactttttccagatgcagtcataacccccctttcagctttttaattggtgactgtttctttcacagtttgggactgatgtttccagctgtgttgggtctgctgtgctgattccttcgagatccctctccctcctccgcctcgcttccccccatgccagtcagcagcacacggtgccagtcagcaacacatggcaggctttctcctcctgccccagcctacctgggccccctgtcacaccttcatcaaatagaaacccatttatgtttcctactgagatacattcagatgccactaactgtacaaatccctctgtgttctgacccctccctccctgtgggctgctgatttttcagctttctttttattattgccaccctgaggagcccttttcgaccattcttcccaattgctctccctacacatggaattgtagtcccacagacagcctgtttgtctgtgtgcatagctgtgctctacacatacgagggaagctgtggcttcagaggggccagtgcccaccccctttggtgatgctacctcacctgtgtcccccggcttctcacccgcctggattctcacctgccagcctcactttccctctgacccccccacacaccagctctgcgtcttctcacctccatcctctgtctttcacttgtattgagataacattttcccatagttatcagagtgctataagttccctggggagcatccggataataccacacatagcagaaatcaaagacctcctgtgtgcccctcacgcagaaacattgaaatcacagctcttggcagatttcctgtcacttgccagttatccatgtacctgggtgctcagtgacatgatgatgtgttgcaggccgactggcgtggaccacatggcttccccactggttcaaacgtcacggagcaggttccccccgctagtcacggagaccagggggcagaatacagcagttcctggatgccgccttgtttctgtaagacagatttcattctatttcagtggaccatttaggttctgtattggaaaacaaacaaaaacaaccttggcacttccaagtgaaattagtaacatgagatctgagtagctgtattcaaatgccttcataatctgtttccagaaagtaaatgaatggcttatgagaatttacagggagtgagaggcttaattcaccgttttgtgaaataaaagcatgtcttgaactaaatcagaaattccaggtgtcaaggaaatctctgataggatagtggagcaaagaagagagcatgaaatttggtcaggagacaggcaggtccgcgtggatcctgccacagaaactctcttctatgacttggtgcaagtcactttaatctccctgagccttagtgttctctgtaaaaggggattaatgattcttacctctaaagaattgttagaaggacaaaatgaactcataggtgttaaatgattcctgacgtgaaattatgagctcagtaaattaggaccctggtcatttctatcggtcatttttacagctaacctttgctatgtctattgcagtggagggcaataccttctgcagtcagactcgcctcggccaggcagtcaggtctgcggggggtgtgctgtggccagcatgcatatccaggcagcccccaggtttacagccacccctcactccacttcacacaagtaacttgtctctattcattttatacaacacagaaggacccctgttgtaggaacataaagacatagtgagagaaaaaccctacctggggccaggttccctcctgcatgccctgtgccaccttgagcccagcactggaacccattcccagaaggcaagagttgcaaagtgttcatgtttaaccttagaataacatcattttacaaaaggcagcggagtgcagtggctcacgcctgtaatcccagcactttgggaggctgaggtgggtggatcacgagggcaagagttcgagaccagcctggccaacatagtgaaacctcatctctactaaaaatacaaaaaaattacctggatgtggtggcacgtgcctgtaatcctcactactcgggagactgaggcaggagaatcgcttgaaccctggaggccaaggttgcagtgagccgcgatcacgccattgcactccagcctgggtgacagagcgagactctgtttaaaaaaaaaaaaaaaaaaaaaaaggcaaacatcacattaaaaagtctgctacttcacaaatgcagaattacattttcttaaggttttttttatctctctttccctattatgacactataattttatcaggcttaatagtgcagttacataatcaaaatatatttcttcaggtatttatccttaggagacctgatccttagtaatgtctaactaaaagtttccaaatagatgagtgaacgattgagcatgtcgagattttcttttgtgtttttaaggattgcatttattttaaacaagaacatactatccttcatttagtacagaggaaggcatctacaaaaccgtgtgttgagtgccatgcctgacggtacagaacgatcgcgtcttcgagaaagaacagccaccctggaacggttgtcaaggcccagcacaacccacacgttccgggtgggttctctgtttcctgtaactttaattttgaaaaacatttgaaaaaaatgaaacttgtccctgattttatttttcttccagcagtcggatacgcctcgaaaaagttcattgacacaaatggaatttgctgctcacacatggacaggtcaaagtattttgacaggtcagcttttctccatatgtaaataaagtgatgtagtaagtgagatttcaagtttcagacagtgaaatggaagatgatctaccttgataagcctattttgctgtaggagggaatagcaaatgtttggggcctgtggcctgacctcagaaacctcgatcacagagcacacctgcagagacttacttacctgctgtgaggtcaagaagaggggaatgtccaaaagctctcaatgaactgggggcctcactcaaaaaaaaaaaaaaaaaaaaatgctgtcttaggagcagtgagtacctctgtctgctatagcgttttcatgctctatttctaagtgaaactctactctcagattctctttgaaaatctgatgataaaaatgcttgagaaaattaacacagatttgctaattactttataacacaaggttttacagataaataggtattctcagcctggtatgctgtttgcaggatattctagtttgaatacgggccagtgatgtttccagttccagaacagtctccaacactgttttcaaggcgttagtgtggcctctggagtctgacgttggatttccaccctcgctctgccaccggctgtgcaaccctaggaatgtcccaacctctctggccctcagcttcctcttttataacaagcagggtacataaaatcattattggaaaactgtgaaaaggatctagctagataccaggcatgtattgctcagaaatgatgaattatgaaccatttgtattataaataacctgaaatttcagggataatttattgttttacagggaattttaaacatataattctaaaaataaatttcgtaacatgtaagcattgcgtagcacagatctgtcgctgtccacatcagccctcctgtcgtcctgtagcatagtgatgtagcatagtgatgtcgagattcttcagctctgtaaagttctgctcctgcgctagtcgctctgggctgctgggcctttttgttgcttttcttgtatgttccttagcagcattagcggtcattcacatgtcaacagctcgttctctaaaaagcagccatgctacatggtcaggtgttgcttttatttatttatttatttattttgagatgaagtctcactgcgacgcccaggctggagtgcagtggtgcaatctcagctcaccgcaacctccacctcccaggttcaagcgattctgctgccacagccccccaagtagctgggattacaggcacatgccacgatgcctggctaatgtttgtatttttagtggagatgaggtttcaccatattggccaggctggtctcaagctcctgacctcaggtaatccacccatcttggcctcccaaagtgctgggattacaggcatgagccactgcgcccagcccaggtgttgcttgtaacacgattgtaggtgcttggggggaagtaggcgcccaagttagcttatcaatcatggatgggtgtatcaagtgctcactctgtgccaaggtctatgccaaaggctgggattcaaacagcaggggtgtttccgtctgtgcctcaaggagcattgagcctggcaggcaagctggaaaaggctgtgagaggggtgagcagcaccacctggatcccctgtcagatggctggagggtgccgaggcttcctagaggagatgaccatcacaagggatgtgagagagagggagtgagggctgacagatgactctctggatggccagcggcgggtggtgctgagcgagggaactggggaaattctgacgagttcacttttggggatgctgactacagcacgccgagtggaggtatctgggaagtagttggagcacacgtaagtagaggtttggagtgggaattgggttctgaatttgttctaaatctcactgttaatcattgaccaaatgccaagtcagtgtattctcttatcagtaactttttttcctttaaaatatgctagtcattgtttctacaattataaaaaataatacattatcgaaacagacaacttacaaaacacaaaaatccaccaaggacaacacagccaaggcccctgatctcacgacgtagagagaacgcggctcaaaggcgtgacctgtgatgttggtgcaatgaggcgcgtgccccatgcagacgtccccaggccccaggtgaggcacatgtggcctcacacacggatttgagcttgggagcgggaggcctaagtcttatccctcaaaagtcttgtccctcaaaaatggaaagctctttctttcctcctgagcactctgtcaacgtcagcccaccacgctgctcacacagggagtcgcctctctggccaccagctcaggcagcacaccacgatctaataggacattcaggaatgaattaaaaaccagagtggattcatggtgacaccttcggcatatcactcactgctttctggaagaggaggtgggggtagagctggtatcgggggactgcagtgacccccactgggggcgtccagaggagttacattaacacgtgcaatcacatatggccacttaactcatgtaggacccagggaacggtccatgccagtcatctgcgcctcactgcctcttaactactgacccaagacaaaagagctattagaagagagaatgcagccaaccaaatgcacagctccaagaggttttgcatctgtaacaacaagctaacatttagttctttggttcaaaatatttcccctccttaaccatttttttaatgcttcaaagttcatccccatttggggagtgggaagggtatgtccaggccccctcaggatcaggctggcttttcttcctttccaccaggtgcacaggcaaaactggccacaggggactccctggagctccatgcagctcggcagggcctgtgcagtccggaagggagggcagagatgcccagggctgtaggtgccggcctgtgcaatccggaggaggccatgcctggtggtcgtgagagacacgggccttggcacggaagtcctagctctgctgctgggtgctgtgacaccaggcattccctgtgggtctcagcttccatacctgtaaaatgggaataacacctcacttaaggactcctgaaataaaacacggagcagataacgcagtgcctggtgcataacaagcctcaacatatccaaggactcatcctgatcacccatgagcctacttaaggtcaaccctgcctcatttaaaaaacaaaacaagactgtgccttcaagttcaggtaggggtggccctgtccggggccaacccccgcctagaaccagccaggcttgtgctgctggagaggaatggccaagccaaggcactcgggaccagcactgagcagcctggtgagctctaagcccgcagagcaggcagggcccccgacaggcaggtggtgtgcaggggtccctggggcaccaagggacaggaaacctcaggagaaggaggccctttcacccgccaaagtggaaccttccccactgaacaccggatctcccagcactgtctgaccttcagtcacattttaaacactgaacagagggacagagggacctgtgttccttgatgtttcatctttgttcatccatcggtcgtcctccaaaccaaagtccagaagcttctgcactaatttcgaagtcaggctgaaccttgagtcatgaacaaaactctttcaattttcctctaagtcttcatggagctcatcataagcaggatcctcataaaggaatttctgaatcattccaatcagtgattctaagaaccacatctttctgcggtccttctgagtggcccagctgtgcaagagacatccccatgcaaaagcaaagccttgatagcacctgatctcaggccggatgttggctccgtgcaccctgcggtgctgccttccttcagtgacgcccacgctcctgccttcctcccagccttcctgatgcccttccccatgtaaccccgcatccgccttcatgatggcatccaacacggcccggctcccagggtcaggcccagacgcaccgcttcagaggatgagctcttatcaggaactctgagacagctactattgatggtcagaggtcttttctatatctgcagaagtgatcgagggtccataagagggatcttcctgtctttctgagggtttgttttctttttctctgacaagcaggcacatgacctccttgctacctttgcgtccaggtcaaaaagcactgggaactactaacttatcaacttttattatttctgtgatagaaaaaaaaaggagccaaaggggtattccaggtagtgggaaggatcccttaaagtacctggcattgcacctgcccctgggaagcaggagagctgccaggaagtagtgctccctcagcctcctgggccaggacccgcctctgcatggaagcttctcgtgaatccaccagctcgggaggacgcgtggcctgcacctccgcttgattttgggggagcacacttccttttccttaggaccctaataggcagtttttgcatatgactatttcctaatttatacaaaagtgtattaaaataaaatatatattttaaagtatttgcatggagtgtacaaaacaatcgttctgagtgggtgcctttgtaacattttaatgagaattaccttttgcttggtgtttccaggttcacaatatgtgcctaaatcttttcagaggacaactttgactttcaagaggagattccaagtgacatcttgaaaccacctcaccagaaccattggagcacctgtggcctcggcacactgcttatcacttgaaaaatggaggaacaagtgttatatttatctgtgtgtctgacagtgtgagatgttagaccgagagaaaagcaaacaaataaatcacttaatcttgaacactt

SEQ ID NO: 38051 - DNA, 405672 bp, Homo sapiens; identical to SEQ ID NO: 37013

SEQ ID NO: 38052 - DNA, 3222 bp, Homo sapiens; identical to SEQ ID NO: 36126

SEQ ID NO: 38053 - DNA, 147735 bp, Homo sapiens
agtggcgctgctgggacgggggaaaggagacgcttcttcctcttgctgctcttctcgttcccgagatcagcggcggcggtgaccgcgagtgggtcggcaccgtctccggctccgggtgcgaacaatgctgactgatagcggaggcggcggcacctcctttgaggaggacctggactctgtggctccgcgatccgccccagctggggcctcggagccgcctccgccgggaggggtcggtctggggatccgcaccgtgaggctctttggggaggccgggccagcgtcgggagtcggcagcagcggcggcggcggcagcggcagcggtacgggcggaggggacgcggcgctggatttcaagttggcggctgccgtgctgaggaccgggggtggaggtggtgcctctggcagtgacgaggacgaagtgtccgaggtaaggctccgggaccctcgcctcccacacattgtgaggcgtgaattctctttgggtaggctctgggccggggccatcctcccgcttccctggtggagcccttctgtgacagcggtcggctccatggcggcggtggccgcggtgagggcctagtgagccctcggcttactctttagctcgagcgggacaggttcccgtcaccattcgtagacccacaatagggagtcctttggtctctgagcttcgcgcgggaacagggactcctcaggctgcctcccgcccaccctgctttggagttgggggtggggggcggggtcttgccagagtccctgcccttggtactgagagagacaaacagagacagagacagagctggtgcaaagatcgtttctcttctttgcctctcctcagagttgagggatacgtttatttgccttctgccttgtgtgtgtcttacctgtgtgcttaaggacggttcttattctccctcttcagtttgagacaggtttgagtattagggatctctcggcttttaccctgaaaaatcacgtgactcctccttctgggaccttttgtgaagttagacaggaaaaggaagttccagggcatccctgagcttcggaatagctgggtagctgaactcggaggttttaggcttggagaaagtggggcaacctgtggaaacctcttcttttttttttttttttttttttttttgagatggagtttcgctcttgttgtccacgctagaatacacgtgatctcagctcactgcaacctccgcctcccgggttcaagcgattctcctgcctcagcctcccgagtagctgggattacaggcgtgcgccaccacgcccgactaattttgtatttttattagatacggggtttcaccatgttggtcaggctggtctcgaactcctgacctcaggtgatccgcccgcctcggcctcccaaagtgctgggattacaggtatgagccaccgtgcccggctggacaccttcactctgcctttgcagtgaagtccttcatttctttaactcttctgtgtgtactctaatgtgtacacatttttaggtctgagcaacctgggatggtaggcattaacttcttttgggttctggggaaaaaggggcgggttttgtttttgttttttgagatggagtttcgctctgtcgccaggctggagtgcagtggcgcgatctcggcacactgcaacctccgcctcctgggttcaagcgattcccctgccttagcctcctgagtagctgggactacaggcgcgtgccaccactcccggctaatattttgtattttttagtaaagacagggtttcaccatgtccaggatggtctcgatctcctgaccttgtgatcccaaggggcggtattttatgtgtatacttttttctgttgactgtggcttgcgtagagtactgtaccgtgattgttttaagtgctcagagtatttcttctattttggttctgaggtgcctgagttgtcacctgtgaccagttattttaacctctggtcttggtgttaaagtacaggaatttctctgtgtgtactaacaatcccggctcttggatttgagaggaataaggagaaattatttgtgggttacagactgcagttagtatactgtcttatcattctaggtctgaacagggttttatttaatatttaaaaccttagtacattctgaccctaacattttgctttggaaaaaaaagtgtgtgggttataaggcgggtagtcccttgaatgtctacgtctttgaatttcacggtaagggaaataacttctaagccaaggtgagagaaatgttttatttgagtaggcagttatggggagagactctggagtatccctgctcttggtcttgtggaaggctttattttatcctttcagtgaaacgtgagagattaagctagaacacagtactttttagctaggaaatgaagtgtgggggatatccttagactaaagattagagcttattttctatgaaacttgtaaatgagaatctgaaagagtttgctttggtctaaatgtgatagaaaaaggggaccttgattttcttgaccatttttacataattgtcatgggtgagatgaaaggtcactcatttgcctttttttttaattttaattttttgttttttttgttttttttgagactgtgtcttgctcttgtcacccaggctggagtgcggtggctcgatcttggctcactgcaacccccgtctcccaggttcaagctattttcctgcctcagcctccctagtaactgggattccaggtgcctgctaccacgactggctaatttttttgtatttttagtagagacgaggttttaccatgttggccaggtgggtctcaaactcctgacctcaggtgatcgccctctcagagtgctgggattacaggcatgagccaccacgcccggccttaattttttttttttttttgagacaggttttgctatgttgtccaggctagcctcaaactcctgggctcgggtggtcctcctacctcagcctcctaagtagctgggactataggcacacgctactgtgcctggcaaccatttgcttttttataagtaatagtcttaaatttcttcacaggtagagcactagtttgcccccaaagtcataaatttgtctctctctctttctgactgtgcatgtctgtgtgtgtgtgtgtgtgtgtgtgtgtgtgtgtgtgtgtgtgtgtgtatgtgtaatggtctttggagtctccataccatgtaattaaagctatgggcagaatccatgccttttgtatttttgaagcttattgtagaagtcatgtgttggtgattcctacacccacttagtggtgcctaatgttagaagagccccatattctcctgtttacttatgttttctgtgcctaaaaggatttacaggttaagagtacatgtagacctcatttttggaatggaagtttctaggatacccactttagcctaatctaagatgatgcttagtgggtgtatagatgctttcttaatctgtgtaagcaggaaattttttttgggtcctgtttctcccatatcacatagagaggaaattcttggagtatctagtctttatagtatgtgtggtagagtatagtctgtgcctttgtgaataaaatgacctgttttggccaagcaaaaattttcccttttctttttctgtctgacaagatgagctgtcttcttttattattattgcctttgaattttcagtgtgaaaaggtaacagtgttcttcaaaaaatactcatgtaattggcatttgatgaataatactaaaatcctccgtctcatctttcctaaatattttgtttatttttatttatttttttgagacagggtctcattctgtcacccaggctggagtgcagtggcacgatcttggctcactgcaacctccgcctcctgggttcaagcgattcttctgtctcaccctcctgagtagctgggattacagatatccaccaccactcccaggtaatttttatatttttggtagagacagcgttttgtcacgttggccaggctggtctcaaacttctggcctcaagtgattctcccaccttggtctcccaaagtgttgggattacaggtgtgagccaccatgcctggccttcatttttcctaaatatttataaccaccgggcatggtggctcacgcctgtaatcacagcactttgggaggccaaggcgggtggatcagctgaggtcaggagttagagaccagcctggccaacatggcaaaattctgtctctattaaaacaaaaaattagccgggcttggtggagggcgcctgtaatctgagttactcaggaggctgagggaggagaatcgcttgaacccaggaggcagaggttgcagtgagccgagatcacgccactgccctccaggcagggtgacagagagagactctgtctcaaaaaaaaaaaaaaataaattattttagaaacaagtacctagacatccaaaaagatgatgaattggtgtgtagtttgggagtgaagtttgtcttgttgctctaatggggcaggattaggtgagaaataagaaatgtggagccctagtatttttgctctagaattagttggtcttctacattttgtgtacagaggagtagaccctctaaggacctctttatatttaatatcagagccaagagctgagaaaaaacaagctactctttcttgctggccaagcaaaagaccttttggttagaggaatggactcacatctttcagtacattttttttttttttttgagatggagtcttgtcgcccaggctggcacgatcttagctcactgcaacctctgcttcctgcattcaagtgattctcctgcctcagtagtgagattacaagtgcgtgccaccatgcctggctaatttttctatctttagcagaaatgggggtttcaccatattggccaggctggtctcgaactcctgacctcaggtgatctgctcgcctaggtctcccaaagtgctgggattacagccgtgagtcacccacctggcccttttgttattttaaacattggggtaaatacctgcttcgtatttcttcaggcattcttagcatgtttcttagctatcgaagcccttgattagaagagctagcactgcattgaatcctattaagaaatgtatccatgttcagaatagaagttaggttaaaaatttcttaaaaaccactttaggcctggtgcggtggctaacgcctgtaatcccagcactttgggaggccgaggtgggtgggtcacaagatcaggagtttgagaccagccagaccaacatggtgaaaccccatctctactaaaaaacaaaaattaggtgggcgtggtggcacgcacctgcaatctcagcctactcaggaggctgaggcaggagaattgcttgaacctgggaggcagaagtcgcagtgagctgagatcgcgtcactgcactccagcctgggtgacagagtgagactccatctccaaaaaaaaaaaaaaaaccactttaaaaaatggtttttattttaaatttttatttatttattttgagattaggattacaggtgtgagccaccacacccagcctatttttatttatttatttatttttagagatgggcttttgctctgtcacccaggctggaatgcagtggcatgatcatagttcactgcaacctcgaattcctgggctcaagcaatcctactgcctcagcctcccaaagagctaggtctaactagaggtgtactccaccactccacctgatttaaaaaaaaaaaaatgttgcccaggctagtcttgaactcctggcctcaagggatccttctgcctgggcctccaaaaatgcagagattacaagttgtaagccactgtgcctgaccgaaaaaccaatttttaaattttaattttagaattgtggtcttttaatttttttagcaaatcgaaataaaaatacagtttctaaagaaaagattgtgtgagacatggttttcaatttttgtcgtaagaatgaatgtgtgtgtatatgtgtgtttgtgtgtgtatgtgtgtgtgtgacggccctcttttaaaattattacaaaagtggccgggcgcggtggctcacgcctgtaatcccaccactttgggaggccaaagcggatggatcatctgaggtcaggagtttgagaccagcctggccaacatggtgaaagcctgtctctactaaaaatacaaaaattagctgggtatggtggcaggcgcctgtaatcctagccacttgggaggctgaggcaggagaatctcttgaacccgggagacggaggctgcagtcagccaagatcataccagtgcactccagtctgggtaacagagcaagactccatctcaaaaaattagaaaataataaaattattacaaaatagttacttgttgaaaaactcaacaatatagatagtaggtataaggggaaaagtaaaagtgcttcttcccacccccattaattcttcaaattctacccttcaaggtaaccaatattaaaatttttcattcagtaaattttctaggcctatctttctatgtatatatgtatatatgttcatatacacatactttaaaggcatatcaaatttaaaagtgtagctttatatcacactgaggtttttttcttgaagcaggtgctgtatttacaattatataaaagcacgcagaaattgtatttagctctgaaaatatagcacaagctttgtagggattcctttttccctgaaaattacttttaacatcaaaagcaaaagtcatacagaaatcccatcctgattttctccagtaggtaaggagttgggtcatatcctttaagattgtttatgatctatatataatctgttttttaatttttaattaaattttttttaccgttatgtgttttgagagatgggggtctcgcttttttgcccaggctggctgttgccctggctacacagtgcggtggcatggtcataactctatgtggtctcccactcctgggctcaagcaatccttctgcttcagcctcccaagtagtcaggactacaggggactataggtgtgcaccacaatacttggctagtatgatctataatctagagcagtttctcaagagcaacatatagacattttgggacagagaattctttgttgtgaggggctctcctgtgcattagaagcatccctggcctctacccactagatgccagtagaacccgattatgatagccaaaaattgttcagacgttgccaaatgtctcctagggacaaaatcactcctggttgagagctaccggtctagaggccactcttgtcaggaatggtagttttgttatactctgtattcaaacttaaggtaaacaaggtgagtcactgcttttaatagcatttcaggacttatgcttataacctgaacaagggagaaatagaaggtactgaaaggtttaatataaaactagcatgcactgctgtaaattttctatggtaaatgtatcattttggggaactttcacttaaaatatattatttttcaaaaagttcagttgtccatgaaaatgaatttttaaaaaacttttatggggacttccagtttgttcaaagtagaaatgctttattccataaattatcatttgtagtgataacataggaaatataactttgtattctagtgggctaattttggagactttggaaatgcttattgaataaaaagaattatatgttattactgtaacaattttttttttttttttttgagtcagaggagccttgctctgtcacccaggctggagtgcagtggcaggatctcggctcactgcagcctccacctcctgggttcaagtgattctcctgcctcagcctcctgagtagctgggactacaggcccgtgccaccacgctcggctaattttttgtatttttagtagagacggtgtttcactgtgttacccaggatggtctcggtctcctgaccttgtgatccacccgcctcagcctcccaaagtgctgggattacaggtgtgagccaccgcgcccagccacaattttttgtatgttgcacaaatatcaacctttcacaagcttcatgatgtaaagccttaagactttacatataaaatgatgcattgataagtatatttatgtgaatggtggggttgatgcagagttgattagtatgggtggaggaaaactttttgggaaactttaagtatgagaggtttttgttgttattagtatattttcaatagataattacattcatatagttcataagtcaaagtaatataagggcagatacagtgaagtctcaatctcaccctgctcccacatatcttgctctttatacttttaataaaagtattatatagcctttcagaatttctttatgaaaatacaactatgtgtattttccctactgttacacagatggtaagatgctatttatgtgaaatttttaaatggtaaatttgagaaggatttagacttttttaaaaaattaaagtgataaattatgttatgaatgaaggatggaggtgagtttaagcacattcctttctgagtctatttgttagtagagtgctgattgactagatgaattcaaaatcagttctggccttctgattcagtgatcactaatataaataaaatatgttactttaaagaaaagcaaaacagttttaaacagttttagccttgaattggcaagtaaacaaaataaatgacaagtttaccaaatttttttttttggccaaatttactttctcagaactaaagttgtaataaataaaatcaattctttttttaaacccactataaaggaactgtttcaatgtatctgtcttcacagaccttattgatcacatttccctctcctattgcttgtctatagagtcatagaatcttggtgataatcctatctcatctcatttttaggtaactgctaccatttattgaatgcttattatataccagtaccgtactagatactttcgttattttatttaatcgtttcatcacccctttgaggtaggtattatctacatttttatagatgaataagtgtaggctcagagagtttttagagtaatgaatctaaaaaacaaaaaaatggttaaaatgttatatggctagtgactggtaaaggtgggatttgaatgtgatactgaatttagagcccatactgttattttgcttcaaattaagaaatatgtagtttttggttaccaaatgctgttttttaaataaatcattgtttagttcctattgaagttttcacagatgtaaagtaaaatggagaaaataagcaggatgtagtgaatttctaatgaagctattttttcccacttttttctattttgacaaatactcttcctacttttacaaaatgaatttttaaaactatctgtacttaacagaatatcaactggaaacttcatttgggaccctggataaaagcctcagaagtctgggaactgttgagctaaatgacttgcccagatcacacagttaatatgtagcagtcaagactgaaaaataggccatctgattcccattctagttatcctaccttccagattctcctaactttcttttgatgcattatattaatgagtttaattagttgcttataaatgcctctttcaaactattatagtttataatccatagttgatcttgttggaaaagtttttttttttttttggctgttttttttttggtttgtttgagaacggagtctcactctgttgcccaggctggagtgtaatggtgcaatcttggctcactgcaacctctgcctcccgagttcaagcaattctcctgcctcagcctcctgagtagctgggattataggcggccaccaccatacccagctaatttttttttgtatttttagtagagatggggtttcaccatgttggccaggctggtctcgaactcctgacctcagactatctgcccacctcagcctcccaaagtgctgggattataggcttgagccactgtgcctggcctttttttaaatttttttttttttgagacagggtcccgttatgtcacccaagctggagtgcggtggtgcaggagtgcagtggctcacgatcgtatggcgcaatcacggctcaggcagccttgaccttctgggctcaagcgatcctcccctttcagcctcccaagtgtctgggaccacaggcgcacaccaccgtaccctgctaatttttaaattaaatttaattaattaattttttccgacacacagtcttagttgcccaggctggagtgcagtggcggatctcagctcactgcaacctccgcctcctgggttcaggcaattctcctgccttagcctcccaagtagctaggattacaggtgcgtgccaccatgccccgctaatttgttgtatttttagtagagatggggtttcaccatgttgaccacgctggtctcaaactcctgaccttgtgatctgcccacctcccaaagtgctgcgattacaggcgtgagccaccgtgcccggctattttttttgtagttacaaggtctcattatgttgtccaggctggtctcaaactcctgagctcaagggatcctcctgcagtggcctcccagagggccaagattacaggcatgagctaccacgcctggccggaaaagttttatattttttaatgaaattactgtcatgtagatcagcataagagagtgtaccactagagtatagggggagcactattctaaagaaattttgtaatgaacttaattggaaagttcaggtctttcattattcatttaaaaaggattaagaaataattaaaaccattgaaatagaaaggcatatgcccaactttgcagctttgccaatatgggaaatatttgttttacaatattgttatattccaattattttgtaaaaattgtaatctgcttttctattgatagttacagacagtgcatggttcctgtgagtaaagatcaattgacttatgatgattgactagtttacctttcttcctgccaagtttacctaaaccaggaagaaagtaaggttgtatataaaaaaatttgttggactgaaatttagcaactatttgtggaagagcacattttgctcttcctctgctacatagacttctgttctcacaaagttttccacttactgaatagatactgttttcagtagtagaaaggatgtttttttaaaaaatgtagatatcccactgtatgctagtgattgattcatctgtattagtatgcaattttgaaaagagaaaggcaagtatatccctagaggttacccctaagaaccaactaagaaccaaagagttaaacaagaaaacagtttattaagttgccaaggtaagtttgatgtgtttaaaaatttacaatgaggacaattagattgagaacgagtttgttttttagattttggtaaaatattcataacataaaatctatcattttaaccatttttttgtttttgttttaaaattgtggtagaatatgtatatataacataaactttaccattttaatcacatttatactttaaccactgtacatgtatgttaaatgtacagttcagtggcattaagtgtatttacattgttgtgcaaccttcaccatcaaccatctccagaactttctcatcttccaaactgaaattctgtacttgttaaacaataattctcccattctcccttcccccaacccctagcaactaccattctacgttttctctctatgaattttactacttatataattggaatcatgcagtatttgtccttctgtgactggctttgttctcttagcataatgtcttcagggttaatccagttgttgcttgtgtcaaaattttattcttttaaagttaaattcaattgtgtgtgtatatgtatgtgtgtgtgtatatatgtacacacatgcacactccctatattttatttatctgttcatttgggtttttttgtttgttttgtttttttttggagatggagtcttgctctgtcacccaggctggagtgcagtggcacgatctcagctcactgcaacctccacctcctgggttcaagtgattctcctgcttcagcctcccgagtagctgagactacaggagtgtgccaccatgcctggctaatttttgtatttttagtggagatggggttttgctatgtaggccaggcttgtctcaaactcctgacctcatgtgatccactcgcctcgacctcctaaagtgctgggattacaggtgtgagccactgtgcccggtctatctgttcatctgttgatggacacttggattgcttccaccattgggctattatgaataatgctgttatgaacatagatatgcaaatatctctttgaggcctgcattcaattattttaggtatatacccagaaatggaattgctggatcatatggtaattctatttttaattttttgaggaactgcaatactgtgttctatatcagctatatcatttgacattcctaacagcaaagcacaaggaagggttctaatttctccatattctagccaacagttatttatgtttgttttttgataatagcaattctaatgggtatgaagtggtatttcattggggttttgatttgttatttccctaatgattagtagtgttaagcatcttttcatatgcttattggccatttctgtatctttggtgaaatgtctattcaaatccattgtacatttaaaaagaaattgtattgccgattaggcacagtggctcacgcctgtaatcccagcactttgggaggctgaggcagaaagatcatctgagcccaggagttcagaaccagcctgggcaatatagggaaccctgtctctacaaaaagtaaaaaaaaattagccaggcatggtggcacatgcctgtagtcccagctactcaagaggctgaggtgggaggattgcttgggcctgtgtggtcgaggctgcaataagctgtgactgccactgtcactgcactccagcctgggtgacaagagtgagaccctgtctcaaaaaaaaaaaaaaattgtgttgtttgttttttattgtttagttgtaggaattctttatatattctggatattaatcccttatcagatacataattaacaaatatttgccttcattctgtagcttgtcatttcattctgttgctgtagtgtcctttcatgaacaaaaagtttctaattttgatgaacctaatttatctgtttttttattttgtcgtatgcttatgatgtcatgaaattattgccatctccagtgtcatgaagattttcaggcgtggtggttcacacctataatcccagcgctttggggggccgaggcgggccgatcacaaggtcaggagtttgagaccagcctgaccaacatggtgaaatcccatctctactaaaaaatacaaaaattagccgggcatggtggtgcctgcctgtaatcccagctactcaggaggctgagtcaggagaattgctgaacctgggaggcggaggttgcagtgagctgagatcttgccactgcactccagcctgggtgacagagcgagacttcgtcttaagaaaaaaaaaaagagttttatagtctaagcttttaaatttacgcctttgatacctctttttttttttttttttgagatggagtcttgctctgtcgcccaggctggagtacaatggtgcgatctcggctcactgtaacctccaccttctgggttcaggcgattctcctgcctcagcctcccaagtagctgggattacaggtgcacgccaccacgcccagctaatttttgtatttttagtagatagggggtttgccatgttggccaggctggtcttgaactcctgacctcaagtgatctgcctgcctctgcctcccaaagtgctgggattacaggcctcagccaccgcacccagccgcctttgatacattttgagttaattttttaaaatttatttttatttatttatttatttattttattatactttaagttctagggtacatgtgcacaacctgcaggtttgttacatatgtacacatgtgccatgttggtgtgctgtacccattaacttgtcatgtacattaggtatatttcctaatgctatcccttccccctcccctgaccccacgacaggccccggtgtgtgatgttccccaccctgtgtccaagtgttctcattgttcaattcccacctatgagtgagaacgtgcagtgtctggttttctgtccttgcaatagtttgctcagaatgatggtttccagcttcatccatgtccctacaaaggatacaaactcatcctttcttatggctgcatagcattccatggtgtgcatgtggtacattttcttaatccagtctatcattgatggatgtttgggttggttccaagtctttgctattgtgaatagtgccgcagtaaacgtacgtgtgcgtgtgtctttatagcagcatgatttataatcctttgggtatatacccagtaatgggatggctgggtcaaatggtatttctagttctagatccttgaggaatcgccaagttaatttttgtatatggtataaggtaaggtccaatttcatgcttttgcttgtggatatccagttttttagcaccatttgttaaagaccattattttcccattgaatggccttggcatccttgtcaaaaatcaattgaccatatataagtgggtttactttcttgactctctgatctattccattggtctatatgtctgtctctttgccaccatcctcttttgattactgtagctttatagtaagttgaaattaggaagcattagtctttcaaatttgttcttttttttaattttaattttttatagagatgaggtcttactatgttgtccaggctggtctcaaactcctggcctcaagtgatcctcccaccttggcctcctaaaatgctgggattacaagtgtgaggcaccatgcctaacctgttcttcttttttaagattattttgactattctgggtcttttgagatcccatattaattttaggatgggtttttttttttttaatttctgcaaaaagtgccattgagattcaatagggattgtattgaatctatagattgttttggatgagaaaaacttttaatacaaattttatgtaattgttttattataataattattagcaaatcaaaggacttgatctggacaaaatattaaaaagcatctatgatggagaggctgccagactcagtcaactgatgttctccctgaagccattgaacccaaaataacatgggatgtttactttgagtatatgtttttgaaatataatccttattttttcctgatttatcctcatattgactaatttgtgagtgatcaggatatgtcgtatattgattaaatgctagaaagaatattctttatcctttatatgattagatatgagctcagtcttggaaaaattatctcaatatggtattaaacttagataaatgaacctgtagttatcattatgacaaaggagcaaatcccaaaagggacagtagtggatacattctctttttttttggttattatttatgtatttatttatttaattaaacatttttttaattaaaaaattttttaatttaaaatttttaatttaattaataattaattaaagacagtgtctctgtcactcaggcttgagtgtagtggcacgatcttggcttactgcaacctccacctccagagctcaagccatcctcccacctcggcctcctaagtatagctgggactataggtgcatgccaccatgtctggctaatttttgtattttttgtagagatgggctttgccatgttgcccaggctggtggtcctgaacctcctgagctcaagcagtctgcctgcgtcggcctcccagagtgctgggattacaggcatgcgccactgcacccaacccagttactttttattgtgatataatttcaaacttactggaaagttgtaagaatagtacaaggaacttttcccatatagtctttttttttttttttttttttgagacagagtctcgctctgtcgtcgctcaggctggagtggagtggcacagtcttggctcactgcaacctccgcctcctgggttcaagcaattctcctgcttcagccccccgagtagctgggattacaggtgcctgccaccacgcccggctagtttttttgtatttttagtagagatggggtttcaccatgttgtccaggccagtctcaaactcccgacctcaggcgatctgccctcctcggcctcccaaagtgctgggattacaggcgtgagccaccgggtccagccttcttttttttttttttttttttgagataggatctcactgtcacctaacctggagttaagagtggcacagtcacggttcactgcagcctcaacctccccaggctcaggtgatccacttcagcctcctcagtagctgggactacagatgtgcaccactacagtggctaatttgttttttgtattttttgtagagtcagggttttgtcatgttgcccaggctgttctcaaattcctgagctcaagcagtcctcctgccttggcctcccaaagtgttgggattactggtgtgagccactacgcctggcccattggtttttaatatattcacaaagttgtatgaccatcaactaactattctaaaacacttttatcactcccaaaagaagccgtgtactccttagcagtcttttcccattctcaccttcccccagcccctcataatcactaatccactttctgtctgtatgtatttgcctaatctgggcatttcgtataaacagaatcatataatatgtggttatttgtgcctgatttctttcacttaacatattgttttaaagatttctacaatattgtagcaggtatcaatactttttgttttgcttttgagtccgagtcttgctctgtcacccaggctgcagtgcagtggggcagtcatatctcattgcagcctccagttcttgggctcaagtgattctcgtgcctcagcctcgcgagtagctgggattacaggcatgtgccaacactcctggctaatttttgtatttttagtagagatagggtttcaccatgttgcccaggctggtctcgaactcctggcctctagtgatccacttgccttggcctcccaaagtgctggagttataggcatgagccatcatacctgtcctactgccaattctctgcagctgtactatttaacattcctaccagcaatgtacaagagttccattcttctcatcttcactaacatttgttatttttctttcttttctctcttttttttttttattacagccattctagtgagtgtgaggtggtatctaattgtggttttgatttgcatttccctaatgattaatgatgttgagcatcttttcatgtgcttattggtcatatgtatatctttgaagaaatatctattcaaatatttttcctgttgattgggttttttttatagctatgtgtttgttttttcttttcttttttaaatttgttttaggaaaaaaattctggatgctagttccttaacagatccatgatttgcaaatattttctcccattctgtgagttgtcttcattttctttctttctttttttttttttttttttgtttttgagatggtctcactctgtcacccaggctggaatgtagttgcccaatcatagctcactgaagcctcaaacttctgggttcaagtgatcctccaacctcagcttctggaatagttgggactatcagcatgtaccactgtgcctggctgatttttaatttttttgtagatatggagtatcagtatattgcccagactggtcttgaggtcttgaactcctaagctcaagtgattctcctgcctgtcttttctttctttctctctctctttcttttcttttctcttctctttcctttctttttctttctttctttctttctttctttctttctttctttctttctttctttctttctttctttttctttctctttctttttttctttcttttctttctttcttcttctgtccttccttccttccttccgtctgtccttccttccccctcccctcccctcccctcccctcccctcccctcccctcccctcccctcccctcccctctcctcccctccgctcctcctcccctcccctctccacacagtctccctccctctgttgcccaggctggaatgtagttgctccatcatggctcactgcagcctcagcctctcaggctcaaacaattctcccctcagcctcccaagtagctggactacaggtgcacaccaccatgcccagctaattttactgtttgtacagacaaggtctcaccattttgcccaggctggtctcaaactcctggcctcaggcagtcctcccgccttggcctctcaaagtgctgggattatatgcatgagccaccatacccagtcttgtcttcactttcttgtgtcacttgaagtttaaaaattttgatgacgcccaatttatatatttatctttttgcttgtgctcttgttgtcatgtctaagaaaccattgcgtaatccaagatgacaaagatttatgatttatgcctgttttcttctgagacttgcatagttttagctcttacatttaggtctctgatccaatttgagttaatttttatatataaggcgtgaggtagaggtctaacttgattcttttgaatgtgcatacccagttttttcagcataatttgttgaaaagactatttctatcccccttgaattgtctttgcacccttttcaaaaatcagttgactacgtgtgagggtttatttctggactgtctgttctattcattgatctatatgtctccctatgccagttccacactgtcttgattactgtagctttttgcagtaagttttgaaatgagaaagtgtaagtcttctgactttgttatttttcattgttgttttggttattctgggttattggttattggttatattcttgttctcttgatgtggtctttaggagaggtatagtaggaggtgtttaatatgatgcagaatttgtggtaatagacaaatgattcaaccccctccttcccacttccataacattctagctcttgaaatttctgtacctttctatatgctgtaggtggggagaaattcatgtaatttaaaccatgtaatttaaatttgccagactgctaggagaacaagttgtagtatcaatgtttgttttcctttttttaacccgtttaccctgtgcatcccctctctcacaaagcctgagtatatgttttagaagaggtaagaccgaagaggaaggagatggttggtttgggtagttgtcttctgagtggactagtctccaagaagaatatggacagaatttctttttccagggcaacaaacaaatggataattggaataaactataaaacatggtaattagagtttttactttttttttttttttttttttttgagacagtttcgctcttgtcgcccaggctggcgtgcagtggcgtgatctcggctcactgcaacctctgcctcctgggttcaagcgattatcctgcctttgcctcctgagtagctgggattacaggggccggccaccacacccagctaatttttgtatttttagtagagacgaggtttcaccatgttagccagattgctctcaaactcctgacctcaagtgatccacccaccttggcctcccagagtgttgggattacaggcttgagccaccgtgcccggccgagtttttgcatctcgtaacacctgcttaaggaggtgtaaattcaatgtttaagtaacatacagtttgacttccaagccagtattgtcacagtcttatcacttgctctaatgcttctagttttgttaggttactaattatttcagctcagtgaacaataagagtctgtactatattttggtacctgtcttacttgggacttgactgataggttagcaatgaaaagtttattttcttttagtttgaagagaccattatttgaggctatacttaaaatcatggatttgacctattaccaacccctcaacagaatttagaattatatgatgatatagtatcacgagtactattgtatatatctccttgttgctgatctgttgaaattattcactcattctctacagaagaaaatcttggttaatttggggtaggacttcttcatgaactcacattttgcataacagaattatgtcctttaaaggttagagtccttggtagtttaagaattctgattggtattttagagtggattgattgattgagacggagtttcactcttgtcgcccaggctggagtgcagtggcatgatcttggctcatttcaacctccgcctcctgggtacaagcaattctcctaccgcaccctcccgagtagctgggattacaggcgcccaccaccacgcccggctaattttttgtatttcttaggagagatggggtttcaccatgttgggcaggctggtctcaaactcctgacctcaggtgatctgcctgcctctgtgtcccaaggtgctgggattacaggcatcagccaccacacctggcctagagtggatttatttattcacaattatttatttagagcctactatttgttaagctttgtgctagactttggactacaaagatgaaaaaatatgttccctgtccttaaagacatcagtcttccagcactttggggggctgaggcactttatgttctgggcggatcgtgaggtcaggagttcgagaccagcctgatcaacatggtgaaaccccgtctctactaaaaatacaaaaaatttagcagggtgtagtggtacgcacctgtaatcccagatactcaggaggctgaggctggagaatcgcttgaacctgggaggtggaggttgcagtgagccaagattgcaccattgcactccagcctgggtgacggagcaagactctgtcttgggggggaaaaaagacatcagtcttttcaggaatattaatattcctggtaatgaaaaaagaaggtaaattattgtttattttttgagacagggtcttgctctttcgcccaggctggagtgcagtggtgcgatcatggctcactgcaaactctacctcctgggttcaagcaatcctcccacctcaaacctccccttccacaccccacccctgcagctgggactacaggcatccgcagccacactccacactcagctaattttaaaatattttttggtggaggtgaggtctcaatacctagggtagtttggaagttctggccttaagtgatcgtcctgccttggccttccaaactgctgggattacaggcatgagccaccatgcccagcctatttattcaaattatatttgtcattctaaactctttttagatattaataaattgtatttgagtgttctaggcattgtgcactttaattgcatcacctcatttaattttctcatggttctgtgacagtccaagataccaaattcaatgtgtggatcattgccctgtgttagttggatgatcactctaaagattgatatttgagtgtcttgcttcaggagattgatgggctctaagtggcaggtttaaaggggcagtaatttaaaatggaaggatgcatagtccatcagcataagattgtcttgtgcttatttttgagcaaaaccacaactgctccttattatgttctgtaaactcgccaagcctgtgatgcttcagggcctttggcacttctggttccctctgtcaggtacattctcttagatatccatgtggcttccctttcacttctattatgtttcatttaagagaccttccaactattaatacctactgtatgtatattgcataaacatctcaggctcattaattctaaaactgaactcatactttccccttgcactccactatgatgaatgtgtcccccaaagttcatgtgttagaaacttggttcctagttcaacagtgttaggaggttgggcctaataagaggtaactgagtcattaggacttctcacaggagctggttaactatcctgagtcgctttattgtaaagcacatttggccccctcttccattagctctctctcccatgctgtcttgtcattctgtcactcttttggccaaaatccttcccatttcgtagataaaggatccaaattccttggtatggcagacatagttatttaggatttggcgttgtctatctttccaactatatccttatgctctatttgctttttatattctagccatactaaattgctgtagttcttagaacatatcaagctcttatataccctggtatatatacttccactgctttggcatcaagaataataatactagctactatatatatatagagagagagagagagagagagacagagacagagatagagatgtatcacacacacatctatatatacacacacgcactcatctagacaatatcttgttctgtcatccaggctggaatgcagtggcttgatcatggttcactgtagccttgaactcctgggttcaagtcatcttcccgccccagcctcccaagcagctctgactcctccggtgcatgctagtatgtctggctatttttagtttttaattttattttttgtagagatgatatgttcaaaaactacagcaatttggtatggctagaatataaaaagcaaatagaatacaacaaggatatagttggaaagatagtcaaagccaaatcctaaataactatatgtgccatacaaagaaatttggatcctttacctaagaaatgggagggattttagccaaaggagtgatatgattgatctggtattagagttagtgggcttgataatctgttacatttaatttaaattccaaagttattttctgacaatatgattgttaggacagctgtagattttctgttcactacactggttagtatttgttttagttacactctgttgtttagaagattcacttcatccactttggtgtagtgaaaagggtgtaaactttgttgtctgaaacacatagcttcagatcctcacatggttttgtgatcttgggccagtcacttaacattaagtagttaagatggttgaataaaatagtatatggaaaaggctgatacatatgagacattttattaatggtagcctattatgtttttaaaggtacttaatagtagatttttaaaaagatttttccttctcctgttttcagttagggacttcaaaagataatagattctgtgttaaagctatagtttaaaaatgaagtttttgtgttcgagcaaagtggggataattttcttcagctttaacttagatttaggaaaagcatgatggttcttttttgtgctacatgaagctaaccaatttcagaaaacccaagatatgatttctgttttttattactgttttttattaagacagggtcttacacttttgcccaggctggagtgcagtggtgtgatcatggctcatgcagcctctaccttctccagctcaaatgatcctgccgcctcagcctcccaagtagctgggactataggtatgcaccaccatgcccagctaatttttgttttttgtagagacagggtttcaccctgttgcccaggctggtttctaactactgagctcaagcaatctgcccaccttagcctcgctaagtgctgggattacaggcatgagccactgccccaggcctcttttctgttttttgagaaggggggattgtgagtctgagactgggggggaataaagttttcattgtagaaagaaccttgaaaagcttttatgttaatgaatatagcctttttattccagtattttaagatgtttttgctgagtatattaggcctttttgtaacaacaaaactcacccctaagtttgtcattatttggtgctaaattacaacagtattactttttgcctttgagttgatcttagggcatgattatggtggttgctactgctagaattttggagtactgtgtgttttgcaaaaaggaattgttatgtccttcagtaattacttcttggaacactggcccatcctttttgctgttctgagtagagatcaacaataggcattccaaaatggtgctgatcctgacttaaagtggagggctcacgttgggtaggggaaggataagacatgttggcctattcaaatatacataagaaaaagaggactagcgagtacatgttttaaaaatgtatattttggttgtttaaaataccttcccattttaaatgatcaaatctgaatttcttaagggagcttctttttttgggacagagtctcgctctgccgcccaggctggagtacggtggcatgatcttggctcactgcaacttctgcctcctatgctcaagcaattctcctgcctcaggtccccagtagctgggactacaggcacacaccatcacgcctggctaatttttgtatttttggtagagacaggattttgccatgttgcccaggctggtcttgaactcctaacctcaggtgatctgcctgcctcagccttccaaagtgctggggttacaaggtgtgagccactgcgcccagctgggagctttatttttgaaggttggtgaggagaggtagaatgagataaaggtttagtctttccttgaacttttttatttatttatttatttatttatttatttttttattgatcattcttgggtgtttctcgcagagggggatttggcagggtcacaggacaatagcggagggaaggtcagcagataaacaagtgaacaaaggtctctggttttcctaggcagaggaccctgcggccttccgcagtgtttgtgtccctgggtacttgagaccagggagtggtgatgactcttaaagagcatgctgccttcaagcatctgtttaacaaagcacatcttgcaccgcccttaatccattcaaccctgagtggatacagcacatgtttcagagagcatagggttgggggcaaggtcacagatcaacaggatcccatggcagaataatttctcttagtacagaacaaaatgaaaagtctcccatgtctacctctttctacacagacacggcaaccatccgatttctcaatcttttccccacctttcccccctttctattccacaaaacagccattgtcatcatggcccgttctcaatgagctgttgggtacacctcccagacggggtggtggccgggcggaggggctcctcacttcccagtaggggcagccgggcagaggcgcccctcacttcccggacggggcggctggccgggcagggggctgaccccccccacctccctcccggacggggcagctggccgggcagaggggctcctcacttcccagtaggggcggccgggcagaggtgcccctcacctcccagacggggtggctggccgggcggggggctgacccccccacctccctcccggacggggcggctggccgggtggggggccgacccccccacctccctcccggacggggcggctggccaggcggggggctgacccccccccacctccctccccgacgggcggctggccgggcggggggctgaccccccaacctctctcccggacggggcggctggccgggcagaggggctcctcacttcccagtaggggcggccgggcagaggcgcccctcacctcccggacggggcggctggccgggcggggggctgacccccccacctcccttgcggacggggcggctggccgggcggggggctgacgcccccacctccctcccggacggggcggctggccgggcggggggctgacccccccacctccctcccggacggggcggccggccaggcagaggggctcctcacttcccagtaggggcggccgggcagaggcgcccctcacctcccggacagggcggctggccgggcggggggctgatccccccacctccctcccggacagggtggctgccgggcggagacgttcctcacttcccagacggggtggctgctgggcggaggggctcctcacttctcagacggggcggctgccaggtggaggggctcctcacttctcagacggggcggttgccaggcagagggtctcctcacttctcagacggggcggccaggcagagacactcctcacatcccggacagggcggcagggcagaggcactccccacatcccggacgatgggcagccgggcagagacgctcctcacttcctagatgggatggcggccgggaagaggtgctcctcacttcctagatgggatggcggctgggcagagacgctcctcactttccagactgggcagccaggcagaggggctcctcacatcccagacgatgggcggccaggcagagacgctcctcacttcccagacggggtggcggccgggcagaggctgcaatctcggcactttgggaggccaaggcaggctgctgggaggtggaggttgcagcgagccgagatcacgccactgcactccagcctgggcaccattgagcactgagtgaacgagactccgtctgcaatcccggcacctcgggaggccgaggctggcggatcactcgcggttaggagctggagaccagcccggccaacacagcgaaaccctgcctccaccaaaaaaacacgaaaaccagtcaggcgtggtggcgcacgcctgcaatcgcaggcactcggcaggctgaggcaggagaatcaggcagggaggttgcagtgagcccagatggcagcagtacagtccagctttggctcggcatcagagggagaccgtggaaagagagggagagggagaccgtggggagagggagagggcgagggcgagggcgaggtccttgaactttttcatagctccagttgaaattcatgagagtggtgatgactctttgttttgtttttttaaattaaccagcctagaatattctttttatttttatttttatttttattgagacggagtcttgctctgttgcccaggttagagtgcagtggcgcgatcttggctcactgcaacctctgctgcctgggttcaagcgattctcgtgtgtcagcctcccgagtagctgtgactacaggcatgcaccatgaggtctggcaaattttttttgtatttttagtagagacagggtttcaccatgttggccaggctggtctcgaactcctgacctcaggtgatccactagccttggcctcccaaagtgctgggattacaggcataagctaccatgcccggcctagaatttttttttttttttttttgtgagatggagtctcgctctgttgtccaggctgaagtgcagtggcacaatctcggttcactctaacctccacctcccaggttcaagcaattctcctgcctcagcctcccgagtagctgggactacaggcgcctgccaccacgcccggctaatttttgtatttttagtaaagacggggtttcaccatattggccaggctggtctcgatttcctgaccttgtgatccacccgcctcggcctcccaaagtgctgggattacaggtgtgagccactgcgcccagcctggcctagaatattcttaaaggataccagaaatgaaatttgtggctactaatatttgactctctaactcaaaatataaatttatttaacatgttaaaagtaaaaatttcataatccaattccaagggctctgtggaaaacaatgtatttttcatttatatttaagagcttggctggtgttcttttttttgttccctgcattgtatgaccacaggactagagaatacataaacaaatatatgtaatgtacatgttttatgatagaatattattttttactattaataacattttctgtgttagctagcaattactatttctagaaatacagtctgagagaagttaattagttattgatcaatgtaatatgagatattattattttattacagtataagacttaaagcatattactattattggaagttttaattatagcgctacatagaaactgttttaatgtggacgtgagttttggttaaatcatagctggattaataaatgatttttcaaactagactttggccagagtgactgactgttcttttaggtgataatagctgagtctgtggtaatctctcttggtaactgttgcatccagtggttcatttctgaaatgtcaaaatggaataaaaatgggacaaaatgcttgtcccccttctcccttctcctcccttttgtttgttttagttgaagctaaaaaccacactcccatactccttgttttttgttttttgtttttaaggcaagaaggaaaaataaccttttgaggaggaagacaaaggtttttgtctttagtatttcaggagatataagggaaaaacaggtagtttttgatgggccgtattcctttaccactctttttcctccaccctttattcttgtacctagtcagaggtaggaaaaaagattctttggtgtttagaacttgcctttggcaaaaaataatactgctataagtggatgtatttatttgctgctgaatgtagctactgaatagagatgagctatgtaacagtatcatcaggcaataagaacattgctgtgatgttatagctatatgtaagaaagtataaggcttttatattcatttgcttgatgaagactaatttcattagacatactattattttgggcttatctgttatatatagacatggtttctgtactctatcaccaagccttttatattaagtatacagaatgtatacagaatttgtcatatttaacatatctccacgtagctataaatggtttccatctttttttttttttttttttgacagagtctcactctgtcgcccagggtccaggttgaagtggaatggcatgatcatggcatatagcagcctcaacctcctgggctcaggcgatcctcccacctcagtttcttgagtagctggaaccacaggcacatggccaccatgcctggctaatttttaaaaattatttttcgtagagacaaggtctcactatgttgcccaggctggtcttgaactcctgggctcaagcagtcctcctccctcagtctcccaaagtgttgggattacaagcatgggccacatgtacccagccagctgtattttgaagtaatgctaatgcaatctgaattgtaagaatatgtttcagcagatttgttaggtaagatatttgtgaaccgccaaaagtaatctctcaaatatttccaaaataataagcataatgggatattttgtccttttattgattccacattgagacagacatttttaaagttataaagagggtgggacaaaggaaacagtagtgctttttgggaaatctgattgatacaaatgtattcatatcatttatctgtatggttttgtattaactataactcattctgggtttttttcccacaagtattgtggatatttaaaattttatcatatgggtcagatattagatgtaaaatgcataaaaccacactcaaaagttcaagtgagtgctgataaaatgcatcatgttagattctcagtatgattcttccactttgaaaaggtggagaaaatagacactgtggtgagggacaggacaaaagaattgtaattacacagaatcatgttctaaaaattatatttatatggtggtttattgtttcaaaatgcttttaccttcattacctcatttcaggatttcaatagcactgtaaggtaggtggggcagatagtgtctttgtttattgaggaagaaatagaatgtcagaaaggttgagtattatgtctgaatttacacacaatgcctgatagaactggtacttgaaccttattctcttgatctccagtgtaatatgctctccattatgtcttactgcctaattgaaacttgagtttacatccactgtaagacgtagaattaactcaataaattatcttatgcattatattttcagagaagttatcagcctctgaagcaagggacacatcaccattttgtatttttcttctgaatttgattcttcccaagcacttatgaatgtgccatcttatttacctgatgctattattgacacccaggaagtcactgctactggttctttctctctctaatggtggtaatcaggcaggcaatgaacagtctgtcaccttttatatggtctactcaaatctattcccagttgttctttctagcctaatgccatagttgtattctagataccttatatcttttaaaaattgagatataattcgtatgccataagatatagcattttaaagtctacatttcagtgatttttagtatatttacaaggttgtatagcaatcactactatctaatgccagaacattttcatcaatccaaaaagaaacttcagactcacttacagtcactcctattcttcccttctccactcccaaggcaacctattgtctttttctatggatttgcctatgctggacatttcatataaatgggatcatataatgggaccttttgtgtctcccttctttcactaaacataatgttttcaaggttcatctatatcatgtatttcttccttttgatggctgcataatattcaattgcatggatatatatcatatttggtttattcatctactgatggacatttgggttgtttctactttttggctgttataaagaatgcaggtatgaacgtttgtgtttaagtttttgtatgaacatgtatatttttaattatcctaggtatatacctaagaagtagaattattgggtcatatgataattctatgtttaacttttgaagaactgtcaaactgtttccacagtggctacaccactatgtttccaccagcaatgcagaaagaccttatattaattttttttttttaagagacagtgtcttgctctgtcatccacatggaatacagtcgtacaatcatagctcagtgtaattttgaacttctgggctcaaatgatccacctcagcctcatgagtagctgggactacagttttatgccatgacgctaggctaattttaaaattttttgtagagacaagatctcactaggttcccaggctggtcttaaactcctggcctcaaatgatcccccccaccctggcttcccaaagtgctgggtttatagacgtgagccactgtgctcggctcgtaccttacattttttgagtggacaattcatctccaagccccacccccttcccccccccaaaaaaaaaacgggggtttcttttggagatagtcttgccgtgttccccaggctggagtgcagtgccacagtctcagctcactgcaacctctgcctcctgtgttcaagcgattcttgtgccttagcctcccaaatagctgattacaatcatgtgccaccacacccagctaattttgtatttttagtacagacagggtttcgccatgttggccaggctagtcttgaacacctggcctcaagtgatctgtccgccttggcttcccaaagtgtggaattacaggcatgagccaccacacccagcctccaagcctattttttatttcattttctgcctctatctgaaatatacttcctcttctgcccacctctacccctatgtctaactacctattgaaattctgtgcatccttcaaagcctagttcaaatgttgcttcttgtgcaaagtcttcacgggttactagggctggaagtgatttctccctcattagtgcatatagttgtatcatttatttctctttgaggccttttgtaatagttgttggagtctttcttatttcttctaccacatttttgtattatcatagtgagagagagatatatatatctcaaatgcgcctttagtaaatattgagagaatgagagactactggaaatccttaacttggctttttaaaatgttacatgagacatataatatttataaaataggaatattaatatgtaaatactattttaaataaataattttataatttttccactggaatgatgtttttacctgtccttccaactggcaggtatgtatatctgcaaatatctcttaatttcttggccttacattaagctgttgtatgagcagttgcttttcaaggtcatttgacaactggttgcctgcatttatctattggatctggcatctttgtctgtagttacatgttaaagaagctgtgttacagtatagctcaatgtttttaggtctgaagttaaagattcattttgtaaaattatagtacatcattagataataaaataagttattttaactttactgtctttattaggctatatttatttggtgtccattgtgaaaattgatgaccaactagccagatatgccaaataatgtagtccagatactgtggtccttttttttataaatgtgtgatatcctagtggttaaaagcatggactctgtaggtatgtggcctgagtttgaaaccttattttttttgtttgttagctgtgtgaccttgaagaagtacttaatctttctgttcctgatgtttttctttatctacaaatatgttaatttttcctggctatacatatttgcatattacagtaatatatatagtatatatattatctgtatattatacaaattacatatatgccatacatgttatatgtatatacgtatatatgtatatgatatacattacatatattatgtaaataatatacatactacatattactcatgagtactcatgttcatatttacatatatacacatatgtacatttagcaaaataagaatcatactgttttgaatcttgtgtattttatttaattttatgaatattctcatgccattaaatatgcttcaaaaactttttttttaattttttatttcttctcacagttgagccagtggtcacaaaaacattgtttttaatgactgcatggtagtccatcatgtaaatgtacaacatgtatttcccaaattctgtattataatttttcctcatttttggaatttcagttaatgctgcagtgaacatccttgcacactaatttttgtctggctttcagaaaattttttagtgagctttttaaggtattttgatacacgtttccaaattgcttcccagaagggttgtatatattttatttaagaaaatacattttgaattaattttatttgaaattggagggttacatgtttatttttgtaagttgatttttgcttataccattcattcatttcaacaagtatgtattaaattcatactatgtgccaggtattcgtaggcccaacgtatagcactgtaaacaaagtacagtttttaacctcatggagtgttcctgtctaaaggtctccaggtatcagtgggttagtttttattttccctcatttcagagtcagaattgaataaattatttagaaaagaggaaaacttttctcttaatgacctatctatgctatcaagtttgttgttgttgttgttgttgttgttgtttgttctattctatctagtctatatggattttctcagggttatgttcatgtacttgtttcaataaaaagtaaatgctttttttttttttgagatggagtttttgctgtgttgcccaggctagagtacaatggcacgatctcggctcacagcaacctgcgtcttctcctgggttcaagcaattctgcctcagtctcctgagtagctgggattacaggcaccacctcaccacgcccggctaatttttatatttttagtagagatgaggtttcaccatgttggccaggatggtctcaaactcttgaccccaggtaatccccctgcctcagccttccaaagtgctaggattacaggtgtgagccactgcgcccagcccctgcttttcttttttcagtattaatttttttttttaatagatatggggtttcaccttgttgcccaggctggtgtcaaactcctgagctcaagcgatctgcctgtctggccctcccaaactgctaggatcacaggcgtgggccactgtgactggccttaatattgcttttcatgctctgtattagtcacagaatatacaatgctcttgaggaaacttcagtgtatgtgtgttatacctgtagtcatgtctgaaggtaaacagtcacaatgtccttcaaagtccattcccatactcccttgtttctataataatttttctgcttatatttaagttctaattaagaagtcatattaccttaaattgtagttattctaatcatattgatatcagtttcatggatattgcatctttatttcattaacaggttgaatcatttattttggaccaagaagatctggataacccagtgcttaaaacaacatcagagatattcttatcaagtactgcagaaggagcagacttacgcactgtggatccagagacacaggcacgactagaagcattgctagaagcagcaggtactttattttttgttttatctttttcatatctttaaaagtctagatctctttacagttacatgagattatccccaaattctataacattatacaaaatttaaaatctctaaaatttattttactttttatctcccaaagaaaatgttcacattttgtatttctgggctcaactcatatatttttaaggtattaagataatgagcgtccaggcgcagtggctcacgcctgtaatcccagcactttgggaggctgaggcaggcggattgcctgagctcggagttcaagaccaacctgggcaacatgatgaaaccctgtctctactaaaatagaaaaaaattagccaggtatggcggtgtgcgcctgtagtcccagctactcaggcagctgaggcaggagaattgcttgaaccctagagggggaggtttcagtgagccgagatcatgccatagcactccatcctgggcaacagagcgagactccgtctgaaaaaaaaaaaaaaaagataatcagctagttatcaaggaaaacttacctgttagccattataaaataaaaatgtgggagataaatttagttaatcagtttatgacttctttatctgtactgatttagggagctgcatgttgattacttgtgtattcactttaatctatgtttaacttgattttaaatagctaatttttttatatgtaatgcatattataaaatagctaaagcaatgtgaaatatattaagtagataacaaaaccttcccgttttctgtcaaggtttacatatacttctagacttttccccttatgataatataaatacatgtatatgtttgaacatacatgattgttataaatgaagtaggaataatacacaaaatacaatttttttccccatataatttattgtgggtatccttccatgacagtttatgttgatctttctccttttattgaagggtaccataatattctgttgcttggatgaaccataattaatttttccaattttagcttatatccagtttttcagtatcacaaataatgttatagtttatagccttatatatctgtaacttttcttacttgtgcaagtatctctttaggacagatttttagaaagtattatcaatgggtaagaatacatttgcatttaaaattttagcaactggctgggcgccatggctcatgcctgtaatcccagcacttcgggaggccgaggcaggtggatcacttgaggtcaggacttcgagaccagcctggcccacatggtgaaacctcgtctttactaaaaaaaatacaaaaattaactgggcgtggcggcgcacccctgtaatcccagctactcgagaggctgaggcaggagaatcgcttgaacccagaaggcggaggttgcagtgagttgggattgtgccactgcacttcagtctgggtgacagagcaagactccgtctcaaaaaaataagtaaaataaaattttgacaactattattaaattagtccctcaagtttgtgcctgtatttatttctttattcactcaaaaatcaacaatttttgagagggcctcacacctcagacattgttttgtcaatttcataaatgaaaaatacctcaccattttagtttgcattcatgttatatcattagtagattgtgtggtagctctttataaatgacgatataaattcattgggtattgtgtatataattttttaattttaattttatttgtaagaatgaatttaatttaaaatgttgccccagaagatggttgtgaccaaaggaagaaacaattgaattgtttgttacagtattacagactgtctcccctctgaagatactactgaaaatagtaaagacagatatcctgtactagagatcttatggtgtgactatgtattttgaaagaaatctcatttatttgatagacagcctcatatgaagttacatgtggattaggtagaggacaaattaatattatgtgcattgtaaaggtagaaagactaaaacataggtggttatgccatggccttttgacattagtggcagaattgaattgataagccttatcttctgtcaacctaacctatggattctataccatttctttttcctagataatagtgtttagaaatataattacaatttgcacttttatacttttttttttgttgttctgcactacctgattgattgatgcacactgaaggaattggcaaattgtcaactgctgatggtaaagcttttgcagatcctgaggtactccggagactgacatcctcagttagttgtgcactggatgaagctgctgctgcactgacacggatgaaagcagaaaacagccacaatgcaggacaagtggacacgtatgtgtttaatgacttttggatattagacattttcttgaatagattttggggaagtagccaattttggttaaatatatcttttggtggagcttataaactttagctgaaaggatattacattttaagtggatatataaatgtatatgtattatgtagctatacaaatggatatttttgtttcttcattcagctcttattcgttgagcattcttgtggaatgtattacactagagtctctgagaaatccaaactgaataagatctgttttccagttataaggaagttacttattctaaaagttattatagtaaactctaaaccgagtgcttgagtactaatacatgaaacgagttactaatgcagtagtgtagttgcttgctactcaaatatggtccatggactggcagtatcagcatcacctcagagcttgtgagaaatgcagaatcccgggccctactccatatctactgaatcagaatctgcattttaacaagaaatacgagtaactcgtacacattaaagtttgagactcggtggtctagttagtcattctgtggtaaaatagttttcttaggttttcgccttcactgttactaagtaaaaatttcagccataggattatatcccaaaatatctttgggaatcattatacaagtagagtttaaaaacttgtgcatctaatacaggggtgtccaaattttgggttccctggtctacattggaagaagaagaattgtcttgggccacacataaaatacaaacactagaggccaggcatggtggctcatgtttgtaaccaagcactttgggaggccaaggtaggtggatcacttcaggccaggagttcaagaccagcctggacaacatggtgaaaacgcatctctcctaaaaatacaaaaattagccagctgtggtggcacacatctgtaatcccagctacttgagaggctaagacacaagaatcacttgaacctgggaggtggaggttgcagtgagccaagattgtgccactgcattccagcctgggcaacagagtgagactctgtctcaaaaccaaaacaaaacaaaatacaaacactaatgatagctgatgagcgaaaagaaaaaaaaaaattgcaaaaaaatttcataatgttttaagaaagtttacaaaaatttgtgttgggttgctttcaaagctgtcctgggccgtgggttggacatgcttggtctaatgctttaaaaaactttatttaaaatttgttgtaatatgttaggagattttaaaagataaaaatgacagctggtttcaaattcactcactggctttctggcttggttgataaacatgaataattgaagttgcagacaaaatgctcagcaagtaatatgttcatataattttttcttttactgcattaacatttttctttgtgtgactatttatatttaatataatttatcataggacccccgagtctttttgtttcggttaattgttgaatggttttgtttccagtcgcagtctagcagaagcttgttcagatggggatgttaatgctgttcgtaaattgctagatgaaggcagaagtgtaaatgaacatacagaagaaggagaaagcctgctgtgtttggcttgttcagcagggtattatgaattagcacaagtaagcagaaataatctttagtgattaaaattgtggaagggttttgatgttttatttatttttgtcacttataagatagattataattagaggccagagtcttctcttcccccatcctccttccctttttggtagtgggtaaagtagaaacagataacacagtttattttgttgccggtacatgtaactgagaatgatccatttttctgccacttactcaaagctaatcctaatgaataagaaacaaatagatataataataattttaaatttgtcctttgaaataatatacagctataatggaaagtagtcattattttcatcacattcaggttaccccaattcttttaatttttttccttctatgttagaacagtactgggaattaaccatgtttttaccagtttctgtcttgtgagtatagttttgctgttctttggctagataacctcaagcataacattctttgacaagagccatcacattttataataggatggctaatatgattgcatactttatttaaatattaatatgtaatgatattgtaaaatatgtaacctggcatgttaagcagtgagtattggcataattttttcaaaaggtcattattgattttttcccacccctattctagaagaatatcttcagagattcagtatattctctagaaatactattgaatagtaagaattaacaatttctctgtctgtatatgtgttttaaaggtattgcttgctatgcatgctaatgttgaagatcgagggaataaaggagacataactcccctgatggcagcttccagtggaggttacttagatattgtgaaattattacttcttcatgatgctgatgtcaactcccagtctgcaacaggtatgtagaaaatgatgtattaattgggagaaaaaattgacataattattacctgagagagagaaaaattagatttctgaggaaaaccagtataaacctacagaaaaatcttagcccttgtgtagaatctttgagtaaaatacaaattaatttgacatcctcaaaagtctttaaaacacacttagagtctcctgtagtcaagactgagtttttgtggtatgaacataatggaatattattcagacttaaaaaaggaggagatcctgccatttgccacaacatggatggacctgaaggacattatgctaagtggaataagccagacacagaaaggaaagtattgcatgatctcacttttttttttcccccacagtcttatggacataggtatgcatgatctcactgaatattgaaaatttacaaaaagcgttaaatatatagagataagacattggttaccgggtcaggggtggggagaagaaatcggagaagtaggtaaaaggatacaaagtagcaaatatgtagaatgaacaagtcaaaaagcttgatgtataacatgaggactataattaataatagtgtattatattcaggattttttgctaaatgagtagattatgctgctcttgccacagggggcaaaattgggtaactatatgagaaaaatatgttaatttgttctatagtaaccattttactatatatgtatcttataacaacatgtcatataccttatgtatgtaatatatatggaggcaaaattataaactgtatttcttataattctttatcttcaatacaatactctttagattatagataaacctgagtgtttaccctatagggttttacatgttgagtttgctgaatacatttactaataagatattcttttttttttttttttttttttttgagatggagtctcactctgtcacccaggctggagtgcagtggcacgatcttggctcactgcaacctccacctcccaggttcaagagattctcttgcctcagtttcccaagtagctgggattacaggcgagtaccaccactcccggctaattttttgtacttttttagtagagacgggggtttcaccatgttggccaggctggtcttgaactcctgatctcatgtgatctgcccgcctcagcctcccaaagtgctgggattacagatgtgagccaccaagcctggctgagatattcttgtatagcaacagtccccaacctttttgacaccagagacaattggaagacaatttttccacacgtgggggagggaggaggggatgttttcgggatgaaactgtttcacctcagatagtcagttgtctcataggagtgtgcagcctaaatccctcgcccgtcatttatttgaactgagcagctttgtgcatactatagttggaacccttgaaagtggctccctgtattaattaaatacagaaaatatctcttatatttacataaaagaagacagttaatgttagagtgtgttggtgaaccaccagattgatttacttaattttttatctgattatgaaaataatatatgctcattgtaagaacatttcagaaatgctgagaagtaggaagaataaaagattactctcccataaactctgtggcacagaaatcactgctattactgtgttagtttagttccttccagtatttttgatgtataaaattatgtagttgaaattataccctatgtgcaattttgtttgacttcacttattttctattttattaactttttttttgttttttttttgagatggagtctcgcactgttgcccagactggagtgcagtggtgcgatctcagctcactgcaagctctgccttccaggttcacgccattctcctgcctcagcctccctagtagctgggactacaggtgcccgccaccacgcctggctaattttttgtatttttagtagagacggggtttcaccgtgttagccaggatggtctcgatctcgaccttgtgatccacccacctcggcctcccaaagtgctgggattataggcgtgagccatcgctccaggcctattttattaacttcttaacaaacttttttaaaggttgtgtaatatttccttgaattgatataccacaaattttaggggcagagggcattaattggttgtgaactatagcaaaagttgttaaattaagatgataaaatcaattgctttgttctggttaacagcattatgctatatacacactcctttgaaaaatacccaaaaaaaaggccgggcgtggtggctcacgcctgtaatcccagcactttgggaggctgaggtgggaggatcacgaggtcaggagatcgagactatcctggctaacacggtgaaaccccgtctctactaaaaatgcaaaaaaattagctaggcatggtggcaggcgcctgtagtcccagctactcgggaggctgaggcaggagaatggcatgaacccaggaggcggagcttgcagtgagccgagatcgtgtcgcctgggcgacagagcgagactccgtctataaaaaaaaaaaaaaaagaaaaatactcaaaaaagagggtactgccaacaaggaagttttaaatttccccttgaggattcttggtgatcatcaaattcagtggtttttaaggttgttttctgtcaaataactctaactttaagccaaacagtatatggaagcacagatataatattacacagataaaagaggagttgatctaaagtagagatagttgggggctttaatttctggaacctaggtctccccatcttcttctgtgctgaggaacttcttggaagcggggattctaaagttctttggaagacagtttgaaaaccaccatgttgttctcagtacctttatttttaaaaagtaggtgaacattttgagagagaaaagggcttggttgagatgaagtcccccccccccttttttttttttttagctgaaatagatacactatgtagaaggaagggattattatataccatgcagtaagcacatgctctttgatgggctcctccgtacactctccatgtggccatttcagacattcttctcaaaccccacagatacccctcctcgcttccactgatttccttaactcatacttcattgggaaaatagagatttccagaaggaaattgcatcatcttctcaccaataatttctagtcaagttcgtattttaattaattcgttcattttgttcagtaagttgcacctactgcctgcatgtcagaatcacttaagagagcttgttaaaaatacaggttcctagaagtcttccttctgtactccaaagcagtcagtctcaggagagaccagggatcataaaccatagctctgtattgcagctctgtgaggggatgtggtcacctgcctttacttaatgcattttgtttgatgccagatgtccttttctgcctttaggaatcctacttaacttttgaggcccagtccaaatgtagctgctgctgctttttaaaaaaacaaacaaaaaatcccagttttattgagatataattcatataccataaaattcacttgatttaagtatacaataatgatttttagtaaatttatagagttgtacaatctaattgtagaatattcccatcaccacagaaagatctctatgcccatttggagtcccctcagttattcagacaactgttactctactttctgtctctatagatttgcttttctggcctttttatattgttcagatctttataacatatagtcttttgtattgggctttccagaaagtcttttgtattgggctgaagtgatcctcccacctcttgcctctagaggagcagggactacaggggtatgccaccattcctggctcagtttttttttagtagagatactgtgttgttcaggctggtctcaaactccttggtctcaaactccctgggttcaagcaatcctcccaccttggcctcccaaagtgctgggattacaggtgtgagccatcgcacctggccagaaaatctcttaattagtaggaaaattggccgggcgtggtataattggcataattggtataattggcataattgtcagattacgcctgtaatcccagcactttgggaggccgaggcgggtggattacctgacgtcaggagtttgagaccagcctgccaacatggtgaaaccctgtctctcctaaaaatacaaaattagtggggcatggtggtgggcacctgtaatcccagctactcaggaggccgaggcaggaggatcacttaaagctgggaagcggaggtggtagtgagccaagatcgtgccattgcactccagcctgggcaacagaatgacactctgtctcaaagaaaaagaaaagaaaattaaggtgatgcttctaaccaatgataacgaaaaaaagttgagataatagttgtagtgatttgtgtaagggaattgaagaggtatacctagagcattagcataatcataattgtatctgttctgtcatgattgtatatttctttttaaatcttttatttatttttattttttaaatatatattctgctcatgtattatatttcttcttcttctttttaggaaacactgcgctaacttatgcatgtgctggaggatttgttgacattgttaaagtgctccttaatgaaggtgcaaatatagaagatcataatgaaaatggacatactcccttaatggaagcagccagtgcaggtcatgtggaagttgcaagagttcttttagatcatggtgcaggcatcaacactcattctaatgaattcaaagaaagtgctctaacacttgcttgctacaaaggtacttaatacatgtatgaatatttataatgtttttcgtaaccactttgattatttgagtattgagtatttgagtttactttatattgcttatgttttccctgtgctataaaattatctagtttataagaaattatatagaaagtctattttagtctatattgcctgtaatatagttttctagtatatgtttattattttaattcagatttattgggttaactgtgaagttaacccaactacttagcttagatttagagggtttccattatttaataacttttgttttatatgatttttccaatgtttatttaaaaaatagtacatgccaaagtaataatacacacaatactgaaaacctgaaaaacacagagtaacacaaagaaaagaaattttttgtttttgagacagaatgtcgctctgtcacccaggctggagtgcagtggcgcgaactcagcccactgcaacctctgcctcctgggctcaagtgattctcgtacctcagcctcccaagtagctgggactacaggcatgcaccaccatgcctggctaatttttgtatttttagtagagatagggtttcactatgttggccaggctggtcttgaactcctgacctcaagtgatcctcctgcctcagcctcccaagcctcccaaagtgctgggattacaggcgtgagccagcacacccagctaaagaaaagaaattttaaaatgacatgtaatgctaccatctaaagataaaaaagcatgtatacaatattttagtgtatacatttccagtttgtttttaagtatgtttatatacaaacatatatatattttaaacaaaatagttatactctaacagttttataatctacttattttacttagcagtgtatcatggacatttttcatctcaataaatattctttattttttatttttcatttattatcattgtttttttgagacggagtttcactcttgttgcccaggctggagtgcaatggtgtgatcttggctcactgcaacttccgcctcccgggttcaagtgattctcctgtctcagcctccctagtagctggtattacaggtgcatgccacatgtctggctaatttttgtatttttagtagagacagggtttcatcatattagtcagtctggtctcctgacctcaaatgatccacctgccttggcctcctaaagtgctggggttacaggcatgaaccaccgtgcctggcctattttttattatttttagagacagggttttgctctatcacccaggacggagtgcagtggcactgtcatagctcactgcagcctcaaactcctgggttcaagctatcctcctgcctcagcctcctgaatagctaggattacagactcacaccaccatacccagctaattttatttttatttttttgtagagatgggggtctcactatgttgcccaggtggctctcaacctccaggcctcaagtgatcttcctacttcagactcccaaagtgttaggattacaggtgtaagccaccatgcctggcctcaataaatattcttacaatgtaacttttgatgattatatactatttcactatttcatttaggattaaaattggttgcatatgtcacaaaatctaaattaacgatttgagcaagagagaaattcaaaggtaagccgtttagggctagtatggcagttccattgtcatcaagagctcataattctatttttctgctctgctatcctagtatgtggtttgtatccacaaggttacaataaacctaaaaccaagatgatagctaggaccccagcagttcacattctaggaaagacgttaagggcaatataaggagtgcctctcaatttagtaagctccctttaaagagtcttcctaggtgtgcggccttataactaccacttacatctcattggctacacataactgcaagaggggcagagaaacatagtcttctagtcaggtatgttgctgcccagatgaaactggagttctattattaaaaaggaattaaagaatgctgggtgcagtaactcacacctataatcccagcattttgggaggctgaggcaggaggatctcttgaggcctagatcagtcctagctactcgggcagctgaggtggacggatcccttgagccttggagtttgaggctgcagtgagctatgatcatgccactggactatagcctggccaacagagacctcgtctcttaaagtgagaaagaataagagagtggatattagatagggaactagcagtctctgccaaatacatcaaatagatgtaccataattgcctattgttggacacttaaattcttcccaggttttcactattattaaaaacactgatcacatccttgtgcagacatttttgcataacctctgattatttccttaggataaattcctggaagtggaattgctgggtcaaagggtatggacatttttaagggttttgctacatattgccaaattgccttctagaaaggttcaaccaatttatactcccaccaacaatgtttgagagtgccctttgccccaccctacaccctcaccaatactgggttttatcattctttttaatatttgctatttttgatagtaaaaacatggtgtcttgttttaatttgcatttctttaataggaaggtttaatattgttttcatcagtttaatattcacttgcatttctttgttgaattatcatttcatatctgtcacccattcttctggagtgtttgtcattttcttattgactatcaaggctttttatatattcactgtatcaagaggattggaattattttaaatggagttttctgtgcctgcttattgccacagtgggtttatggttattttaaagctgtttttctggaatatatgatgccaagatactttacttggctttctatttgatctcagtgttttgattagataaataatttatgtattttcaaccaaggtaaaagcattattgctttacttaacttgaattatgtgccttggactaattcagtctttaaagcctagataataagaccttgaaaaaagcctgtatattgctttgaatgggctttgtaaaactgttactgatttatttattgaatgcaaaataagttatcaaattcttgtatagacatctgaagaaaaagattccatacctcaatatttaaatattaaactgatagtgaattcttttaaaatttttgttccttttttcaaggccatttggatatggttcgctttctacttgaagctggtgcagatcaagagcacaaaacagatgagatgcacactgccttaatggaggcctgcatggtaattttaaattacactcacttgagattttatgggaagaaaaggtcgtatgtgtttaagcctttaagagtgattaattgccagtgcggtggctcacgcctgtaatcccagcactttgagaggccaagtcgggcggatcacatggtcaggagttcgagaccagcctggccagtatggtgaaaccctgtctctactaaaactacaaaaattagctgggtatggggcgggtgcctgtagtcccagctactcgggaggctgaggcaggagaatcgcttgaacccgggagatggaggttgcagtgagcagagattgcgcaactgcactccagcctgggcgatagagcgagactcggtctcaaaaaaaaaaaaaaaagagttattaattggtgttgggtttatataatttcttaatgctaaattaaacaaagttgatgcttgaatgcatctgcttttggaatagaacagtcaaagtatttggccttagggatattattgataaaactctaattctggagatagtagacatagttctagtgtttttacagtttcatattaaaatcttaaatagcaaattgacctcaaaatatattgactcaaactgtatggatagcctataaaacatttaactgtttttttaaaggataatgtagaatcatacttttaatatacaattctctgtgtcacagagaataatcacctttaatgctgtcaatccagaaatcctttttctacttctgtaagcacatatatatcatgcgtatatgcatatctaaaagagagtgcaaatacaaagaaactcaaagcattctgataagtatttaagacagatttaatggcaagaaaattacctggaagtgcaaacgcattttttcagatgtgattaaataagctcatcattacacatgttaatttgtattttgttgactattgctgtttagcgaatcactcaaaacataatggcttaatgtagcagccacatattacctctatctattttttttttttttttgagacagagtcttgctctgttgcccaggctggagtgcagtggtgtgatcttagctcactgcagcctacctcccaggttcaagtgattctcgtgcatcagcctcccaagtaggttcaagtgattctcgtgcctcagcttcccaagcctcccacctgtatcttatactatctcatatatcatatgattctatgggttgattgggtggtttttctattggtctctctctctctctctctttattttgaagacagactctcactctgttgcccagggtagagtgcagtggcactgtcatggctcattacagcctgtacctcctgtactcaagcagtcctctcgcctcagcttcctgagtacctgagactagaggggcacgttaccatgcctagctaacttttaaattttttgtagagacagcatctcactatgttgcctaggctttaagaaaagatttatttatttatttatttattattattattttgttggaattcccctcttaatatatgtatgcaagatatgttagcagaatctatcaaaaaaatattcaagaatttggctgggcgtggtggctcatgcctgtaatcctagcactttgagaggctgaggcgggtggatcacttgaggccaggacttcaagaccagcctggccaacatggtgaaaccccatctctactaaaatacaaaaattagccaggcgtggtagtgtgcacctgtaatcccagctacttgggaggctaagacacaagaatcacttgaacctgggaggtggaggttgcagtgagctgagatcacaccactgcactccagcctgggtgacagagtgagactctgtctcaaaaaacaaaacaaaacaaaacaaaacaaaaaacttcaaaaattcaagtaaattcaagtaaaacaatgtattgagagcctagaggagataggcacaatagcagttccttgatctgttgacatttataaatccttattttcttttcaattagaaatgcatttcaactaccagatgactcagtacagtaatttggttaaaatattttattttacatgtatttgaagtattagtaaaactgaaattttaatgtgaagtcatctgtttttggcatatatcaaaagtgattaaggctgggctagtcagttaagtataataaaagtcttgatgggtattgaaatttaacaactaaggtttctttatttaattcttttttgtttttgagacagggtctctatcattcaggctgggtgcagtggcgtgatcttggctcactgcaacctctgcctcctatgctgaagcagtccctctgccctcagcctcccaagtagctgggactacaggcgcacaccactatgcttggctaatttttgtattttttgtaggaacatggtttcaccctttccccagggtggtctcaaacatctgggctcaagctatctgtctgcctcaacttcccaaagtgctggggttacagctgtgagccactgtgcccagccttatttctttaattaaataactactaaaccttatttttctactcagtatttatttttcatttgcaacattatggtcatttttgaaatacagtacaatatagcctctgaccttatgtgtcacaacaagcattaagacctacataaagagcagtttccaagatggccaaataggaacagctccagtctacagctcccagcatgagcgacgcatgagacgggtgatttctgcatttccaactgagcatacggcacaccaggagattatatcccgcgcgtggctcaaagggtcccacacccacggagcctccctcattgctaacacagcagtctgagatcaaactgcaaggcggcagccaggctgggggaggggcacccaccattgctgaggcttaagtaggtaaacaaagcggctaggaagctcaaactgggtggagcccactgctgctcaaggaggcctacctgtctctgtagactccacctctgggggcagggcatagctgaacaaaaggcagcagaaacctctgcagacttaaatgtccctgtctgacagctttgaagagagtagttgttctccaagcacggagtttgagatctgagaatggacagactgcctcctcatgtgggtccctgacccctgagtagcctaactgggaggtaccacccagtaggggcagactgacacctcacacggccgggtatccctctgagacgaagcttccagaggaacgatcaggcaggaacatttgctattcagcaatattcactgttctgctgcctccgctgctgatacccaggcaaacggtctagagtggacctccagaaaactccagcagacctgcagctgagggtcctgactgttagaaggaaaactaacaaacagaaaggacatccacaccaaaaccccatctgtacgtcaccatcatcaaagaccaaaggtagataaaaccacaaagatggggaaaaaacagaggagaaaaactgaaaattctaaaaatcagagcaactctccccctccaaaggaacgcagctcctcaccagcaacggaacaaagctggatggagaatgactttaacgaattgagagaagaaggcttcagacaatcaaacttctctgagctaaaggaggaagttcgaacccaacacaaagaagctaaaaaccttgaaaaaagattagacaaatggctaactagaataaccagtgtagagaagtccttaaatgacctgatggagctgaagaccatggcacaagaactatgtgatgaatgcacaagcctcagtagccgattcgatcaactggaagaaagggtatcagtgattgaagatcaaatgaatgaaatgaagcgagaagtttggagaaaaaagggtaaaaagaaatgagcaaagcctccaagaaatatgggactatgtgaaaagaccaaatctacgtctgattggtgtacctgaaagtgacggggagaatggaaccaagttggaatacactctgcaggatgttatccaggagaacctccccaacctagcaaggcaggccaacattcaaattcaggaaatacagagaatgccacaaagatactccttgagaagagcagctccaggacacataattgtcagattcaccaacgttgaaatgaaggaaaaaatgttaagggcagccagtgagagaggtcgggttacccacaaagggaaacccatcagactaacagcggatctcttggcagaaactctacaagccagaagagaatggggcccaatattcaacattcttaaagaaaagaattttcaacccagaatttcatatccagccaaactaagcttcataagtgaaggggaaataaaatcctttacagacaagcaaatgctgagagattttgtcaccaccaggcctgccctaaaagagctcctgaaggaagcactaaacatggaaaggaacaactggtaccagccactgcaaaatcatgccaaattgtaaagaccatcaaggctaggaagaaactgcatcaactaacaagcaaaataaccagctaacgtcaaaatgacaggatcaaattcacacataacaatattaaccttaaatgtaaatgggctaaatgctccaattaaaagacacagactggcaaattggataaagagtcaagacccatcagtgtgctgtattcaggagacacatctcacgtgcagagacacacataggttcaaaataaagggatggagtaagacctaccaagcaaatggaaaacagaaaaaggcaggggttgcaatcctagtctctgataaaaacagactttaaaccaacaaagatcaaaagagacaaggccattacataatggtaaagggatcaattcaacaagaagagctaactatcttaaatatatatgcacccaatacaggagcacccagattcataaagcaagtccttagagacctacaaagagacttagactcccacacaataataatgggagactttaacaccccactgtcaacattagacagatcaacaagacagaaagttaacaagggatatccaggaattgaactcagctctgcaccaagcagaccgaataggcatctacagaactctccaccccaaatcaacagaatatacattcttctcagcaccacatcacacttattccaaaattgaccacatagttggaagtaaagcactcctcagcaaatgtaaaagaacagagattataacaaactgtctctcagaccacaatgcaatcaaactagaattcaggattaagaaactcactcaaaaccgctcaactacatggaaactgaacaacctgctcctgaatgactactgggcacataacgaaatgaaggcagaaataaagatgttctttgaaaccaacaagaacaaagacacaacataccagaatctctgggacacatttaaagcagtgtgtagaaggaaatttatagcactaaatgtccacaagagaaaacaggaaagatctaaaattgacaccctaacatcacaattaaaagaactagagaagtaagagcaaacacattcaaaagctagcagaaggcaagaaataactaagatcagagcagaactaaaggagatagagacacaaaaaaacccttcaaaaaaaatcaatgaatccaggagctggttttttgaaaagatcaacaaagttggtagacttctagcaagactaataaagaagaagagagaagaatcaaatagacgcaataaaaaatgataaaggggatatcaccaccgatcccacagaaatacaaactaccatcagataatattataaacacctctatgcaaataaactaggaaatctagaagaaattgataaattcctggacacatacactcttccaagactaaaccaggaagaagttgaatccctgaatagaccaagaacaggctctgaaattgaggcaataattaatagcctaccaaccaaaaaaagtccaggaccagatggattcactgctgaattctaccagaggtacaaggaggagttggtaccatcccttttgaaactattccaatcaatagaaaaagagggaatcctccctaactcattttatgaggccagcatcatcctaataccaaagcctggcagagacacaacaaaaaaagagaattttagaccaatatccctgatgaacatcaatgcaaaaatcctcaataaaatactggcaaaccaaatccagcagcacatcaaaaagcttatccaccatgatcaagtgggcttcatccctgggatgcaaggctggttcaacatatgcaaatcaataaacgtaatccagcatataaacagaaccaaagacaaaaaccacatgattatctcaatagatgcagaaaagtcctttgacaaaattcaacaacccttcatgctaaaaactctcaataaattaggtattgatgggacatatctcaaaataataagagctatctatgacaaccccacagccaatatcatactgaatgggcaaaaactggaagcattccctttgaaaagtggcacaagacaggcatgccgtctctcaccactcctattcaacatagtgttggaagttctggccagggcaatcaggaggagaaagaaataaagggtattcaattaggaaaagaggaagtcaaattgtccctgtttgcagatcacatgattgtatatttagaaaaccccatcgtctcagccaaaaatctccttaaactgaaaagcaacttcagcaaagtctcaggatacaaaatcaatgtgcaaaaatcacaagcattcttatacaccaataacagacagagagccaaatcatgagtgaactcccattcacaattgcttcaaagagaataaaatacctaggaatccaacttacaagggatgtaaaggacctcttcaaggagaactacaaaccactgctcaaggaaataaaagaggatacaaacaaatggaagaacattccatgctcatggatagggagattcaatatcgtgaaaatggccatactgcccaaagtaatttatagattcaatgccatccccatcaagctaccaatgacttccttcacagaattggaaaaaactactttaaagttcatatggaaccaaaaaagagcccacattgccaagacaatcctaagccaaaagaacaaagctggagacatcacgctacctgacttcaaactatactacaaggctacagtaaccaaaacagcatggtacttgtaccaaaacagagatatagaccaatggaacagaacagagccctcagaaataataccatgcatctacaaccatctgatcttttgacaaatctgagaaaagcaagaaatggggaaaggattccctatttaatacatggtgctgggaaaactggctagccatatgtagaaaactaaaactggatcccttccttacactttatagaaaattcaagatggattaaagacttaaatgttagacctaaaaccataaaaaccctagaagaaaacctaggcaataccattcaggacataggcttgggcaaggacttcatgtctaaaacaccaaaagcaatggcaacaaaagccaaaattgacaaatgggatctaagtaaactaaagagcttctgcacagcaaaagaaactaccatcagagggaacaggcaacctacagaatgggagaaaattttttcaatctacttatctgacaaagggcgaatatccagaatctacaatgaactcaaacaaatttacaagaaaaaaacaaccccatcaaaaagtggacaaaggatatgaacagacacttctcaaaagaagacatttatgcagccaacagacacatgaaaaaatgctcctcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtggtactgttgactagttcaaccattgtggtagacagtgtggcgattcctcaaggatctagaactagaaataccatttgacccagcaatcccattactgggtatatacccaaaggattataaatcatgctgctataaagacagatgcacacatatgtttattgcggcactattcacaatagcaaagacttggaaccaagccaaatgtccatcaatgatagactggattaagaaaatgtggcacatatacaccatggaatactatgcagccataaaaaaggatgagttcatgtcctttgtagggacatggatgaagctggaaaccatcattctcagcaaactatcacaagaacaaaaaaccagacagcgcatgttctcactcataggtgggaattgaacaatgagaacacttggacacaggaaggggaacatcacacaccagggcctgttgtggggtcgggggagcggggagggaaagcattaggagatatacccaatgtaaatgaggagttaacggatgcagcacaccaacatggcacacgtatacgtatgtaacaaacctgcatgttgtgcacatgtaccctagaacttaaagtataaaaaaaaaaagacctacataaattttgacattaaaaatttgaaattaaagaaggatatttatggtgataggtagaattgatacccaccatgagaatattttattgttaattgacttactgtctatgcagataggccatggtaaaaattttttacaatgaatgtctttatttttacatcattacaaaatctttgcctcattgcaacaaggtgttgtgattaggaaaaatataggatggtgtcaatccagagacatttatgttggtgacataatcccaagtggtaacgacttcacataatttgttgtgttattttttgccatgcctttgtttctgaaatagatgtaatacggtttctacatttgaatatgactcctgagtttgagggtatgactgtatttgacctggcagtagtataatcttgttattttgaggtagcattgactatagatttcacagttttttgaacttcaaaaaatggaaatttaaaattatttggatttgtgactgttatgtcaccaagtctcattcttttggagaattttgggcttgctcaaaagttggttaaaataatttgaaaattacttaaaagcaatattgatgaacttttgataaggctcagatgagcatgataatatatatgctgtctatgctgaatcttctaatcttgtcttttttcttcctttttccaatctcttgctttcttctctcccacttaaaaaaatctcaaaacaaaaaatttctctccttctttctttacttctgaaaatctgcaggatggacatgtagaggtggcacgtttgcttttggatagtggtgctcaagtgaacatgcctgcagattcatttgaatctccattgacgctagctgcctgtggaggacatgttgaattggcagctctacttattgaaaggggagcaaatcttgaagaagttaatgatgaaggatacactcccttgatggaagctgcccgggaaggacatgaagaaatggtggcactactcttagcacaaggtaaagcagttttacttcttttagaaaaatcagttttctttggatgttttgtgttagtactggtgaagtttactacagctagcatatatatatatatatatatatatatatatatatgcatatatatatatatgcatatatatatatatatatatatatatatatattgcattgatgataaattaccctggaggaaaccacagaagcagagaagacagagatgattatcacaattcagaaaattaatatctttattataagtctcttgcaactaattttatctgtttttatactttcctaggagcaaatataaatgcccagacagaagaaactcaagaaactgctcttactttggcttgctgtggaggattttctgaagttgcagactttcttattaaggcaggggctgatatagaacttggctgctccacacctctgatggaggcatctcaggagggacacctggaattggttaaatatttgctggcttctggtatgtggctttaagatgccttattgctcagaaagacaaatacaaataatagtttatatgtggaatctaaaaacgttgagctcctagtagataatagaatggtggttaccagagtgtgggcatgagggtgggaggagagtacacaaggagaggggaaatgttgatcaaagggtacaaagtttcacttagataggtggaataagttttaatgatatattgcatagcaaggtgactacagttaacaataatgtatatctcaaaattgctaagagtagatttaaatgttctcaccacaaatatgtgaggtgataaatatgttaattagcttgatctaatcattccacaacatatacatatatcataacatcacattgtaccccataaatatatacaattattatttgtcaattaaaaataaaattaaattaaataattaaaaatactgtttagaaaaagacttatattgctttcttaactttaacaattaactgttaactttttcatttctataaaagttgaaagacagctgcataatttaactgatcttagactcctaagtctctaaaactgatttttaaaaagatttcttactgttattaatgtttgtgtagtgaccataaggtatctcgttcaccttctttctccgtctaattgtttgtggcttgtggaagggagatgttagtttctactagtctctgttaataagaggaggtggggatgatgacattattgagaggttataatttggtacctttaagtctgttcatttcttgacatttctaagtcatctgaaaaaagtgggaattaatttatttttacagagtactaattttaaaaatatttgtgctttattattaagctgtggtaagcaataagtacttttacatagaatatttgtagttttatagaacatactaaaaaaaaaattagtcccaacagatgtaaatatattctttgaaaataatgtcagatttttcttttttaccacgtctgatatattatttaaaatttgatatatagaaaagttaatatgtaaaagaaaataaaatatttagcaaaattttattcatccttttgggctttcattgttaacattaattttaatatagcccaacctcagtttttcctttgaattattattgaaataatttgttaaaccagattttattttattctattttttgagatagggtcgtgctttgtcattcaggctggagtgtagtggtgtgaatatgttccactgcaacctcaacctcctgggctcaagtgatccttcagcctcagcctcccaggtagctgggactataggcgcataccactatgcctggctaatttttgtattttttgtagagatgggattttgccacgttcctgaggctggtctcaaactcctgggctcaagcaatccttctgccccggcctctcaaagtgctgggattacagatgtgaactaccacacccggccttaaaccagattgtgaatggtttggatgatttatggtttggacaaaccaaccataaatgctgacttttttcctgaacaaatactgataatcattctagttattgtatatattcagtcatttttcccctatcatttttagtaactgtgtcctattcaagagtctttctctgctagtggttatctttgtacattcttcccacatccctctcttaagctaaagtcgtgctattgtaacgtgtttttaaaagaaggaataaatgtttattaagaaattattgaatatcagacattttgctcagcttttgtgttatctctattaattgccactggttcctatgtagtgagaaatattaaacacattcttgtagatgagggaactaatgcacaatgatgttatataactccgtcgaaggtaaccaagctaatagggacagagtcaacattcaaacttagaactcgacattgttttttctactgcattaccattgatttagctccttttgcttatttgaagtatgtagctcgtagaaactatctcagggtttgagaatcacttttatgtgatcactacctaaaagttttttttccacccagttttaagggtaatttatttacatgaagtgcttcttacagtgtggcactaaagaaaactcaaataaggcctatacaattaaaacaaatttaacaacctttttgttatggcattttttcaaacatacagagaatgtagtatttgagatcctaagaatccatcacctagttagtgttttaacatgaatgtctaattcatggccaatcttatttcatctgtacttcttccacatccccattcttacaaaattatttttatttaaaagaaacatttttaactttttatttttaaaatttgaaaattaatgattaaaaatgttacttttataaaagtgttaatattcagtatttaaaagataattttaaaaataaccacaatacaattttcctacctaaaaaattttaatgagtttcttagcaaatatccaagccatttttgtatttctctgatagttttataaatctgtatgtatgtgtttagtgacttttttgaattaagattgaaataagattcataaaatcactattaatcaatgtctcttaagccttttttaatctatgggctacatctcatttttcttatctttcttcttgcaatttttggttgaagaaatagaatgtttttccattaggcttcccagagtatggattttcctgatgatattgctatgattttgtttaacttgtttttctatcctttggattttctataaattagtagttagatctagagactttattgtattcaggtttgattcttttttttttgttttttaatgggatacttcataggtggtatttgtatactttcttcaggaggtaataagtatatagttgtctctctttttgtgatattattagccattgatgagcattgcttagatccattaattccttaggggttacaaaggggtgatactctaagttcttttattccttctttgtttattccttccttgactatctataaagagaaactttccctcaactatttgcctgtaaattaaatacaaatcatcatataaaaatggcaagaaaggccaggcgtggtggctgtaatcccagcactttgggatgccgaggtgggcggatcacaaggtcaggagatcaagaccatcctggctaacaccgtgaaaccccatctctactaaaaaatacaaaaaattagccaggcgtggtggtggacgcctatagtcccggctactcaggaggctgaggcaggagaatggcgtgaacccgagaggcagagcttgcagtgagccgagatggtgccactgcactccagcctgggtgacagagcgagactccatctcaaaaaaaaaaaaaaagaatggcaagaaaaatgtttgtctttttttccccctttatctgccagtttccaaagtgatgaggtagtcccttagcatccttcaaaggtgatcagtgaagtgtttttttgtttggttttgttttgagacagggtctcactctgttaccctggctggaatgtagtggtgtgattgtggctcactgcaactttgaactcctgggctcaagggatcctcttgcctcagccttccaagtagctgggactacaggcatacaccactatgccccgctaatttttttttttattttttgtagaggtggggtcttgcttgttgcttaggctgatctcaaagtcttggcctcaagcagtcctctcactttgttctcccaaagcgcggagattacaggcatgagccactgtgcctggccctgtttttttgttttttatttgaacatcattttgaactttcagatttaaatatataagatggcctttacttcatcacggtcattctttgtgatgtaaaaattgtcagaagatgggacagtttgaatatctttggtcagtaaggttagctcctaaatccttttgacatgacctcattgtagtctctgatagtttccttgctttctcatatggcaaagtgttccaggctcatcttgtacagttcctgctccagccttgggatcagtcatttttctaagaagccctaatttcattatttagtaaatggtacttagagaccacaatctaagctagagatgctatttatgcttatttagtctactaccattgtctctaggctttagttggtcagggctggggaatatatatttttcttatagatcaaatatatcaggaattcattggtcaccttcgaaggatgctaagggaccacctcagtacttccaattcagaaccacaagggttttttttggttttgttttgtttttgagacagagtcttgctctgttgcccagactggagtggagtggcatgatctgggctcactgtaacctccgcctactgggctcaagcaattctcccatctcagcctcccaagtagctgggactacaggcatgtgccatcatgcctggctaatttttttgtttgtttgtttgttttggtagagacagggtttcaccacgttgcccaggctggtctcaaactcctgtgctcaagtgatctgcccgcctcagcctcagcctcccaaagtgcaagggttacaggtttgagccaccatgcctggctagaaccacaagatttttacttaagttcaagaatcttatatctcacctaaggttgggagttcaagaccagcctggccaacatggtaaaaccctatctctactaaaaatacaaaaattagccaagcgtggtggcatgtgcccgtgataccacctactcgagaggctgggccaggagacttgcctgaacccaagaggcagaggttgcagctgagtcatgccactgcactccagcctgagcgacagagtgagactatctctcaaaaaaaaaaaaaaaaacttatatctgtgttttcccttaaccatgcccaaaatttctgttctcacgaaataattgctcatttgatttataccacaatatccatagaactgtctctgaatacaaaccaaaagtaccaccaatatgatttctgaaaaatgcttaatattttttggttttgcagctcttttattccttagggtatatcttactactgatgtaagggcaaattactgtgttttaaaatcatttggtttagttctttttggtatgactcaaattatttttataaagcatatttaaaggaaaactagtatacttaaaatgcattttgatattttcacattttgaattcttcagtttcaccagattgcaaaattggactatctaatacaattttacagttcacaaagtaaatgtatgcttttttgtttgctaggcgctaatgtgcatgctacaacagcaacaggagacacagccttaacctatgcttgtgaaaatggacatacggatgttgcagatgttttacttcaagcaggggctgatttagtaagatatttttaatttcaaatatttttgcgttaatgttaatatccatttatacttaacatttagaaaacactaaagatcaatggtttgcgtactttgtatacagtaacttaaaaaagcttggctacctgttctagttgttgtatgtattaaatgtatttgaaaatacttagtgttgaacagggcatactgtttcttttcctaggtaaaactactagtttgtttcttcctttcactccacccccatttgacattcctgtgctttttaaactgccatctgttagatatatcataaattcaatgatgtgttcacagaatagagtaacaagtcaagtcactttgagtgatttattattattttaattgacacatgataattgaacatattaatggggtacagagtgatatttcaatacatgtatataatgtgtaattatcaaatcagagtaattagtacatccatcatcattttgaatgatttctgttgtttctctgattagacatttcaaaacaaagctactattgttaatcatccttctagtacattcctacaaattctattctttttgtgttttctgttttggtttttcaaaatttcaaattaggtggcaggttcatatgtgtaataatctatataaaaataatattccatttaaatgttcatgcctcttgctgaaatgtgtgctttgcctagcttttattttgtgagagtgctttaaactgcttcctagagtttttcccagaattctctgatacatttcttaaaaacttatgtgtgacatacatagctgtaaatgttatagagaattagatttcttagttttgcttatttagaaaaaactatgcaagtattaccttttaaatcatccaagtagatacctgagaacattattggaaaataattattaaccaaaataaatgtgtagtatgattgttatttattatcatttctactaatacaaaatattgtaatgaaaacactatcattcattcttattaattaggaccttccctatcagttataatttttgggaggtatgcttttttgtctgagaattgtgacagcaatatatgttaagtacatcttagtcttttgacttctttctatatctttttccttttatagagttgctttgagtcgtctataaaaattaggaattgaagtttgtcattcaaaataaagaaatagagtagaacttaaaagcttagataatataagcaaaatttaatactcttatcctctaaattcttacctggattctctcttcattgtattttctacaacaaagtcactgtcttaacctgttgggagttcttctaaaaaattgaatagggctgggtgcagtggctcatgcctgtaatcccagcactttgggatgccgaggtgggtggatcacctgaggtcaggtgttaaagaccagccggactaacttggtgaaaccctgtctctaccaaatacaaaaagttagctgggtgtggtggcacatgcctgtaatcccagctacttgggaggctgaggcagaagaatcagttgaacccaggaggtggaggttgcagtgagcctagattgcgccattgcactccagcctgggcaacaagagcaaaaacgccatctcaaaaaaaaaaaaaagaaaaaaattaaataggataaaagaggagctatctggtaaatgtactctaatgtataacaaaaccatactgattgtgaccaagttaatatctgttacatttttaaatattttatttttactgtcttctggaattagttaaaatagagtgtttattatttagttccttagaagaactacattaattgaacagatagagctatttgaacttaccgtatttacttactttcaaaatgtaagattaaaaatggcccagataggccaggcgcagtggctcacgcatgtaatcccagcactttgggagaccgaggcggacggaccacctgaggtcaggaattcgagaccagcctggccaacatggtgaaacctgtttgtactaaaaatacaaaaaaattagccgggcatggtggcgggcccctgtaatcccagatacttgggagaatcacttgaactcaggaggcggaggttgcagtgagctgagatagtgccattgcactccagcctgggcaacaagagtgaaactccatctgggagaaaaaaaaaaaaggctcagataaatacatatcttaattattcaatacagaagtaatgccattgttctaacataattattcatttttatcttgcaatctatttttacattcatatttacatgaaattatagacacaatatataatacagttgttttctattttttcactatgtgttcttgtgttctatcataatctttaccatattactatatagtctctataactcttgcatcatattccatcaagttgatgaaccatactcgttcattaattatggaacttttgcttttcatttttcactattacaaatactgttagatttaataactctatatgtataactttttaccttttcttattttgaattattttatatattgattttaagttttaaaaatgtatagcctcttccatgcttttgctatttgtggactgatatcttaattttaatattatttcttttcctcattataaaaagcaatactgttcttcatataaaatgtggaaatgctgggcttgtagtcctagctaccaaggaggcagaggtgtgaggattgcatgagcccaggagttaaaggctgcagtgcacaatgagcatgcctgtgaacagccattgtatgctagcctgggcaacatagtgagacccttctcttaaaataattttttaggagaaaaagaaaatgtggaaagtatgggaaagtataataacttttatatttaaaacctatgaatatttgtgagtaaaatttgtgacagtgaaaaaaatataaaacctatgaataaattttatttcaggctttattgtaggccagaggaaagaaaaagttctagtcaaaaacagggaaacctcagagtaaagcaggcagattagtccctgagtcctgggaaaaagtgactggtaattcttatcaactttatcttacaaggcagtaccatcttacttgtccttcattctttgctgctgtcttctaatatctgttttgggctataataatttcctccagcagtttgcagatagaggactgtccatcccccattgcatgcagtggagatgtatttcattcctggcatctcatagatatgttctcagtttaaggtttaagtgtactaattcttttttttttttttttttttttttttttttttttttttttgatgtggggtctggctctgttacccagggtggaatgcagtggcacgatctcggctcactgcaaccttctcctcctgggttcaaatgattctccttccttagcctcccgagtagctagaattacaggtatgtgctaaaatccagcctgggtgacagggcaagactccgtctcaaaaaaaaaacaaaaaaaaacaaaaaaacaaaaacgtagtttatcactgacttacctctgtaaccataaagtaagccctctgacctttgttgctttctttggactgtattctgctgactgagtgaactatattgggcattttccaaaaatagttgagcaattggaaactaggtaatttagacatgggtacattagtactctgtagttcttcttcctggaacttatttccttttaaatgagatttgatatggacctcccttaatagaaagaaaaatatcttatggatcagtttattatctgtattaaatcttataaatagaaaacatagacccaagtcctcttttataagattttttaaaaaatttaaacaatatattgtgtatctctctagacatttctgtatacccaaaatatgtacatttaatatatgtgatataacatctttccgtgttccagtagatttcccattctttttcacaggtacccagtgttctgtataatttattaaccatttatctacgcataaacacctgagttaatagtttttaaatattacaaatggtgctgcagtaaatattgctaggcatatttatgtatctttgctacttttgtgaatatatataatagggataaattcctggaagtgaaattgctggttatagggaaatatttgactaaaattttattgtttcgggaggtccacatctgaaattttgataactattgtcaaactgttcaaaaatcctgaaccagtgtacatctctgttaacagttgatccctcctgactctcccacattctcacaaatataaactgatttcttctttctcccctccttccttccctcccttctctccttctctcccaccctccttccttcttcttccttttttaaacagtttaattttctaatttctgatcacagcccctatgtttgcattatctacaaaaatcttcttgcctggcacagtagctcaagtctttaatcccagctctttgggaggccaaggagggcagattgcttgagcccaggagttcaaaccagcctgggcaacgtggtgaaaacctgtctctaccaaaaaaaaaaaaaaaaaaaaaattagccgggtgtggttgtgcgtgtctgtagtcccagctactcaggaggctgaggtggattgcttgagcccaggaagcggaggttgtagtaagctgagattgcatcactgcactccagccggggcaatagagggagaccctatctcaaaaacaaacaaacaaacaaaaaaaacttactgtgctacaattagccctattaattgctcccaaagttttagcgaactatagaaaacacaggaataaaattactttctggaagtatgtgaagacaccatttacaaatagatttttaaaaatcagatatttattcagtatctattgacttcattctgaaggacaaggagagtaatatatctttcaccatagaattttcatgagttattttaatattctcctggttatacatttacattctgatttaggaccctatttctcatagttatttaaatatatatatatgtgtatatatgtatatataatatttaagtggattcagtttttacattactagtctttcttattatatagcttcatgattcctgaattcctcaacttgacttatctgttggctggctagtactggtattttgatttgaatttattctccccctcaaaaaaggagttaataggtgcttgcatattttagaataccatatgttgtatttataaatgaatgtagccatgtatgaaattattgaatcacttgttctttcccctcaaaattttaaacccactatattagtgtcttctggtactgaatattgccaaagcctgctagactattctgtattatatgtaagtgtctcctttttctgtctggattatcataaaattctttcattatacttaaacatctgatttcatcaggatgtatcttgtgttaattattctattaattttcctgagaaacagtgaatactttctgtctgaagactttaataagtcatagtctttaataagttgtcatagtatttaatttttaaaattttttttttttttagtggtgaccgtggggtgatattttcttttttttaaaggaaggtttctttctgctatgtttttgactatttatttttctattctgttaacgtccttcaagatatttaccattcatatgtatggtctccctcatctcgcttgtttgtatttgtattatgtttatgtctaatacatttctttgtccttttcttctgcattgtgtcttaagtctgtcatccaggtcactatttttttctgtatacttgtttctgctttttttttttttttttttttttcttaaaagggacagggtcttgctttatctcccaggctggagtacagtggcatgatcacaacttaatacagccttgacctctcagtctcaagcaatcctccacttcagcctcctgagtagttggaactacgggcacacactgccacaccagctaattttttatttttattttttgtagagacggggtttcatcatgttgcccaggctagtcctgaaccgctgggctcaagcgatctacccaccttagcttcccaagttactgggattacaagtatgagccaccatgactggcctgtttctacttctaaatgtggttttcatggcttcactgttactgctcccttatctgcaaagcttgggaccagaagtgttttggatattttttttggattttggaatatttgcagaatacatacccattgagcatccctaatctgaaaatccaaaatctgaaatgctccatgagcatttcttttgagtgtcatgtcagtaatcaaaaagtttcagattttggagcatttcagatttcaggtttttagattagtgatgctcaatctgtatttagtttcttctattcttccaattcactttccagtcttttgttttatcactttgttcagctatttaagtaaagattccctgttctcttcaatttatttgaaggtattggggaatatttgactaaaattttattgtttgttttgtaggaacttcttgataggttccatgttggatactttgtgcttattattcgtattttaatgggactggctatttattgaaatagggggtgaaataggggtaaggtggcagggaagaggaagtgagccttaacagttagcttcttaaaatcatgtagttgtctcaggatactgtcttgctgaatctataccataggagcatgcactttcttaggataagcacatcacataggtaggaaattggaatgacttagagtgaagccttctctaggccacatttcctttatttggagatttagttgactctggtcaatgactgaaaagcttcttatggtttcctaagttgtatccctgtctcacctttagatagtttctctctgttaagagtctagatctagagaaaatacaaacattccatttctcaagttctttgaaggttcttgttttagttgaaaagtggaagccttaagtacatttataatgaggggaaaagctatgtaactatttatcttacagtattttcctccgtcctcccaacttctgatatgcccaaatctcttgatttcattattttctttggttagatatttttaaatgttgctctgtttttgtggctttgttttttgagacaaaggcatgaatttaaataattctgcagaaatatttctacatatattaagatttatattgaagttttattggtaaaaaaccataatatcacccccttaaaaaaatttatactctgctcatgacattacagtctctacagatgagaatctttttagttgaagatcctgagttaacaaagcccaccatctgaagtatcggtcacaaggtcttcatggccaaatgtgattttcgtttttggaataagatccgtgagttcttctttttcctttcgcaggacaagcaggaggacatgaagactattttggagggcatagatccggccaagcatcaggtgagggtggcctttgatgcttgtaagctactacgtaaagaatagatgttgtaggtaaccagaactctggatatctgaattccagccaagaagttccaggaccctgctgggtgacaaaggaaatcctcttcaattgaaaaagattatgaagtcccaataaaaagagatttgtattgctggtagtttgtttccttagtcttctttctcagtgatattcctaaaaaaatctcttaggtgaaaatagattttcttattcaggtagttcttttacattctcctttattgggagagttagtataccgcagagagaaagtctcagtaataaagtcctttgcattcaactttgttcatcaaaaatctgaaactcagagtgatattaatatattggattgttttaaaaataatactcaaataaacaaaaaaattagtttagcaaaacgtttactatatagtttatgccctaatttctataaactagaagtttaaaattttcttcttaaaattgtctcctactattctgaaattggtttttaagaaggtgaatattttttcataggaaatatttcttttgaaaaaatgtgtgaatttgtgcccagtggttttaaaagtcaaataaatttaatatccattataatccaaagagatttatttaaaatcaggagcagtttttaattttaaaattattaatgaattgtgattagatcacaaataacttaggccatctaagtttctttttttttttttttttgagacagagtctcgccctgttgcccaggctggagtgcagtggtgctgcaatcttggctccctgcagcctctgcctcctgggttcaagcgattatcctgccccagcctcccaagtaactgggattacaggcgcgtgccaccgtgcctacctaattttttgcatctttagtagagacggggtttcaccatgttggctgggctggtctcgaactcctgaccttgtgatctacccgcctcggcctcctaaagtgctgggattacaggcgtgagtcaccgtgcctggcctaagtttcttaattctaaacccctcttaatcatgatgcttattaagtgtcttcatcattggcttgttaaatgagaagctgttttatttattctgttgagatttttaaaaattttttaaattttttttttttgagacagggtctcactctgttgctcaggctggaatgcagtggtgtgctcttggctcactgcagccttcccatcccaggctcaagtgatcttcctgcctcagcctccccagtagctgggactagaggcatgtgccaccatgcccaactaatttttttcatttttatagagatgaggtctcactgtactgtccaggctggatatatttattctactttgaagtaagtaagtttattttacaaaatgtgatgtgaacatgtgagcttctactcagtttgtataatattataggctcctatcaagaatgtaaagctgagtgttatttcagatcaaagtaattgtttttccctggatttgttagatgaaatgtaattgtaaatctttctctctagctgcaagtctcaaaacaggatttttttaaaaatgagttttgcagccccacgtttacaggttcagattccatagatctgaaatagggggtctgcatttgaactaatatctcaggagattctgatgacaagttctccatattttacactttgagacattggtagaggccatacagattattctgcatcattgctgagttcttttctttttccatctttgctttataatcgatcatttttcctccatccaaattgaataaacttggtttttctctctgttacttgtgatttttagaaaatgtgctaaacacaagccttaggaccagtgcctcttaaccttttatccatatcagttctcctgaggggtatgaatccaatcagtaatagtagatcactaaggtaatgattaatatacagtggtgggttgaaggaacatactccccatggaagagtattggaatcctctagtacgtacagtatcaaacagtctccctccttttctctgtgattttggtctttctccttagagaatgtcctccctccaactccaaaagacattgcctctgtggtatagttacagtccttaaatatatgtcttgggtgccctgtggctgtgattttttaagggaaattaacttattttaaataaaataaacttaatttaaaataaaattttgttatctaaagccaaatagaaaaaattccacattttttcttacagtgctcattcatcagaaccttttttttttcttctttttttttttttttttggagatggtctcactttgtcgctcaggctagagtacaaaagcgtgattatagctcactgcagctttgaactcctgggctcatggcatcccctttcctcagcctcctgagtagctaggactacaggtatgcaccacaatgcctggctaatttttaaattttttttcagagacaaagtcttgctatcttgcccagacttgtagtgtattttttatagatatatttttagggagcttatgagctctagtaatctacttatcaatgtatttcaactgttagtaattaccttaccttaataaactttaaatgtgaccttaccttccactttttaacttttttattaaggaatagcgtatatacatatttttaactttactacttaaaactaggaaacttctgtcaatttcttaaaaatctaaaactacctatggaatacacaaaactcctaatacatttcttttaaagccaagttctctctttctatgttattgtgtattgaatgagttcttttcagctctctccaggttgtttaaatataagtacaaatgacttcagtcaagaaggtaaagtcattattagtatatagaaaaatgaatctaaaaatatgtagtcgtgccccaaaacaacaggattaaagatctccgtggactagaagtgcagcatggatccacagtttaagctgtagtcccaaggagaattaagggctaaaaaaatacacaatgggggctgagatttcagcatgtgcagaggaatagggaatgaatgcatttcacatgtagtacatcagtagatctagtctacttgaataaagcaaggaaccggcatcttattgccctacctgtgaaccaaaatggataaaaaaatatttgatcaactatctagggttatggttagaaattagcaaattgtcatatccaggttgtatgtaaaaaacaaaacaaaacaaacccaaaaaaactaaaaaaaaggggggaaaaattagcaaattgtcgttaatggaagaaacagagacaactgtgtaactaaaaacttggaggacaaccttcttgatttagggaacagaagtgaaatatctctatgagacaagaaccttaggtgtccagcaaaatatctacttctgaaatggactccaagagccagactgagggaacttccaaaacatctgatgaggagtacatctgtggatggaaaagaaactaaaacaaaacacctcccatcaaaatgagtttcctcagtaaaaaaattataaagctggagagcgaatctttatcaagaaagatagtcaaaatgtaaacaaacaaaaagcaaaatataatacactcaaggaaattgaaataaactttaatcttgagaattatgaacatgtttattttaaactatgaccagtagccataaaacaatgtgagataataaagcaaaagctgataattacgtattaagaacaggtggatataaaataaaactaaaagttttggggggtaacctcaatatatagggtaagacagcatattagacacagttgaatgcattagtgaatgagtgataaaacaagaaataatacaataaaatatataatgaaatatagtaaagagatagaaaatatgaaaaagaaattgagagaaagagaatagattagaagctccaccatattatctactagaagttcctgaaggagaggatagaaatggaggggagaggaaatgtttgaagagaatggtggagaattttctagcattgtgactagacatgaatccttgactgaagaatcatatccatcactaagcagaacagatgaaactgtggaactttaaggataatgaaaaatgtcttaaaagctatcagaggaaaaaaacgcattacctacaaaaaaacaaccatcaaagttttgaccttctcatcagcaataataaattacagaagatgatgggaagtaatatcctcaaaataccaagataaaataacaatacagaattctgtacttaagtaccattctagagaaggaaaaaataaacatattttcaaatctacaaagaataaacgaattaccatcattagacccttgacaaaagaactactaaaagatatatacatcagtaagaagaaaagtgagtcctggaggaaggcgtgggatacaagaaactacggtaagcaaagaaattgataaaacatattataaatacaaatgtttgagtttaaaaacctaaattttaatgtttaaaaccaaagtagtactaaaattctagaaaacaatagcaggaaatcagaaggatgtgttagagagtttaaaagccacgctagagtcttttgttgttgttcaggaggagaaggtactgaataaagtttttttttaaagaaaaatagaatcgtaatcagaacaaatataaagctattacactcaattgttaaagggcagagacttctgaattagagtcagaatcaaaatgtaacaaatgctgtttgcaggagacaaacctaaagcaaagtgatgaggaaagcttgacagtgatgggaaaaaattatgtaaagcaatattaatatcagacaaaatggaattttaagccaaaagcacttttagaaatgaatactcctccaactgagaaaataattaccaatcagtaactaacaatctaccatccaaataaaatataaaactgcaaaattgcaagagaaatggtcagatctgcatttgtagtggtaggatttttttcacacacttctcaatgaaactgatgaatcaaacataaaatgattgttaaaaatcaaacaattttttatctttcataaagctagcattctgtttccagtaaatatactttatattcttttccaatacatggaatatttataaaaattgtccatgttttaggccacagagaagtccgaagaaactcctgaatcttcatcacatggactacattctctgatctctcttgccttaaaattacacatcaacaataaagtcttctttaattccatacatttagaaattgaaggaaaatactttttctttttgttttgagacggagtctcactctgtcaccaggctggagtgcagtggtgccatcttagctcactgcaacctccacccaccgggttcaagaaattctcctgcctcagcctcccaagtagctgggattacaggcacctgcctccgcgcctgggtaatttttgtatttttagtagagatggggtttcaccatgttgggcaggctggtcttgaactcgtgaccttgtgatccacccgcctcggcctcccaaagtgctgggattacaggcatgagccgccgcgccaagccaggaaaatacttttataaaattcatggggttaagaggcaatacagtaaaaattacacggtagaaactgagttaccagtgcacaccaaaacttgggtagggagaatatacctaaagttgtccttagaaggaaaattgtagttctgtatatcaacatattaaagatgaaaataaaatttaaaacaatagcacaaaggaagaagaaaataataaaagcaggagaacaccttgttctatcatatatggtattctgtggtacatgatattctatggtatagaatgagatgttgcccaaatgtagggaaaaaatataaaagcaaaagttaacacaatagaaaataattttaaaaagagatacaaaaaatatagggatgaagagtgaaattaaaagctggtttttaaaaaaagactaccaaaacagataaaacaagcaagcaaggcttttctttctttttctttttttttttttttaggggaaaaggcacagataacaataaacttaaaagtgaattgtaattattttataagtagagatcttaaaattcaatcaataaatgtgaatgctcaggtgaaatgaatactaatttttgctagaaatatataaattatcaaaattgactctagaataggaaaccatgtattacaaattgaatcagtagtttacccatatatagaaggtaaaggttcaaatggatttatgggtgaattttaccaaatgttcagggtttttgggtttttttgtttgtttgtttttgagacagaatttcgctcttgttgcccaggctggagtgcaatggtgcagtcttggctcactgcaacattcacctccaaggttcaagcgattctcctgcctcagcctcccgagtagctgggattacaggcatgcaccaccttgcccagctaattttgtatttttagtagagatagggtttctccatgttggtcaggctggtctggaactcctgacctcaggtgatccgcctgcctcggcctcctaaagtgctgggattaaaggcatgagccactgagcctggccaagaaatagatactttctttctttatttttattttatttattttttttaatttttatttatttatttatttttaagatggagtcttgctctgtcacccaggctggagtgcagtggcacgatcttggctcgctgcaagctccgccttctgggttcatgccattctcctgcctcagcctcctgagtaatgggactacaggcacccgccaccacgcccggctaattttgtttttttttgtattttacggggtttcaccatgttagcttggatggtctcaatctcctgacctcatgatcccccccgcctcggcctcccaaagtgctgggattacaggcattagccaccatgcccagccgaaatggatgctttctatattattctagctgttctcaagaacagaaaaagaaacattaaactgcatgatatttaagtttgtagccttggaaaataattttctgcgtttatgaagggaaaaaaatcagaaacaatttgtatcctaaaattttattagtattgaacaaatagtggctatatgactaaatccaatgctcataagtagtacgatgtatacaaatttgattaccattatatacatatatgcattgattcccatgatatgcacacatatatgtatatacatacattatacatatatattcccattattgattcccattatatacatatatgtgttcccattatatgtatgtattcctgttatacatgtatattcccattatatacatacatatgtatatatacattgattcccattatatacatacataggtatatatatatacttatatatatacctatgtatgtatatgcgtatatatgtgtgtgtgtatataatgggaatcaatgggaatatatgtgtgtaatgtatatatgtatgtatataatgggaaccaataatgggaatatatatgtataatgtatgtatataatgggaatcaatgtactcctatatatatacatacatatatatgtatataatggggattttccatatatacatatatagatatattattatttttttcttttttctgcttcttgcacagcagggctaacccatagggagtgtgcccacagtagcctgattcccattttaaaagaaagatttagtagtcagatattttggggcaaatattgtgtgttgtgggatatacattattcattttaagacacaaaatgttgtaatacagagttgtggcattgttttatcaacttttttcaaatgtgattatgttattcaaaactaagggaatgaatgtatatttatagagaggaaaataaaataggtagcttttcaccccttttatttcaggaattaatatgttgaattttgaaatgacttggtgtgaggatattgggactgtactttctgatttcttgtcttttaacaactatggtaatattttaaatatacagaattaacagttattttttaaagtttattctaaatcagggctgaaagctttgaaatcatttttcatgatttcatttgaaatgtctttgccatgactcacgggacctaattatgttgatatgacctaattatgttgatcactgccaggcttaagaaataagaaagagaaaagggtaaagtaaggataagtgacattaatattgcccaactatgttctaataataacatatcagttgcagataatcaatgtcttactctcgggcttaactactactcttaatttcttgtttagttgactttcctttctcttatttacctagtagaaaataataaaaacttcaaacctcagtgctatgagagggaagatttgcaagttcagttatgcttggtttcctgcatgattaaacaatatttaatcactccattgtttaagcattatgtgtacagtggcaagcaaaaaaagacaagatcattcctctcatggagcttaccgtttagtggaggagacaggttagttaaatataatacttacacagactaaaatatgattgcagtttatgaaggagagcttcatagagatgtatgtccataataggaagagtgatttagtcaggaagttcagggaggtcttccttgaggaaataacacttgacttgagatgtaaaggatgaaaatgagttagtggaggaaaagcattaaaaagaagagagaccagtatgtgcaaaaaagttgtgaggcaggaagggaaaaaacaagttgctaaatgggcaatttatttccaggatgtagttgattgtaatgataattcagaaataagttggatagaaaaactggacaaacaactttctaggtctttccaagtaaggtctttgtgatacatattcagttttatttgaagtaaattgccagaatgttagatttacctaaatttgaatgtgagttcaagatctattctaaagccaaattattttggcattatctatagttattcatttttccataatctagagttaaaagattcttatttaattaacatgtataacaattaaaaagtcaaagcataaagtagtttttaaagtaggtttaatgatactacactgtcaagatttttttttaaacctattttagggaggaattcctatcacttttctgtgaggtttccattgagttgacagtctactcatttcttattgttgttttgcctgagttgtagatcagaataattaaaatgtaaatagactaaattgtattctattgggagagcacatattttaaattgatcatgtggtaattataggattttcagagttaattagaagaatatagctgaaataaagccttaacgtaaccaccagtctttatcagttttttcttagtaataaaagagaaccagaacaacagaaattcgtgtttgcatatataatgaaagaggggataggtaagagaacttttcaaagaagcagtatataagctacattttaatacttagatgaatttaatgagttcataattcttccaacagacagtattactcaccatataagcaagctccttttagtggcatttgatgtgaggcatgcatggttaaaaactgttttatcattcattcctcttgctggcaaacttcctagaaagaacaatctttctgctattaggagttgtatcttttgcctttgactattcaagtatttaatttctacttaaaaaaaaactacccattggtatatttttcttcttcatttttccgttactcctaaaataccatagtgtttttcttcagggaatcatttgcatcctttgatagtgcttttattggcttctgctataagatcaagattcttctaatcatttcacaggactgaggttcctttttcacaatccagataaatagttgggaaacattttttaaaacttagaattagaaaaatgcagtgatttctctttgggaaccaaacaaaacattaatattatctttaatggttattacttggtatgcaaaactgaacttgcccttagaaagttacattatctactttggactgaaaatcctgtataatgggggaattgaggtaggtggtataaagtgtctacaatgagtaagtatattaaatcctcgttatttctcatttcatcagtactgtttttaaaatagatggttagactgttggcattgatggattattttttccatttctttaacaggaacatgaatctgaaggtggaagaacacctttgatgaaagctgcaagagctggtcatttgtgcactgtgcagtttcttattagcaaaggtaaagaaagggcaagtgatcatttccaagaggctacagtttatggaaaaaaaaatcctaaactgttgcaatttatgttatggctactttacctacagtaaagtattgtattcttgccttttgttattatattttatttagtaagcatagagtttgtgagttgtttactgggaattttctttattagttttgaattttaagttttcatcaacaaagcaacatgtggttgctcccaacttagaaaagccaaatgtaaaatgtcccactatgattaggtggatatgcaacagctaatgatgagtctattctgctggagatgtgggtggaggacagagagtaagtctgctactgtggtacttgtttgtggtacagttgaattaactgagtttgtaagggtcttatttataatttttatatgtctttagaaattctattattagaattatatttaggcaagaaatttcaactggtgaatgaagaattagcttaagactgtttactgcagtaaaataaaatgctgtagaaccaatgttaggtttaaccgtatataattgtcatgttatgaatcaaaaatggtaatgtcagcagtttcatttggttcagcctaactctttgtatagtgtcagaaatactgtggcatataatgaaacatcctaggataggatggtcaaaatacaaggaagattctctcaggttgtgttatgttattaagataaaaactatatttatattttaatagatttctgacatttagtgacattaaaaatgcagggtaagattttatcttttttttttttttttttttttgagaaggagtttcactctttttacctaggctggagtgcaatggcgccaacttggcttactgcaacctccgcctcccgggttcaagtgattctcttgcctcagcctcccgactagctgggattacaggcatgcaccaccatgcacggctaattttgtatttttagtagagacagggttttaccatggtttgccaggctggtctcaaactcctgacctcaggtgatctgcccgcctcggcctcccaaagtgctgggattacaggcatgagccactgcacctggccagattttatccttttaaatgtacttgttttcctctgaattggataaaactaggtttattttcttcatattgcatttttgctgccaagtaaggcatatctttacataatatagtctgtaaaagctgtttacctcaaccacacagaaataaatagatggataaactctggagttctcttatgtttctttactaaagagaatacctaatcatacccaacaacaacctgctaagaatataatcaggcttatcaggaataggaacacattgattatatcctttctatgtcaaataatcctgtcatctaaaataatttcatgttgctaatctcaggatgtttattgctgcgttttacctttcccaaaaggtacttttatgcaagttaggattagattcagctggatattttctgaaaattagacaaactaatagtagtggttttacccactgacttatttttctcttaaataagataggtagaattaagaaggaagaatgaatatttctatagtcttaactttctagttgagatcttttggaattgttaaaggtagctgaactaaagttattttttccaggggtcaaaaataatttatcaaaaaagaaactaagaaaagactttgcatttagacatttttcaggtcatgttatacacagctattgaacaacttgcctttcagataacatatctggataatattctgtcttctctccatatctaggtcccctgactcttaaaatacacaatatgaagaattatatatctcttaaacattgcttaaaaaaatctgttttctttactttgagacctggctatattgccactttctagtagatcaaaaatgtctttgaaacattttgagttatatacagtggtgttatttgatgcttacattaacctgtatatatttattaatcttagtcttctagattttccattttaaaagtgatattgaatgaacgaactacagcttcatgcaacattgtggatgaatctcacaaatataatattgagtgaaagaagccagacgcaaaagagtacattgtatgattccgttcatataaagttcaaaaactaaaaccagtttggaagtcagggtagtggttaccattgggaggctgggtagtgactgaaagggagcacaagatggggcttttggtatgtggataatgttctgtttcttcctctgggtgctggttacacaggtgtgtgttcattttgtgaaaaaaattcaaactatacacttaatgatttgtatatttttttgtatctacattatacttcacaaaaaatttttaaatgatattgactatgaactagcttgatgtcaacctttgctaagattgcgatttatttttcttcaaaggtgccaatgttaacagggctacagccaataatgatcatacagtagtgtcgctggcatgtgcaggaggccacctggcagttgttgagcttctcttggctcatggggctgaccctactcatcgactcaaggtagtctacttaaaaataagtaaacaggctgtgtgcggtggctcatgtctatgatcccagcactttagaaagctgaggcgggtggatcacttgagcccaggagtttgagactagtctaggcaacataaggagaccccatctctattaaaacacacacacacacacacacacacacacacgtatgtatgtgtatatatatataaataatatgtgtatagttataaaaatatgtttgatctatcttagtgcttagtatttaatactgtttaaatgagttttgattttatatgagctgctaagaaactataaagaattaattatcatggcaattctttttcaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtaaagtaaaatggagcttgtttgttaatataaatattcttcaacatgattagaagtttttgtttaaaatcagttttaagcaaaatggacttgtttttattctctgttacatattgagaaaatcatgactctaaattctttaggatttattttctttaaaggtacactgaaatttgttattgccttatttattgagaatagtggtttttaaaaaccacttaatatcaaatataaacgtaagtattctaagttgttatcttattacaactaggtttttcagggttttttatttgttttttaacaagagaatcaagagaaagctttttcttttttcttttgtttttttttttgagatggagtcttgctctgttgcccaggctggagtgcagtggcacaatctcagctcaccgcaacctccgcctcccaggctcaagcgattctcttgccttagtctcccaagtagctgggactataggtgtgcgccaccacgcccagctaattttttgtattttagtggagatggagtttcaccatgttgcccagggtggtctcaaactcctgagctcaggcgatctacctgcctcggcctcccaaagtgctggaattacaggcgtgagccacatgcccggccgagaaagcattttcttaatacctcccaaggtagtattaattatcctagagatagtgacttttgtcaaccatgaaagtataggtaacataagcgctagaagttcattaaagtaacttttaaacccaccttaaattatggagcttttactagtatattaagttggtgaaatctaaattcttttctacaaagtcattctgaaaactgctagcataccccaattgaagaaatatattacatttttgttttcttttgatccatgtagaatttgaacaagggtaaattggctagtggatagtgaatatgtgacttgtacccctagctacaattggaaccagcaaggcgttctattcagcaagggagtaatgttatttccatttagcttaaaatcattgactatttgtagattccccgactgtctaatcattagtctcaaaaattattgcttggtgaaagctttttttaaaaaaagcttcaggaaacaaaagtgcatttggtggtatatgaagataacctaaaacaggatatctgtttcatttatgggcctttgtcttattctttggtctgagatgatttttttctgagttgactttttaggtgccacgtgtgccaacgcatacacttgccatggttgtacctccccaggaacctgacagaacttcacaggagaactctcctgcccttttaggagtgcaaaaaggttagttattgaattatttttcttaaaatgggtattttttcacctaattgataaatccagaaatgtactttaatgatacagagttactgtgtacccatggctaattgaggtagataattctgacaaatgcaaatagtcttactatctaaaaccaaaaagacgtgttaggaaaaatgactttttattattttcctgttaacatactgatagttgtagctttcatctggcacagatgaaaacacttaagaaacaagccaagttcttgattatatttaagtaaccacagtttatcagacattcatttttcatttgataattctttagctaaccaatagtaaatgaagagtaaaaatgcatatttgctatctagttaagtctttgtaacattgattcagttaatgagtgagaagtttaagaattacattcagttgcatttatgcaatgctgaatatagtagattatcatctgtcactatgtgaacctggacaaataactatcaaaataaaatgtgtacaagtaatatccaaatgactattaagaaggagagtatactacttaaaaaactcaagtttatgagctctgatatgtttctgctgtctttatatttgtaaatgaaatgtaccttcatgtataaatgtaccttcacttcataattatgtatagttgtaatatctgagttttctgaaataaagaaaatagttaatatgtaggatgtttaaaactatgtaaaaacaaacttatgaacatcgttcatttagtgtatgataatcaagtcctagatattgaaatcacaatgaggtatgtaagtgtatataaatatctgtaacactgatttaagaaaagttggtgtgggttgactgttatagcagcaaacagaaatttctttcaaattatgccaattttagtaatttaaagtattgggggcctttaccagggctaaactattaatttcagagatgaaatatctgtagtctctctgatttaagctaattctagcagtttttcatggaacacctagctattcaaaattttcctgctgtttttaatcttaacaattaaaaagcaaattaaacatgcatctgtaagtatcataatcagctgatatttaacctttagtaaaatatttaaagctaaatgcctctgtttttattgttttctttgggggggagtttatttggctaaaccttatagaggactgtagtaactttggctttggaaactcaatactaaataagaatcattggccgggcatggtggctcacgcctgtaatcccagcactttgaaaggctgaggctggtgaatcatctgaggtcaggagttcaagaccagcctggccaacatgatgaaaccccatctctacgaaaaatacaaaaaattagccaggtgtgttggtgggtgcctgtaattctagctagttgggaggctgaggcaggagaatcgcttgaagccaggaggtggaggttgcagtgagctgagttgaggccattgcattccagcctgggcgacaagagcaaaactctgtctcaaaaaaaaaaaaaatcataaaaaaaaatataggccacgtgtggtggctcacgcttgtaatcccaacactttgggaggcttaagcaagtcaatcacttgagtacaggagtttgagacgagcctggccgacatggtgaaatcccatctctactaaaaatacaaaaattagccgggtgtggtagtgcacacctgtaattccagctactagggaagctgaggcatgagaatcacttgaacccgggaggcagaggttgcaataagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaatacaaaagttagccaggagtggtggcacaagcctgtagtccctgctgctagggagactgtagtgggaggatcacttcagcctgggagaccaaggctgcagtgagtcatgagtgtgccattgcaccccagtgtgggccacagagcgagaccttgtctccaaaaaaaaaaaaaaccagaaaaagaaaaaaaattaggctatgtgctgtggctcatacctgtaatcccagtgctttgggaggccgaggcagaatgatcgatcagcctgcccagcataggagaacttgtctctatttaaaaaaatttaaaaattagccagtcatggttgcctgtgcctgtagtcccagctactcaggaagctgaggcagaaagatcacttgcacccaggagctccaggcagcagtgagctatgattgtaccactgcactccagcctgggcgacagcctcaaaatataaataaataaataaataaataacacagatccacaaaacaatcaagaaataagctagatagagtgtatgccaagaggaaataaaaacattttaaatttaggtttaatatgtaaatactctgagatgtttaggtagtgattttttaagtttatactctagtgagtaaccatatttttgcttactgaaatatcttggattatttagttattttctgcattttgatgttttattacttactaaatagtataaacatggactacctttctaaggaatcattttactagattattagggttatccctaattaacatttgtatttagatcacttgggcacttgctactgctatcaaccaaatggcattggcaatctaacagttacttatgtaggatcaaactgcgatagtgcattgtgttaaaatgtcatgttagtataaatcatgcatatcatagaatattatgttgctatgaattaggaaaaatcatttaattatggaaaagaacacactgaattaccaggataggaaaacctatcttaaataaagacttaactttttttttatacttaaagctcctttttcttcttaaagcttctcttttatgtctctggaaaagctcccttgagtgatgaaattgctgtttgacctttttgtttttgtttcttctaagtccatatattctgtgtcgtgtatgtgattagggatggacaaagggttcttattccctaggactctcttttcctcttccagcgatcatcttttcaggttcttataacattttactcctgtctgtttttagtaaatctttttattattcatatcctcatccttttaaaaatgtattaatgcccataaatcttacccaggtgtttgatatatgttctactcagatattcttttctttcatgccccatgtgtaccatttgtacaggctccgtccatcttgattcataacctcccgatttaggcaacttgatctcacttgtctgttggttttcaaggattcaggattctaggtggcatctaacagaggcctcagaatcacgtccataaaatatgaaactcagagtgacatgctcagttttctagcattatttaactttattacctgcagttacaaatattcagatgggaaaggatacataagtaatgtaaatccgttgccttgttataactggttctacagaaagattcattttgatcttttgcaagttgtgtaacttagaattaatctgctgcaaagcatttaaaattatgtcaggataaacaaaacacatcttttgtgtatacctcaagccctcctgaggagtaatttccttttctctgaaattctagagtacttcattggatcttccttccagttcttgtcacttttgcttgctcccctccccttgggacctcaagtgtagagggttgagttaatcatactcaatttctggtgctttatcaccataacttctctcttgtttcatttattcccttttatttctctttccattcccctgcttcccccatagataatcatttcaatatttgatgtgtatattcttttgttcttataaattcttataaaatatttattttttatatgtatgtatatatgtgtgtgtgtgtatatatatatatatacacacacacacatatatatatatatatacacatatatatatatatatatatatttttttttttttttttttttgagacagggtctcactttgtcacccaggctggagtacagtggcgcagtctcagctcactgcagccccaacctccgaggttcaagcaatcctcctgcctcagccctgcaggtagctgggactacaggtgccctgccactacacttggctaattttttgtattttggtagagacagggttttgccatgttgcccaggctggtcttgaagtcctgagctcaagagatctgcccgacttggcctcccaaagtgctaggattacaggtgtgagtcagcacacccggcgattaccttgtatttttaatttacataaatagtattgtgctacagatttcattttgttttttccctttgtttactcagtactgtttttaagatttatccacctatctctagattgtttctacctatagcatagtgcttcacaccctgtatatcctccatgttttacctgtcctttctcccagtgacgaatatcctgattgcctctattttctcacccccactaacaatgctttgatgaaaatatttgtatagtccctttatggatctatataagaatttctttggaacatcatctccccacttagactgtaagctccttaagggcagggtttatgttgcttatctttatatggtctactatgccttgcttgtattagatgtttaagtacttattgaataaattaatgagtgcaaggctaagaatatagattattttgaaggcagaagaaaattcttaagcatttttaagaaagacattgtgattaaagagatgttttaaaaaagtaatcaagaagtagcattctagaatggtggaaacgagattgaaaacagaagcgtaaatgtaaagtaagaattaaattggcatgctgcttttatatgttagagttgctttttggagtaagtgacatgaaaagttctcacatttttatatcaaatcattaaaattatatagaaaaattgtatatacagtgaatggtattcagtattcctctggaaactttactgataatattctttagtcactttccattatataatcattcttatatggatttacacatgcccaaatttgataatatcttttaacatataactgcttatagtaataagaagaagattgaattaatctgttaacatgtaacacagatgtttctttggacacccttggttaagtgattgctatgttaaaatgtataatgtgtcctgttagtttgggaaattttgagaggaatatttagacataaaggaaaaataagtcaattctaggttagtggctttcatttttaactatgaccacaataagaaacattttatattgaagcccaggacacatcatacatctgtttatcaaaacagaaattccagtggataataaacactctactacatttgatgcactgtgttatttttagttatactttttcaacctgattttctatttgagatccagttgggaatgctgtttaaaaatcattctagtagggtgctgtgtgatgatgtaagcaagggaattacagaacaaggtttaagttttatagacaaaaccaagtaaggaaatatgaaatctagtctagatccttctgtatatcatgtttttttcccattggccattatttttccattgtacaatgcactgattatttttagacacaaaaatgattgataggattaagctcaatccaataaaaaactaaatatttggcaaatacatgtccacctcattccttcactgccaataaaaaaataaaggccatgtttaagctgtcactacatcatggcttctaatacagattttttctagttttgttaatggagggaaagtgagaggcaaaggaataggatagaaaccaaaccaaaaagatgaaatggcgactttacctgtggttctttctttgagacggagttttagtcttgttgcccaggctggagtgcattggcacgatctcagctcgctgcaacttctgcctcctgggttcaagcgattctcttgcttcagccttctgagtagctgggattacaagcatgcgccaccacaccgggctagctaattttacatttttagaagagacggggtttctccatgttggtcaggctggtctagaactcccaacctcaggtgatccacccgtcttggcctcccaaagtgctgggattacaggtgtgagccaccgcacccggccacctttatttttaaatagtactttatgatatcattcactgataccagtgaatagatgtctttgtatctgacactgtaagctgtttgaaggagatagaacccttttattttctggtatcttataatactacttactacctgttgaaaattttgttgctaaaagaatacttgtcttaatctctacccagaaactgtagatgttgctttagtttctaggactaattaggcgacattatctgtttttcaccaatctgttttattcttgatgttatagcttgtgttagtcctttgatgtgtctttaggcaattccactaactccatggctattttgagatgaaccactttttatgcatcatttttgccatcttccatttttaatgctacatacgttctgggcttatagtttgtctattcataaattactcttagtaatcttgtgttccacgcttcttgcatattatttgttaacaagatagacagggccattcctatctgttactgtcctcaaaattctactcttattttggattatactatgtataaagattttaaatctgtgaatgtccagtggggtcataacataattactaaccagtctggttagtgttgaactcttacctagttttcctgaatcttaaatacaaattgcttagtagctatacaagggtgttttgaaactaatggatgtttaaaggaccatggaccattcagtctttgtagaacttctaaatgtactcgagtgatgtcattgaatttattacatgactgaatatttctttgctattgctgtggatttgtacattgctatttgtgaccatttaccttccttttcttgttgattgtcattaggcactttaaacaaatactgtaaatcaaaacagggactcctatatggtcttaggaaagtaataataaaattagctcacaaatctaattgcttttgctctgaaagaataaagtctttttccatcatttttactcagaaagaaatataaattgaggaaggctgaggctggagaattactttaggccaggagttcaagaccaggctgagcaacatagcaagatcccatctcttaaaattatatatatataaattgaatatagacagtgtactttgcaatttaaggaataactaagcctctgaaagtgattgcagtgatattgaaattgtggtcatcttaccttattaaagacagtatgtaggtgaaaaacttagacttttttagtaatgacacatgttgcatatgtttgagctacctgcagttttgagatctctattctagcaaaaaagtagatgaatctctaatttttttttcttcagtagttttgtcacccctttgaaattcagaacatttcatgtctctaaatgatcttttttcctttggacttgagaatcatttttaatacaatggatgattttattttaaaaattcccaaattacctatgttattcatatatgttgactgcaattcaaaataatagataacttttttacccagcttttctcaaacagctttattgtttaatttacataccataaagttcccttgttttaaatgtacaatgcaatgagttttagtaaatttactgagttgtgtaaccatcatcactatctagttttagaccatctccatctgcccaaaaagatctcttatgcctgtttgcaattgatcctcattttcactgttataacctcaggcagccactactgtccctgtctctatagatttgccttgtctctgcagatttgatatgagtggaattacacaatgtgtggtcttttgtgtctagcttctttcacttagtataatgtttttgaggtttactcatgttgtagcatgaatcagtagtttgttcctttttgttgctgaatagtcctacttttttttttttttttttgagatggagtctcgctctctcaggctggagtgcagtggcgcaatctcggctcactgcaagctccgcctcccgggttcacgccattctcctgcctcagcctcctgagtagctgggactacaggcacccgccaccatgcctggctgattttttgtatttttagtagagacggggtttcaccgtgttagccaggatggtctcgatctcctgaccttgtgatccgcctgcctctgcctcccaaagtgctaggattacaggcgtgagccactgtgcctggcctagtcctacttctaaacaagattaagccttagatttgcctcagagtaggtattgtacgtcaaaaaatttatgtccttcatttcatgtccagatgttaggattattaatattgataattatttttcagctgatttgttatgaaggaaggaacttaagtgtaatttaaaaccttaaaataatatacattgccattgtttgttaacatatactgtcagcatgagtaaccctaaatgggaagtctgattttctcctaggatcatttattgtttctctcatagacagaatttacttgaagtgttcatttaaatgcaagttgtcctttgcatagtaagtttaacagtgttccagtacagatgtgttaaaggtatatttaatggagaattttagaaagacatgtcttgaaaaaactgatttcacattatatttcaatataagaagaaaaatattttgactgaaaaacactatcccctactttgatctgtaagttttggtcttttgcattaactctgcattgcttgcagagttgatattgctaaaagaatgattgttctaaatgggcagttaacatttctggtattttcaacgctattttgatactgctttagatttggtgttctttaaaaagtccaatctaatcagcagaattttgagattcttgcctcttggttttccttttccccgcccctgacttaatttccaaaatcctcctatcctaaagtagatttttaaaacttcacagtttttgaattagcaacatcctagtttgtgctgcttgaaatagatgagtataggctttaacctgcctaacactggtgtgactctgaacattcattctataacattagttataagggttttgggagggaggtccgtgtgtgtgggaggggaggctggttttcttttttttttttcttttctttttttttttttttttttttagcatggcactctttcaaacatttttcatgtgcttaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcaggtgggttaagaaatatatctgtaataatttctctttaatctgtgtgctgaacttctttatatacccctccaaaaacgtagactttgtacgtttccattttagaactttgtaaaattacccatttctcgaagtattttggaagtgaattaactatgctcaatagcactaacacacaaaagtgtgttttcccctcttcttttttgtcatattgcaaaggcaaagaaataaagttgccacaatcctttgttttaaaccgttggtatcaaaaccactgtgtgctgtgacttgggtaggagatctcaaagtagaatttctttgtaggcttttagaagtattcgtataagattatacttaaaattttcctgctgttgattttcatgtctggaaatttaaaatcacacagcttttttaatttgtaattttattagatcaacttacgtatttccaattaaatgggatgttcagataaaactaagtattccatattataatatttgtggttagaagataaggtgcattaaaatgattgtcacttgatgatttgaagattgggatttttgcattaactttcttaatgaaagcacacaaccacaccacaccacacacacacacacacacacacacacacacacacacacacacagaaaaaaaggcctgataaccttgaagtatatgtttctgtttattgttgtgtggaaaattacaactagatatgaaatgaggtgcacaagtttactttccctttcattgtccttgcagcagtgggaaaacagtgcaattaatcatttaccttcctaaagatggctggtgaatgtatcacctccatgagagcccaattcagaaatgcagccagaatggctgttgacagtggatgaagaccaagaactaagatgtagctggagtgatattcaaaggcaggccagtcctctgtctcttgattgcaacatttttttccttactgttgtctgttgcctcttgtcatattctcctccccttctcccatcccaattatgctatctcagtttcctttcttcttttgtgagcctttagtcttcctgatctttactgaatctttttaaatgtggaataagattactgaaatcaggaattttattgggcatgtgtttgacttccaatggttatagaattgtgatattgcctttgaggctcctctgatatgtaataggtatcattgtgcagaggaggaatgtcttagttttcttaaagaaaattaaaattctgggaaatgttttaaggagttaggctctttgttctttaatttgggtttttatatcttcagttggtagacacaaattaactttgtattattagcattgaaagttgttataaattgtgaataaattcttgtagttcatttggaattctaattttaatctgggtaaaaacagattttagaatgtgaagtatgattacgaataataatgatgaaactgatgaactgggaataacatttttaacatgtagtgttctgtaactagcattataatgttcctaattaagtgcacagtttgcagttatgaaatctgtgttactgattagttcagttatgttagaacttttttttttttaaagaatgtagaaatagctctaaaaggaacttgtaagtgttaaggaacatcaagttttatttcactgaagtatttgttaaattagtcttttacaaagtttgcatgaaacttagaaaattggcttagaaattatctttttattaatataaacaaaatttaatttgtgttagacattaatacctaccacattgtacaatattcttttattaataagttttaaattttaaatcagccaacaggtacaaaaattatcttcatgtaaaaacttccatttttgtgaaggctatgtgttttgaactatatggcagtaattatattttctttattcaagatgatgtacctgtcttaaatttaaatattatattttcttaagtcaaagtttgtcttaattttcttagttgaaggtaaaataaataaggcaagggtgaattaggttaatacctaatgctgtaattgtaaaacatattaacatattggtaagattatagagtaggacaaatatataattaattttacttaactctagttcttaccactcatattagtaaagaatactgtacatcttaaaattctactttagaattttactttagaagtaaattttactttagaagaattttagatgtatgataacagtacattttactttttaaatataggagtattatttccttattgctattctttcaaaatatttgttgtgataataagttgtttatataatttattaatgttgcaacttgattagctgattaacttagccctttagtgtgttgtttgatacgtgtcatacatgatgtagttccaaacagactatataaattattgattaggaacatggttcctcaagtccttctgaaagtgagcattgggtttttagcagttaccataatagcaagtgattctcaaagttcaaatgtctaggaatataaagtaatttaaagaaattcaaaatagcttttacctttgagcagttctagaaatacttagtaaaattttctttctttttttttttttttgagatagagtctcactcagtcatccgggctggagtgcagtggcttgatctcggctcactgcaacttccgcctcctgggttcaagtgattctcctgcctcagcattccgagtaactgggattacaggcacctgccaccacacccagctaatttttgtatttttagtagagatggggttttaccatgttggccaggctgctttcaaattcctgacctcaagtgatccacctgcatcggcctctcaaagtgttggttttacgggcgtgagccaccgcgcctggccaaaattttcaattctaatatagaaagaagattggttaaaaatcacctaatatcaatttatttacatttattgagcatttaccatgcaccaacttctatgataaatgctaaatatactttatttcatgggctaattataataatactttaaataagtccttttcccacctctatttttctgttgaaaaactgaagctggccgggagcagtggctcatgcctgtaatcccagtactttggcaggcagaggcaggcggcggatcacttgaaatcaggagttcaagaccagcctggccaacatggtgaaacccatctctactaaaatacaaaaattagccaggcgtggtggtgcatgcctgtaatcccagctacttggggggctgaggcaggagaatcacttgaacccaggaggcggaggttgcagtcagccaagatcacaccactgcactccagcatggggcaacagagcgagactctgtctcaaaaaaaaaaaaaaaaaaaaagaaaagaaaaactgaagcttagggaaattaagttgctagtaagtaccaagattcaaactcagttcagccaagtttaagaaccttagatgtaatatgcatgcatatgtgtcaacttaaagttctgatttatctttaagtattgttatttccttagacttcgaaattctattaatcatttcccttatttttatattaagatttgatgtacatgtaagttttaatacagtttttgactttttactatgttgttactatcattgccatcttaacaggctcttaaattgtaattttaaagtatctttaactctgtagtagtgaatataggtttaagaattaaaaagtaattaagaaatcctcttaaggagatttgcaataaaatctttaaataattttttctaattgactttaatattttatttataggtttttgtttttttttttttttgagacggagtctcacactgtcacgcatcttggctcactgcaacctccgcctcccaggttcaagcgattccccttgcctcagcctcccaagtagctgggattacaggcgcccaccaccatgcctgactaattttttttgtatttttagtagagatggggtttcactatgttggccaggctgatctcaaactcctgacctcgtgatctgcccgcctcggcctcccaaaatgctgggattacaggcatgagccaccacgccaaccataggtttttatttacatagaactatttaataaagttaccaatacataaaacagattacagcaattaaatttcttaaaaactcacaacagccgggcactgtggctcacacctttaatctaaccagcactttgggaggccaaggcgagcagatcatgaggttaggagatcgagaccatcctggctaacacagtgaaacctcatctctactaaaaatacaaaaaaattagccaggcatgctggcatgtgcctttaatcccagctactcgggaggctgaggcaggagaatccttgaacccaggaggcagaggttgcagtgagctgagatcatgccactgcactccagcctgggtaacagagcgagacttcatctcaaaaaaaaaaactcacaacatattttatgtacacctagtatcagtgagattttttaataattagatttattatcttccatattgcctacaaaactttcttcaacttcataaaaagtcaagtaacatactgtacttacttctctcacctcattttaaaatagtggataaattgtcagacacagtgactctgcacctgtaatcctagctacttgggaggctaaggtgggaggattgcatgaggccaagagttcaagaccagcctgagcaacacatagagaccctatctctttaaaaaaaaaaaaaaaaagcataccgtataagtttaatttgaattatatatagatgtttgtggtagcagtctgtcttggtcactttcagagatatttcattcagaggtaggaaatattttagaatttatgaaaatgtcatagtcttggtgtaattttctcttgatacaacctttattccacatgcactttttaaatctcttgctacttcctagttttagaacttttcatttgtaattagtcctgttaaaggcacttgctatggaatgtttctgactgtcattattacatggagtgaaaaaatgcttctaggataatgtagtacaaaaatgtttagtaattattgtaacaacacatttttgttaacaaagctgttaaatgcacaaaagtactttttaaaagccaactctgtgaagaagtttcttatcacattctggcatagcactctaatcaactattcaaaaaaatttttatatacctgtttttcataataaagagagatgagataacataaataaaatactgatagaaaagtagttctttactaaagtatatgttaataattgtgggaccactactgaagtcttactgttagaaaggttctgtaacatattaatcttcagtgtcttgttttttcaagcagttttccaaacatatcagctattttgaggaggtgtaacaaaatagtatctgcttttaactcattgaatgacaacaatttttcattattactattatttttttcttggccacttcttccaggaaaaaaatgacaaaaaattttaaggctttgtttccattttgcatattcttataggtgaaacaaacatatgtaataattattcctatttgtaactaaatagttaaattatgttatttatgtgatgacagaagctggagaaatttgtattgccaagatggttatatatgttggtggggatgagctgggtagctcatgtagaaatatatctgggcatcttaaactttgctcacttatttaaactagtaatctactaaactgagtcattcacacttacgaatagtatctttgaatgggatctagtcatatcaaaaattctagagagaaaatattttccaacacttaaaatgcttacatttttctttaagtcctacgtgtttttgactgacttttaatctgggtgcaaatgtaaggttattgccatcactgatgctttgttgatttttttgtatattattactgattatatgtttttttctgagtttttcctttcttgagtgaataatgtttttatttttcaatacaatgaataatagtattgacaatcctataaaatatctgatagttacatctattgagcacccaccatttgctaaaaacactgtgttaaatgctttatatacagtatctcttagactactcacaacatccctgagataggtcctgtttccccccgtggtcaaactccatctcttaagaaacataagaaattttcagagatataaaatacataatttcttttaactcagttttctttcttttttttttttttttttttttttttttttttgagatggagtctcactctgttgcccatgctggagtgcagtggtgcgatcctagctcactgcaacctccgcctcccaggttaaagcgattctcctggctcagcctcccgagtagctgggcttacaggcgcgttccaccactcccagctaactttgtgtttttagtagagacggggttttgccatggtagccaggctggtcctgaactcccaaccctcctgacctgaggtgatctgcccacctcagcctcccaaagtgccaggattataggcgtgagccatcgctcctggacttaactcagttttcaaaccacattttgagatctcaaatagaacttcaatgttcattttaaaaatagttggactttcagatactgattttttaacaaagtttcaaaataaatattgaatttaggaaacacatactccctgctatttatgtgagaaatacttgaacttgtctccctcccctcccccacccttttttttagatgtagtctagctctgtcacccaggctggagggcagtggcgtgatctcagctcactgcagcctccacctgggttcaagcaattcttctgcctcagcctcccaagtagctgggattacaggcatgtaccaccacacctggctaactttctgttttttttagtagagatggggtttcaccatgttggccaggctggtctcaaactcctgacctcaggtgattcacccgcctcggcctcccaaagtgctgggattacaggcgtgggccactgcgcccagccccctttttttgaattgtacacaggatatttttatctaattgacttttttacaaactaaaatctagaattccttttatttacttttatttttggaaattttttttcctccctgttggcaatgcaaaaagctactatttaatgtatgtgcactaaatatcaggtgctgtgttaagtattttatctgcattgcctcagtggtctttccaataaccttccaaggcaggtaccattattttcgccattctacatatagggaaaattgaagctcagagaagttaaattacttgcccaagatcagaaagtcagtgttggaactaatatttaaatgtaggtctgtctgattccaaagcttgtgattttactattactacatattactgctatggaaatttctgtttttgtgtttttctatgtacaaataaccttactcttttaagtggaatttagcaatatgaatattgtttttcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatgtgagtagattgctttatttaaacttattttgcacattctgatcttctttggaaaggaaaattattctgcatttattgtgaaaagaaatattatttgctcttaaattgataacttctgttaaaaaaaattttaacttatttttttcttctcctagactgagagcaatcatgacacagcattaacactagcttgtgcaggtggtcatgaagaacttgtatctgtgctcattgcacgggatgccaaaattgaacacagagacaaaaaaggtaaatatcagtcagaaataaaatccaagtgtagttacatcagaaaataattaacttttttattattgataaatagttcctagactatctcagtgataagatggataagtatatttcagttaggaatatctggattcattattctgcggagccaaataattctcaaaacattcaaaaattagacgtagatcattagtgaaatagagcaagttgtggttgcctttgttaatccaaaggtagttcatacagaggcatcaaagttcattatgagtataaactttaataatttttaccgacttagttttttaattaggtgtttatgggttttttgtcactaacaaattagggtttagagcagttttatgttaactcattatcagtgtctgccctgaaggatttattttgctaaaatactagagaattgtaaacagtggctttaaaataaaataaaaaacataaatttgtttaagattttcattttctgatttaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtgtgttaatgttaattttcattttgtaaatattttgcttgtattttaaaatatgcatatgattcgtattttagctacatgaataaaatttgcatgtattttgtgtgtttgtttttctgaggcagggtcttgctctgtctcccaggctagagtacagtggtgcaattacagctcgctataaccttgaactctggggctcaagcaatcctcagcctcccaagtagctagggctgttttgtagagatggggtcatgtaatgttgccctggccgatttcaaactcctggcctcaagcaatcctctctcctcggcctcccaaagtacagggattatagttatgggccagcatgcctggccctgcacgtattttaacatgttccatatactttctgaggaatgggtacttctgttaacttttatgggaatgtaaatgccctttttttttggcgggggtttgtggagggaacaggagggtggagatgaggtctcattatgttgcccaagctggccttgaactcctggcctcaagggatcctcctgccttggcctcccaaagtgctgggattataggcatgagccaccatgcctggccataaatccccttttaaaaaatctgtttcttgcccttaaagccaaataaaaattatcttaatccttacatttattcggattgaatgaatcacaattctaacacatatgaagtgcaaatttattgcccaataaatggcaaatagaaagggtaacatcttgttattgcagtataattgggatttcaaaactctgaattcctgaaattgaatccatttctctagtgttgatatttcaatatttagggtctaatgaaatgtaattaaaatatcagatatttagataaggaagttataagtcctgtttctttgtgtttccttcattataagttgagcccttggtgtaaactctcttctctatccatattttactttgtaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggtattgcctgttcattttattgttcatgtttagtaagttactactttggacttaaatgtctacctcttaacgtttagacagatacattttaaattaagatagtactaaagttgcaaagccaacgattatacctataatgtgtttgtttataagtaatctcagcttatttcagtaatgtggctgcttataaagaggtctcatttcaaaaagtgttttgttctatggcctaccaccctaaacgtgcccaatctcatctgatctcagaaacggtattttattttatatagttggaaatttataatccctaaataggaattacattttattttttaagttatttattttttgagatggagtttcgctcttgttgcccaggctggaatgcaatggcgcgatcttggcttaccgcgaactctgcctccggggttcaagcgattcttatgcctcagcctcccaggtagctgggattacaggcatgcgccaccacacccagctaattttgtatttgtagtagagatggggtttctccatgttggtcaggctggtctcaaactcccgacctcaggtgatctgccctccttggcctcccaaagtgctgggattacaggcatgagccaccatgtctggccggaaattatgttttaaattgtgacattttcttattctttattattggtcgaaacaagtaaaatctattcattgatgttagaaacctctctttttagtgaaaccttttcatctttaatgcttttctaaaataataggcaacatattattttaattttctaagcacatttccccctttaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaaggtaagcattttttacttgtcaactatttcagatacatttctgtagaaagaacatggcattttaacgcaaattgaatataatattttaaattatcataaattaaaactgataccaatgcagagttgagggattatgctgtataatagtgagtgacatactgtcaccatcatgacttttattaaggacaatgaagaaaacagaattagtacttttcccaacctcagccttgagtagctttctattaatactgcagcttacaacttttgaatgtagtaagattattttgtattaactcttacactgtagacttttaaagaacacctttaatgaggtatgtgcttatcattgtaaaaatcccaagcaaaaatttaattcacaagttataaaattagggcagctaacatctaatttgaccatggcagattttgacagtttcatgactatttggtattaagaaaataggagttagtggaggctgggcgcggtggctcactcctgtaatcccaggactttgggaagcctaggcaggtgaatcacatgaggtcaggagtttgagaccagcctgaccaatatggtgaaacccccgtctctactaaaagtacaaaaaattagctggacgtggtggcaggcgcctttaatcccagctactcaggaggctgaggcagaagaatcaccggaacttgggaggtggaggttgcactgagcagagatcacgccattgcactccagcccgtgcaacaagagagaaactccatcccaccccccgcccccacaaaaaagaaagaataaaggagaaaagtcataagataatctccatagatgcaggaaacacacacagaggaaagaaaataggagttagtatgtcattggcttgaatttctttgcttagaactgcaaggttcttagaactctggaaagacgtaggttgggtagaatttttaataattagtcaacagagaatctagtgctcatttgaaattggaaagatttgactggaaatctcgtacttcttccctgaaattccttttacttcttaaagtttagtgcaacatttacattcttttaatctaagtaatgaggaagtgtagtttttccttggctttttaccacacaaagagaaatgagtctttcctgtcattcaatttgtctttttctattacaagtattcattgtgtgccactcatccattaaaggtcctagagaaatctgtgttattttggatagtaccagtaggaaatgtcctttgaaaaaatgttggagactaacgtaccaaaggcacatatgcaaaaaatttataaagtgattttaatctacttatttttaatatctctattcattatgcaaagaaattatctgagtaaattcacaaaagtatagaagttacagaattgtttttagcatgagataacatgttttaagttcattctagcacgtctgaatctaacaatttctactgctgtttagtaaaattcaaggcaaaatattgcttagctcttttatgagagctaatcagaactagaattgtcttaaaagttaattgcctcaggtttttaaagaaattatgtagcttagttttggtctacggaatagttaaaaaaagaaatgtaacttagttgcataatttattggtttaaacagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggtgagtacttttctattatatgtagaacttctcatggtcattttcacttttcagagcttttaaagttaataacattgttttactttattgatattgttaagaaaagattatttgcaagttattttgtaaaagaagaagatagagaaaactagaaaaagccagcctcttcttacaggaaacaaactattaatatgccttgtttacaggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaaggtaatttgatatgggggaagaaaggtcaattttaagccaattctaagttaaaaccatgtgagaaagataagtttatcttggagaattgagtatatttccatagaaaaatcactgctatctttccattctttttttttttttttttttttgagacggagtcttactctgtcacataggctagaatgcagtggcatgatcgcggctcactgcaacctctgcctcccaggttcaagtgattctcctgcctcagcctcctgagtagctgggattacaggcatgcgtcaccacacccggctaatttttgtatttttagtagagatggggtgtcaccacgttggtcaggctggtctcaaactcctgactttgtgatctgcctgcctcagcctcccaaagtgctaggattacaggctcccgaccttatctttccattcttttgtggccaaatctaagatctatgtggtagttcactataagcaacttggttgttaaatcacttggtgtcttgactatttgtgatacattgttcatgaaacagaagatttaagaaaaactattatatgcagatggatttttttgtgcctaaagaggaacaaaaaggagtagactttcataaaaacttactgtatcttctgtgtgcgtgtgtgtgtgtgtgtgtgagtatgaaacggtctcagtctgtcaaccaggctggagtgcagtggcatgatcatagctcactatagcctcaacctcccaggctcaattgatcctcccgcctcagcctcctgagtagctgggaccacaggtgtcactaccatgctcagattttttttatttttactttttgtagagacgaggtcttgctatgttgcccaggctggtctcaaactcctgggctcagcgattctcccacctctgcctgccaaagtgctgagatatgggcgtgagccatgcctctcatatatattaaagttcatgcccggcctctcatatatattaaagttcacttatctgctgtatttttaaaagccttcccattggtatagcttcccaaactataaactacttagtagggcatgtaaagacctgcataataagcttcatgtcaacctccccatacaaatcatttatgctactatccccttttgctcactgttttctagttactggcctagaatgcactaaattttcaactgcctcagggcctttgctcactgattttcttttcctgaaatgatttcctttgctgttcacctagctcacctctctactcatctgttagctccaattttacatgtcagttctcaaagagtatttctctaacaccaaatctgaaaaaggtccctctgtttctcttttatagttgagttttgattttccttaccccaatttgtaattatatcttcaaacatgtacttaccattttaatgcctgtctcgccaactagactggtaggtccatgaggacaagagtcatgaccatctttttcagcactgtttatatacccagttgtttagcacagtgcaatttacatatagtgaaatgcatgaatcttaaggtacatggtttagttttgataaacgtatacatacatgtaacccataccccataaacatataaattatttctgtaaccctagaaggttccctcttgcccacttttagtcacttccctgccccagaggcaagcatttctctgatttgtatctccatcacactaattcttaaggatgttttagaaccttggtaggaagggaaactatgcaagcttggttacattaaaatagatatgctggccgggtgcggtggctcacgcccataatcccagcactttgggaggccgagtcaggtggatcacctgaggtcaggagttcaagaccagcctggccaacatggtaaatccccgtctctactaaaaatacaaaaattagccaggcgtgatggtaggcacctgtaatctcagctactccggaggctgaggcaggagagttgctagaacccgggaggcggaggttgcagtgagacaagagcgtgccgtggcactccagccggggcaacaacagcgagactcccatctcaaaaaaaaaaaaaaaaagatatgcttagaattgattacagatctttcaacccttgataatggcatttagaaagtgttttatttagattcaagtcctaaggctcagaaagttgtgatagtccaccttgtttagttagtgaagtagaggcaaagtaagactttgaaatttaaaaaaaaattacttattttaggactcatttcccttttacactgaggttcattttacatcaccaatgtttgtttaatagatttattctaggagatactgtttttctacaaaagctttttctaatttcagtgggattaaattcaggagaaatgttgtctagtccaccatccattcctgagcacacattcttgtcttttatgcctttctttttataagctgaatgctgatcttatttttataattttaattttaagcttaatattctatttggaagtatttgcctttttattcttaaattggtaggcatatatgcaaaatcaagggattcctttgtaattctgttgttttactttcttttattcttaagaataataatttttcttttcatgctaccttgtctaagattgttgtacttcttatagggtcatgtaaaagttgttcaatatttggtaaaggaagtaaatcagttcccttctgatatagaatgcatgagatacatagcaacaattacagataaggtaagtttaatatgctactgaagcacatttttgttctttgtggaatgatatgccaaagtgtgcagttaggaacttgttctttttatattctgaaaggttggtcacctgatctctttatgcgtttgtttctccatttgcaaaatagaggggtataatacttttgataaactattttgagatttctactgtggaccatagtcacagtgactacactaaggtactaaaccattagcctaatgagaaggcttcctaaggacatgcaggtttttagggaaatggtgtcttatttttgtgaaagattggactcaaaggataacttaatttggtttagtgacttttcagtttgaactttaacctctggactttaatgtgctcatcagcttaagttttatttggcctctttcattatatatttacataattctatttcctgctgtaggaactgttgaaaaaatgtcatcaatgtgtcgaaaccattgtgaaggctaaagaccagcaagctgcagaagcaaataagaatgcgagtattcttttaaaggaacttgatctggaaaaggtgagtgggaaaaataattttcctttttagaaattattgagggtgggggccgggcacggtggctcacgcctatgatcccagcacttcagaaggccaaggcgggtggattacctgaggtcaggagttcaagaccagccttgctaacaaggtgaaaccctgtctctactaaaaatacaaaaattagccaggtgtggtggcacacccctgtaatcccagctactcgggaggctgaggcaggagaattgcttgagcccgggaggcagaggttgcagtgagtcgagatcgtgccactgcactccagcctggctgacagagcgagactgtctcaaaaaaaaaaaaaaaaagaaagaaattattgagggtgggcgtggtggctcacacctgtaatcccagcactttgggaggctgagcctaggagtttgagatcagtttggtcaacatagagaggatggcctgagcccaggaggcagaggttgcagtgagctgtgattgtgccactgcactctagcctgggtgacagagtgagaccccatctctacaaaaaaaagtttaaaaaacagttgggcatggtggtacatgcctgcaatcctagctattcaggaggctgaagtggaaggatcacttgagtccaggagttcgaggctccagtgagccataattacacactgcagtccagcctaggcaacagatcgagactctctctctattaaaaaaaaaaaaaaaaaaaaggaattgacagatgtcatggctcatgcctgtaatcccagcactttgggaggctgaggagggtggactgcttgagccccagagtttgagaccagcctgggcaacatggcaaaaccccatctctacaaaaaacaaaaaattagccaggcatggtggcaggtgcctgtagtcccagcaacttgggagggtgaggtgggaggatggcctgagcccaggaggcagaggttgcagtgacctgtgattgtgccactgcgctctagcctgggtgacagagtgagaccccatctcagacaaaaagaaaatctgctagagtaaacgtgtcgcctatatgaccaatattcttaataatatatgattcaaaggaaataggtaatagattcttaaaccaccatcaattttttattctgacctgtcattcaaaaaaatatattttgagcccaaatataagggaaggactagattttgagcaagatcccaatttacggctgggagcggtagctcacacctgtaatcccagcattttgggaggcctaggctagaggatggcttgagctcaggagttcgagaccaggctgggcaacatagtgagaccttgcctctactaaaagtttaaaaaattcaccgggcatagaggtgcacacctgtagtcccagctactcaggaggctgaggcgagaggatctcttgggcctgggaggttgaggctgcaatgagctatgattgtgcaatgagccactgcactccagcctgggtgacagagcaagaccctgtctcaaaaaaaaaaaggtcctgtctgggcgcagtagctcatgcctgtaatcccagcactttgggaggccgaggcgggcagatcacctgaggttaagagtttgagaccagcctggccgacatggagaaaccccgtctctgctaaaaatacaaatattagctgggtgtggtagtgcatgcctgtagccccagctacttaggaggctgaggcaggagaattgtttgaacccgggaggcagaagttgcagtgagctgagatcacgccactacactctagcctgggtgacagagctagattctgtccccccaaaaaaaaaaaaaatcccattttaccaaatgacatcattactgcctaagtggttttaacattggtctgtgaagaaatttagtaaagcattggaaatcatttgtttattgttaagatctgggttacaaatggtttattagattcccaattaaagactatccagaaaaaagacgggaggagccaaggtggccgaataggagcagctccggtctacagctcccagcgtgagcgacgcagaagacgggtgatttctgcatttccatctgagctttgaagagagcagtggttctcccagcacgcagctggagatctgagaacgggcagactgcctcctcaagtgggtccctgacccctgatccctgacccctgagcagcctaactggggggcaccccccagcagggtcagactgacacctcacacggccgggtacttcaacagacctgcagctgagggtcctgtctgttagaaggaaaactaacaaacagaaaggacatccacaccaaaaacccatctgtacatcaccatcatcaaagaccaaaagtagataaaaccaaaaagatggggaaaaaacagagcagaaaaactggaaactctaaaaagcagagcgcctctcctcctccaaaggaacaaagttcctcaccagcaacggaacaaagctggacggagaatgactttgacgagctgagagaagaaggcctcagacgatcaaattactctgagctacgggaggaaattcaaaccaaaggcaaagaagttgaaaactttgaaaaaaatttagaagattgtataactagaataaccaatacagagaagtgcttaaaggagctgatggagctgaaaaccaaggctcgagaactacgtgaagaatgcagaagcctcaggagcccatgcgatcaactggaagaaagggtatcagcgatggaaaatgaaatgaataaaatgaagcgagaagggaagtttagacaaaaaagaataaaaagaaacgagcaaagcctccaagaaatatgggactatgtgaaaagaccaaatctacgtctgattggtgtacctgaaagtgacagggagaatggaaccaagttggaaaacactgcaggatattatccaggagaacttccccaatctagcaaggcaggccaacattccgattcaggaaatacagagaacgccacaaagatactcctcgagaagagcgactccaagacacataattgtcagattcaccaaagtcgaaggaaaaaatgttaagggcagccagcgagaaaggtcgggttaccctcaaagggaagcccatcagactaacagcagatctctcggcagaaactctacaagccagaagagagtgggggccaatattcaacattcttaaagaaaagaattttcaacccagaatttcatatccagccaaactaagctttgtaagtgaaggagaaataaaatactttacagagaagcaaatgctgagagattttgtcaccaccaggcctgccctaaaagagctcctgaaggaagcactaaacatggaaaggaacaaccggtaccagccgctgcaaaatcatgccaaaatgtaaagaccatcgagactaggaagaaactgcatcaactaacgagcaaaataaacagctaacatcataatgacaggatcaaattcacacataacaatattaactttaaatgtaaacggattaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagcctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcagcaaggatacccaggaattgaactcagctctgcaccaagcggacctaatagacatctacagaaccctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaggacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaaacccttcaaaaaattaacgaatccaggagctggttttttgaaaggatcaacaaaattgatagaccactagcaagactaataaagaaaaaaagaagaatcaaatagatgcaataaaaaatgataaaggggatatcaccactgatcctacagaaatacaaactaccgtcagagaatactacaaacacctctacgcaaataaactagaaaatctagaagaaatggataaattcctcgacacatacactctcccaagactaaaccaggaagaagttgaatctctgaatagaccaagaacaggagctgaaattgtggcaataatcaatagcttaccaaccaaaaagagtccaagaccagatggattcacagccgaattctaccagaggtacaaggaggagctggtaccattccttctgaaactattccaatcaatagaaaaagagggaatcctccctaactcattttatgaggccagcatcatcctgataccaaagccgggcagagacacaaccaaataagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcagtatacgcaaatcaataaaagtaatccagcatataaacagaaccaaagacaaaaccacatgattatctcaatagatgcagaaaaggcctttgacaaaattcaacaacccttcatgctaaaaactcaataaattaggtattgatgggacgtatctcaaaataataagagctatctatgacaaccccacagccaatatcatactgaatgggcaaaaactggaagcgttccctttgaaaacgggcacaagacagggatgccctctctcaccactcttattcaacatagtgttggaagttctggccagggcaaataggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtttcaggatacaaaatcaatgtacaaaaatcacaagcattcttatacaccaacaacagagagccaaatcatgagtgaactcccattcacaattgcttcaaagagaataaaatacctaggaatccaacttacaagggatgtaaaggacctcttcaaggagaactacaaaccactgctcagtgaaataaaagaggatacaaacaaatggaagaacattccatgctcatgagtaggaagaatcagtatcgtgaaaatggccatactgcccaaggtaatttaccgattcaatgccatccccatcaagctaccaatgactttcttcacagaattggaataactactttaaagttcatatggcaccaaaaaagagcccacatcgccaagtcagtcctacgccaaaagaacaaagctggaggcatcacactacctgacttccaactatactacaaggctacagtaaccaaaacagaatgttactggtaccaaaacagagatatagatcaatggaacagaacagagccctcagaaataacgccgcatgtctacaactatctgatctttgacaaacctgagaaaaacaagcaatggggaaaggattccctatttaatacatggtgctgggaaaactggctagccatatgtagaaagctgaaactggatcccttccttacaccttatacaaaaatcagttcaagatggattaaagacttaaacgttagacctaaaaccataaaaaccctagaagaaaacctaggcattaccattcaggacataggcatgggcaaggacctcatgtctaaaacaccaaaagcaatggcaacaaaagccaaaattgacaaatgggatctaattaaactaaagagcttctgcacagcaaaagaaactactatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcctcatcactggccatcagagaaacgcaaatcaaaaccacaatgagataccatctcacaccagttagaatggcgatcattaaaaagtcaggaaacaacaggtgctggagaggatgtggagaaataggaacacttttacactgttggtgggactctaaactagttcaaccattgtggaagtcagtgtggcgattcctcagggatctagaactagaaataccatttgacccagccatcctattactgggtatatacccaaaggactataaatcatgctactataaagacacatgcacacgtatgtttattgcggcattattcacaatagcaaagacttggaaccaacccaaatgtccagcaatgatagactggattaagaaaatgtggcacatatacaccatggaatactatgcagccataaaaaatgatgagttcatgtcctttgtggggacatggatgaaattggaaatcatcattctcagtaaactattgcaagaacaaaaaaccaaacaccgcatattctcactcataggtgggaattgaacaatgagaacacatggacacaggaaggggaacatcacactctggggactgttgtggggtgggggggaggggggagggatagcattgggagatatacctaatgctagatgacgagttaatgggtgcagcgcaccagcatggcacatgtatacatatgtaactaactgcacattgtgcacatgtaccctaaaacttaaagtataataaaaaaaaaaaaaaaagactatccagtatcctaggatgtgtgctgtaatggaaaaattaaaacaaacaaactaaaacattgcctttctgaggctcagtctgcttacctggaaaatgacagtgttgatatactgagtttggaaattatattaaaagaaaaaatgtcatgatcaagtagagttattctaggaatgcaagagatagcttaacataaaaatattttgttgataattaaaggaagagaaaaagtatgattattgagagatgctaaaattttgacagcaaattttggtttaaaaaaacttcgtaagctaaagagagaagaaaagtttgcttacagtcattgaggagaaaaaaagataacttatccataataaaaaatgatcatgtgaataggcaattcacagaaaaagaaatacaggctgggcatgtgtggtggctcatgcctgtaatcccagcactttgggaggctgaggcaggaggatcacttgagaccagcagttcaagaccagcctgggcaacatagttggaccctgtctctacttaaaaaaataaattaaaataaattctataaataggaaagaatcatttttgtaatagcttcttgtcaggatttttacagtgaaatttatcagtattttgtaaagatccatgatagctgcattttaggcacataaatagatgccacataaatgtttttttaaaatagcattagtgaaattcactccacaaaccatacaatttacccatgtaaagttacataattcacagttgggcacagtggctcatgcctgtaatcctagcactttgggaggctgaagtgggcagatcacctgaggtcaggagttcgagaccaggctggctaacatggtaaaacccttctctactaaaagtacaaaaattagtcaggcatggtggcacacgcctgtaatcccagctacctgggaggctgaggcaggagaattgcaggaacccgacaggcagaggctgcagtaagccaacatcgtgccactgcactccagcctgggtgacagagcaagactctgtctcaaaataaaataaataaagttacgtaattcagtggtgtttagtatattcacagaattgtacatttatcagcacaattttggaacattatgactgtcataaaaagaaaccctgcactccatagctatcatattcccattcccccactgcaatccctgtgtcctaggtaactgctaatctactttctgtctctatagatttgtcaattatggacttttcacataaatggaatcatataatatttggtcttttgtgactggctttttcacttagtgaaatgttttcaaaattcatccatgttatagccaaaatcagtactttatttctttttattgccaaatacgaaaacaattctattctgtagacagaccacattttgtttatctgtttatcagttaatggtcattgggttgcttccacttcttggcaattataaacaatgctcaatgattgtaagcaaccttttcttctctctttagcttactacgtttttttaaactaaaatttgctatcaaaattttagcatctctcaataatcatactttttctctttaattatcaacaaaatattttcatgttaagctatctcttgcattcctagaataactctacttgatcatgatgttttttcttttaataatggaattataaataagtatacagtttttgtatgaaaatgtttttatttctctggagcatgtacctatggatggaattactaaatcatatgctagttctgtgtttaactatttgaaggattgaaggagtgccagattgttttccaaagtggctgtaccattttacattcctacctgcagtgtatgaaggtttcaatttctccacatcctcaccaatattattatctgtctttctgattgtagccatcctagtgggtgtgaagtggatatcttgtgacttggatttgattttccctgatggctaatgatattgaacatctatctttctctgtgcttattggtcatttgtatattttctttggagaaatgtctattcagatcctttttctgtttttaaaaaatagctttattgaggtatatttgacaaataaaaatttgtgtatatttaaaatgtataacttggtttttttttttaattaatttttttctttttcctttttttttttttttttttttaagagacagggttttactctgttgccaaggctgagtgcagtgacatgattatagctcactagagcctcaaactcctgggcacatgcaatcctcctgcctcccaagtaactgggactacaggcataggtcaccatgcctggctaattttcttatttttttacagagatgggatcttgctatattgcccaggctagtctcaaactcctgggctcaagcaatctttcctcctcagtctcccaaagtgcttgtattacaggcgtgagccaccatgcccagcctgcatataacttgatgttttcataatctgttttttaaatggactgtcttttcattcgtgagttgtaagattttttttttatatattatagatacaagtcccttaccagttgtatgatttgcaaaaatatttttcccattttataggttgactgtttactttttttttttttttgagacagtctcactctgtcacccaggctggagtgcggtgccatgatctcggctcattgcaacctctgtctcccaggttcaagtgattgtcctgcctcagcctctcgagtagctgagactgcaagtccgtgccaccacacccagttaatttttgtatttttagtagagatgaggtttcgccatgttggctacattagtctcgaactcctgacctcaggtaatccaccgacctcggcctctcaaagtgctgggattataggtgtgagccaccacgcccagctgattttttactttcttgatgattcctttgaagtataaaagtttttaattttgatggtgtccagtttattttttcttgttggcatttataaatgtgttttgagagtaacatccatggaaatccctgtgtatcataaaaatatcatttcattctttattttacattactgccttattggtaaaattatatacctgctttatttccagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatggtgagaaacaaaccatctgaattaacgataaaattctcctttgtttatcaacttcattttgagtgctctttgctctagttaactctagttaaacatttgattactttattaatctgaaatggacaatgacttttatagtaaatatttgtaagtgttttgcattgtaaattaatgcagagaaacaagagggaaaacaagcgcataatttgaataaattcagttgtaatttaagtcaccttgtaaaacactgcatatatactaaaagcaatacagtgagaagtttgccacctttttttgagattcttctctaactcttcctctcctgattagaagtaaaatttctcagtttacttttagctgagattcaggctcaaggatatagaggcctgaaatgtcagtagagatgggtttagtactctcaaagagttatttattgtactgtctggcagtgcttgtagtaggcaaataattttgttctacttggattctaattctaaaatactatttgaaaaatgtcctaaattcaaattatattgtggtttgggttcatgagactagaattaagaatattaagaatattgggccgggtgcaatggctcacacctgtaatcccagcactttgggaggccgagagcggatcacgaggtcaggagtttgagaccagcctgaccaatatggtgaaaccccgtctctacttaaaaaaaaaaaaaaattacaaaattagcctgggattacaggcgtggtggcacatgcctataatcccacctactcaggaggctgaggcaggagaattgcttgaacctgggaggcggaggtggtgagccgagttcacgccattgcactccagcctgggtgacaggagcaaaactctgtctcaaaaaaaaaataaaaagaaaaaaaagaatattaagaatgttgctagtatgtgtgtcctataccaccttagacaagaaaatatattttatatttgttctaacaacaaataatagtaaatatttattaggctaacaagagcaaagattttttttgtgtgtttttttgagatgaggtctccctctgccacccaggctggagtgcagtggtgcaatctcggctcactgcaacctctgccccccaggttcaggtgatccgcccaccccagcctccccagtagcagggaccacaggtatgcaccaccatccccagctaatttttgtattttttgtagagacaagatttcgccatgttgcccaggagatcttgaactcttgagctcaagtaatcaatccacctgccttggcctcccacagtgctgaaattacaggcatgagccactgcacctggccacagtaaaagatttctttatttcagctgggcgcagtggctcacacctgtaatcccgcactttgggaggccgaggcgggtggatcttgaggtcaggagtttgagatcagcctggccaacatggtgaaaccctgtctctactaaaagtacaaaaattagccgggcatggtggcacatgcctgtagtcccagctacccaggaggcagaggttgcagtgagccaatatcgcaccactgcattccagcctaggcgacagagcaagactccatctaaaaaaaaaaaaaaaagatttctttatttcttagtgaatactggtgaaaggaaaatatgatgtaaaacactgaattattatgaattatcaaatatattctgtcagaatttgttttgagatctgtgactcagtatgatttttattctttttaacaatttcagtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacggtaaatttttctgatttgttaactctacctgcacctttccttcttcatgcctggtacaagaatttgaagtatattaatccaagtacaagttgtgttaaacaattgaagtctaccacattatctatcttcaatattcaaaactgaaattcacccatgtcctctttatcatttgctagttaggaaatgagattattagaaatttttataggattcatagtctgaagttgaaaatatttgcatgctttgattttatctatgtcatttttattgattatagtctaatttttggcatctgaatccattttaatactaaaataaatgatgggttctttgctctatttctgtttttctgactcattgattatttgatgtgccaaagtttaatacgaatatttcagcgtaactctggctataaaggaatagtctcttgagtttctatcttaaaacttatcttttattgtacttgctatttgtctcttcttagacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtaaatagaattagttccatctttttagctttcatatattttccctttctcatgtgagatggctacctagttaattaatgaataatttgaatgtggttattattttaaactgcattgccacactaaatccagaatatgctaaagcaaaattagaagcagtatgtaaattttgcatgcatattttatatgacacaagaaattttggcttttttggataacctcagttgctttttatgtagttcaaatgtaaaggctttctcttgctttttttctttctcatgtctcagtaattctagaactaaagtactaataatcaactttagattcagaatacatgtcagctcatcattgacctgaggctttattttttattgctaagtatgagctgttgatactggtttaaaatgaatatgctagcatagttattctgtgtggattttaataatatggtattcattattttaacagggtcattgcagtttagttgatgtgtaatattttgggcagatttgaatgcttatattgtgagtgatttaaatataatttttgttttcaatggcagtgtaatttttaaaattaggttctctgaaactgcagagcaatgtaatttttaactttactaaattcaattcaatattacaagagatcaatttctaaaataaaaacttttaataatttcctctttagcatttaagaaatgttattctccaaaatgtccatgaacatacttactaagacatctttcttaataaagagacatttaatttcataagctcatgtgtattcttcattttataggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggtaattgtgcaaaatgtatactgctagttctgagtagaaattataagaagcatacctttgtcaggtatggtataattaagaactttatttgatggttaagattacctttttttttttttttaatgtttttggtcttgtttctgtttttttttttcccttaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttggtaagttattaactattgctgcagttgagtttggagctcctatggcctaatctcaccttaagtggacaaaaaaagtagcaagaggtaaatcagtcacatataatgagctgctttagattctctctatgatttttctgtccctcatagtaaggaagttataccatagtgtaagtccattttcttggaattggtgtctattcatattaataaaaaaaactccagggatgtttcaaggattccaaatttacagacttaaaaaaaaaatcatagtgattgtttgcatttcttagatttaaaaaattgaagttgcaaaggtgtttaggcacaagttcataatttacattgtttaatagtactcttgtttattttaggtatagctatttgttttttatgtattttattttttatttttattattttattttatttttttgagacagggtctcactctatcacccaggctggagtgcagtggcccagtctcagctcactgtaacctccgcctcctaggctcaagcatttctcgttcctcatcttctcaagtagctgggactacaggcatgcgccaccatgcccggctaattttttgtatttttagtagagacggggttttgccgtgttacccaggctggtctcgaactcctgtgctcaggcaatatccgcctgccttggccttctaaaatgccaggattacaggtgtgagccaccgtgcccagcctagatacagctatttgaagagacccagtcatttataggctcttacttttgaaagaccagtgtagatttagctgttgcttctttgaaattataaattagctgccgaggcattatgagaaatatatagacagatctgaggtcagttttggcttggagatatttggagaaccagaatctattttctatggtttaagagccaaattttagtctaatctgcactgttctgaaaaacaaattaaaaatgtggccgacccagaatatggcactattgcctcttagcatttctcttccagttggaaaactgccccatattccatgctactttgttgctaattataaactgacctatgttgtttaaaattatttgtgagttatgaatatggcgtagccctagctttcatttcagatatgtttccatttacttgtcttttcaggaaaacatagctgttatattgtatttcaaatagaaatagaagcctgcatatgactatctatggtccaaaatattctctaaattttttccattcctctctgtaaataggcatctattacaacttttcatttggggaaagtaatatagactttgagaagccccagggtgaaagaagagctcatttccagtacccaggatgtgataggaagcattaatccttgaccttccttctagggcctaggattaataatcttggccccatttcttaactgcttgtatggtttcttttgttgatgctcttttcacggatatagtttactttcctagttttcaggtaagaagtagtaataccgactgagcgtggtggttcatgcctgtaatcccagcactttgggaagctgaggcgagtggtttacatgaggtcaggagtttgagacaagcctggccaacatggtgaaactccatctctactaaaaatataaaaaatagccaggcatgatggtgcaggtctgtagtcccagctacttgggaggctgaggcacaggaatcacttgaacccagaagatggaggttgcagtaagccgaaatcatgccacagcactccaagcctgaacaaaagagcgagactgtcaggaaaaaaaaaaagtagtaatacttaagaagatgggaaaagatagagagaaactgaaaccatcatacatggtaggtaggaatgtaaaatggtacatctgctttggaaaaacagtttcacagttcctcagaaagttagacgttaagagtgatcatatgatcccattattctactcctagggaagatatatgtctatagaaaaactggcacaccaatgttcatagcaacattattcataatagccaaaatgtagaaacaaccgaacgttcattaactgacaagcagataaacaaaatgtggtatatctatagaatgtaatattttgtatttggtataaaaagaaataaagggccaggcgcggtggctcacgcctataatcccagcactttgggaggccgaggtggttggatcatgagatcagaagttcgagaccagcctggccaacatggtaaaaccctgtctctactaaaatacaaaacattagctgggtgtggtggtgcactcctgtagtcccagctactcaggaggccgaggcaggggaatcacttgaacacaggaggtggaggttgcagtgagctgagatcgcgccactgcactccagcctggtgacagagcgagactctgtcttaaaaaaaaaaaaaaaaaagaagtactgattcatgctataacatggatgaactttgaaaacattttactaaatgaaagaagccagtcacaaaagaccagatatttattttatgattccatttatgtgaaacatccagattagcaaatccatagagacagaaagtagattagtggttacctaggatgaaggggtgattggagggtgggtgatagcttaggggtgcagaatttctttttcttttttttcttgagacagggcctcactctgttgcccaggctggagtgtagtggcgtgatcatggctcactgcagcctcaacctcctgggcttcaagcaattattctaccttggcatcccaaagagataggattgcgggtgtgagccaccatgcccagcttcagagtttctttttaggataacagaaatgttctaaaattgatgtggtcatgaatgcacaattctgtgaatatacaaaaagctactgaatagtataactttaaatgagtaaattgtatggtttgtgaattaaatctcagtaaagctattaaaaagtacatttatgtggcatctacatttaggtccccaaaatgcacatcatgatctttaaaagctatcatgattagctgggcatggtggctcacgcctgtgctgggaggctgagttgggtggatcacttgaagtcaggagttcaagaccagcctggccaacatggggaaacccccgtctctaccaaacataccgaatttagccaggcatggtggtgggtgcctgtaatcccagctactcagtaggctgaggcaggtgaatcgcttgaacctgggaggcagaggtttcagtgagctgagattgtgccactatactcagcctgggtaatagagcaagactctgtctccaaaaaaaaaaaaagctatcatgatctttacaaaagactgacagatttcactgtaaaaatattgacagtggccaggtgtggtggctcacacctgtaatttgagtactttggaaggccaagtcaggaggatcacttgaacccaggagttcgagaccaccctaggcagcatagtgggaccctgtcttgataaaaaataaatttcaaagttagctcagtgtgggaccgggcacggtggctcacgcctgtaatcccagcactttgggaggccgaggcgggcagatcacgaggtcaggagatcgagaccatcctggttaacacggtgaaaccccatctctactaaaaatataaaaaaattagccaggcgtggtcgcaggcacctgtggtcgcagctacttgggaggctgaggcaggagaatggcgtgaacccgggaggcggagcttgcagtgagccgagatcgcgccactggactccagcctcggcaacagagcgagacaccctctcaagaaaaataaataaataaaaataaattagctcagtgtggtggtacacgcttgtagtcccagctactcagcggggctaggcaggaggattgcttgagcccagaggtcgaggctgcagtgagccatgatcacaccactgctgcactctagcctgagtgagagagcaagaccctgtctcaaaaaaaaaaaaaaaaaaaaaaaacaagaagttattatagaaatgattcatttcaataaaaaaagaaagaaatgattcatttcctacttacagactttttaaagccacattcagtattctcactacctctaggttttgctaacatctactttggttagcactagaaaatttaattttttttgtcaggaaagcacagtaataaattgcctactgttgcctaccacaataatgaaagtctgaaataagtaggaaatgcattaagttacccacatgtccagagtaggcaaatctatagagacagaaagattagtgattgcttagaaatggaaatatgaggctgggtgccgtggctcacacctgtaaccccagcactttgggaggccgaggcgggtggatcatgaggtcaggagatcgagaccatcctggccaacatggggaaaccccgtttctactaaaaatacaaaaaattagccgggcgtgatggcagatgcctgtagtcccagctacttgggaggctgaggcagaagaatggcatgaacccgggaggcggagcttgcagtgagctgagatcgtgccactgcactccagcctgggtgacagagcaagactccgtctcaaaaaaaaaaaaaaagaaatggaaatatgagggtgaggacccagtgaatgacaggtaatgagtatggagtttcttttaagggagacaaaaatgttctaacattgattgtggtgatggttgcacaatcctgtgagtatactaaaatccaatgaattatatactttaaatgggtgaattatatggtatgtgaattacatctcgaagtcattttttttaaatgatggggaaatcaaagtctgaaaataagacctgcttaaaagaaattttgacagtcgatgttgatattaactactttttcctgaaataataaaccataatccttttccagaccttcatcctcttttcctaatacattttccagagaaagcaatggaatttgagaagatggctaagttcagatttatacaaactagatagaaactttgataatagtttgcaactgttgatattttctatcagatagaatactgaaattatcctcagtagtaggcttttcctctttgtgaggaaggaaacattggtagattttgttacttatcttctatagaaaatgactatagttatacagatgaaaagctgtactttgactacaaaagggaatgcaggagttattgttgggtgctacttagttacagcatactcccatttcatatcccctccagttaaaagctttgagattcatctagaacattactccaggtgactgacactcttaaacattgagcccattttcctgtatctagtgctgtttggcgatattcttctggactgtaaggaaaaaatggatttggccatacagtatcacatagatggattgtttttgctgtggtctatgaaaatgagccacatgctatcttttatttatttgtttggttatttttacagcttatctcactttggtggaagtcttcttgggctttcaattttaaagttttagctaattggatgtcttggacctgttttatttcagggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtaggaatcctggaggaactcttcccaaagagttttgaataagttattaaatcatttatttcagttacaacaccatgttgtaactttagtaaactaagtggtatacagatgcccaaggtttgttctgtggtcatgtgaaaaaattgtcagtcatttttagcatagaaaacttgagaattattctttcaagccaaaaatgttttacagtagaacttggatcaagaaaagaggtactaggctgggtgcagtggctgacacctgtaatcccagcactttgggaggcctaggcaagaggatcgcttgagcccagcagttggagaccagcctgggcaacagcaagaccctgtctctattaaaaaaaaaaaaaaaaaaaaaagtaccgcaagtagttttacaaaaggaccctttggaagcagtgttgtaaaattatttcttaaatctggaaagaagttgaatttttgtatatggtcagtttggtgtgatttctcatgtatttttacattttatgaaactattgccttttataagttaaaatattcctttgttctattgattgattgattgattgattgagatagagtgtctcgctctgttgccctggctggagtgcagtggcacgatcttggttcactccaccttctgcctcccaggctcaagcgattctcctgcctcagccttccgagcagctgggattacaggtgcctgccaccacgcctggctaatttttatatgtttagtagagacagggtttcaccatgttggccaggctggtctcaaactcctaaccttgggtggtccacctgcctcagcctcccaaagtgctgggattacaggcgtgagccacctgcctgacccctttgttctatttatttcaatgtttagaacagatgaagtatgtggaattgaacggaattggatttttattttattttaatgagcatcatgaggtagtcagtgagtattggcttttttgacaaggaaaattacccaaatcacccaagagttccattaagaaacaaagctgtgaatcaaaatcgtacaatgctttgctaacatttgaccttatttccttatagaaacaaaaagggctgtagaaagggaaaaaagaaaagactaacaagtatagagggtcaccagatgttttctagaaaatatgctaggtactgtgcaaatattgccacattttagttaattttcaaatgtggctgggcgtggtggctcacgtctgtaatcccagcactttgggaggctgagacgggcagatcacctgaggttgggagtttgagaccagcctgaccaacatggagaaacccgtctctactaaaaatacaaaattaccaggtgaggtggtgcatgcctgtaatcctagctacccgggaggctgaggcaggagaatcgcttgaacccagaaggcaaaggttgcagtgagccaagatcacgccattgtactccagcctgggcaacaagagcggaattccgtctcaaaaaaaaaaaaaaaagtgacagtaatgttttgagcagattatttagagctagaataaaaacaaatgtggcctgcttcctttctagcattgtttagttcaattgggaaaacattttttagactgttgtatacttattataggcagaaatcgtgtaggataatgtctatagaaattatgttttatttgaatgttcttttaaaatgaaaattttctttacagaacttatgttgtggaatagatctttccaacaaggtttctcatattcttatagttttttatatgtaataaaacaatagagaaatattttgccaccaggtgactctcctattccatctgtttcttcgggatcatcttcacctctttcagccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcaggtacaattgccttgctctctctctggagggatatcttaagtaagctgtaggtttgccattaaaacttagttccttagaaaaaacaaacaaaaaaaacttagttcctatgtttaacactcaattagggaagggtgtttatatctttgaggagttcagtccaatttcagagtctggaatattggttgaggtaatacatagagttaatcagaaacaaaagattcaaagtgtgtgtcctttctctcttaaataatcatttgagttctttcagagagtacttaatcttttaaaagacagggtaaagtggagtattcagaggactttacctagtttttcaggaactggttttttttggctagcaagactgtgataaatacgctttgagctcttcagaggaaagatttcagtaacatttggtcatgtttggtaataacaatggtaatgttttgttgttttatccaaataaatttaaaactttgttttcaattattctttccagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaagtgagttgacaaacatcactgtaacttgattgacactttgtcagccaatgtagtcacattaaggaataccttgtattgaaataatgctcccttttgtttctgtggctttgctagatcttttgcttaatttcaggagtgcacagagttgtccacagtagtttgtcctgaagatgtccccatcccccgaaaacacctgagggatttgggttttgccactttgtgctctgctactacagctttgagggaggcctctacccctcttaaaagctggccatgagttcactgatgctttcttgtctgctctgacagctttatgtcggcaatcaattatgtagagttcccattttcttcttagctcaagcttattcatgaaactaaaatatgggaaagttgaggttatttttatcaaatatgagaaatttcctgatgatttcatattggatttagtttctttctctctcttgttttttgttgaaaagctttgcagatgcagataaacattttgttttctcaacactgccatactgtacttataggatcttttggagttctttaaatgaggaatattagagaagtctaagctggtattatgggatttatagtaattttataatttatagtaattttaagattaaatcttttttcctgctgttttagggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggtaaaatgggcttaatgctcttttgttttttagatttgtcacatcattctttttgttttgtgagaagtataagtactgaatatcaaaagtcataattgaccatttcgatctggattgctttttcaatatcaagatgatgctactgaacactttatttaatatatgtgtattcttcctaggcagaaacagtgaattgccattgcatttatatattcattttgtaactgtctaaagattcctaattagaaattccaatttttcctcccccttttcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagtctttagaagtggggtgtgatcctttcagtggtcatgcaggtaccactcaatccacattatattgaaccagatggttaatactatatttgtaacaggcttctcacatttaacacttgagtcccttcttagactgccttaaaaaagcacttttaagactatttacctatttattctgtgttaaacattccttgttcccttgttgtcttccataatcctttaacatatgagaaagtttcaagctctggcaatgtgtcttatctgactttagctagcagataggccactgataggttttttctctatggatcatgagaatgtcaataagaacaattggatttaaatcagatgacactaaacaaatgtagggacacccaaattatcaacttcaggttccttctgtgcttcctgaccttttttatctgaaagatttgtctggttatagatattttaagctttatatgagttgggacataaggaggtgactcctgtcattctgttgtattattgaatcagctgagtaatatttataaatatgtgagtaattccaggcttagttccatggccctaagcatggagagtcaatatgtttaacaagctaaacagaggaaccctggaatgggctgctttggccaaaccataggctatgccgagaatcagcatagagaaggaaaagttatcccactgaaaagtatagtcatcaacttatttgtgttttaatatagctgaatttttcctggtcagtataggcaatacagaaaagaaaacaagaaaatgtttggagctgatggagaagccaaaactcatatcaaggcaaagaaggatgcacagagaaagagtagtaactagggacagaactatattagcagcacctttctacgcttatgccaacaggaattcttaattttctctgcccaggtcctaaagccaggaccacatcagacacaccatgtttgttctgtgtcagatatacctgcttctttaatcttctatatcatcttacatatgagaaagcttccttaattaagcttatgtcttatgttttgttttgaatggattttgaaagtgttgtttattgaagctactactttgtagtgattgataaccacatcaagtatcattaaggggccccttgacctttgtgggggcagttgggtggggcacaaaagactccttggatcacctgtgtatcttgctgtttccacttaccattaacagcaacaagaaaaatcacctaaaattggtgaaatgaatgaaactactcttgatgaaatatatactagtgagaaataatattaaataaattattcagtgggacaaaaaggtgagttttattctatcttaactgtctacaatacatttgaattgtctggaggagccttaagtccatattctgcaccttgaggacaaccaaatgagaaattttatttcaggtcagtaagtagaatttatgaagagaaaggagataattatgaggaatccctaggaaaattgggaggaaaacaacagttgtatagttgggagtagttctttaggatacgctcctcccttccttcttaccagcacttccttcctttctttctgactatttggatcccagtagcctgctcccaacctcatttcacctgctaaatctcttcttcctctgcctgcctcttcctggcactactttactgctattttaccaacctgaacatttggataaaacctagctcaggtaagaacttaattactttcaaaatatacaagggatatgggaggagacagcatggatacagtggagcagtagtcagtagtcagagcctaaattctattttcatttctgccgcttgaagctttatggccttaggcaaatcatctcacctttctgggtttcacttttctcatctgaaattgaactcaagagtcttctagttctaacacaggatttcttcttgtgaatgagaatataagatatggaaatatttgaagccattagattgtttacagtgctgagatttgagagcccctagcattggttctgataaggaatcgaaataaatcctgccattattatgggggccagtattgagattttagtggaggcagaagaagaccttgcacatctttagtgagccttcaagttgtgaagaaacatcctgctaaggtatagatcaaacccagtgaaatgaaactataggaatgaaactacatcatcaaggtttctggacccacttatttcaacttgtgttcaatgtaataaaattccgctaccaataaaattattaatgttttaagaccctttaaacctattgtggctacagtgtgctgacttgcccttttataggccagtctgcttccttcagtccctgctctcaaaggggaaatcccatcacctcagctaaccagaccgaagaagagaattggacggccgatggtggcctctcctaaccagaggtaagaaatttcaggacttggaactacggtttccctctcttcatgtagattctggccaagtcctccccacaatccgaaaactagtgcaagagaggaccatccttagtttaagttaacttacagaagtggaggccgggcatggtggcttacgcttgtaatcccagcactttgggaggccgaggtgggtggattatctgaggtcaggagtttgagaccagcttgggcaacatggtgaaaccccatctctactaaaaatacaaaagttagccaggtgtggtggcatgtgcctgtaatcccagctactcagcaggctgaggcaggagaatcgctagaacccaggaggtggaagctgcagtgagccaagatcacgctactgcactccagcctgggcaacagagcaagactctctctcaaaaaaaaaaaaaagaaaagaaaagaaaagaaagggaaaggctggctacattataatttcaagccagagagaggagtacttagtatatgtggttccttcccactgtttaagacctttggggccgggtgcggtggctcatgcctgtaatcccagcactttgggaggctgaagcgggtggatcacctgaggtcaggagttcgagaccagtctgggcaacatggtgaaaccccgtctctactaaaaatacaaaaattagccgggcgtggtggcatgcacctgtaatcccagctactcagaaggctgaggcaggagaatcgcctgaacccaggaggcggaggttgcagtgagctgagatcatgccattgcactccagcctgggtgacaagaacgagacttcgtctcaaaaaaaaaaaaaaaaaagacctttggaccacattgtaaatccaagaaaaggcaagcaagcttgtaggaaaacagcttctgaatgaacatcttgttctctgactagcaagaagtatttctaccaagacatacaactggttatgatgtcttcccagtggaccctgccccctatagtgaggggctctggtaatgctgcattttctatttatcctcagtgatttgtcatttgcaaacaggcaggttcatgcgcctccatcctctcctttaggcaatgggtgagagaaaggtggttttaagcatcaaaaacttaagtgtgttaagaccacctccaataaaaggcatgaccctgggcttcaacacctaatttggaaaagatcatgaatcagacgatcttgtttgcaaacctattttgtgattacttttcacattctgttttatcttgatggtatattaatgtgaatccaaagtaatttgcctgataacagagacctggtatttccttataggcttaatcagatctctgggggtggggcctgggcataggtattttttttaaacacttccatattctaataggtaattagttgttttttgttttttgttttttaatgagacagagtctcactctgttgcttaggctggagtgcagtggcgccatgttggctcactgcaacctccgcctcctgagttcaagcaattctcctgcctcagcctcccaagtagctgggattacaggtgcacaccaccacacttggctaatttttgtatttttagtagagatggggtttctccatgtttgccaggctggtcttgaactcctgacctcaagtgatttgcccgcctcagcctcccagagtgctgggattacaggcgtgaaccgccttgcccagccagtaattagtattgaccctctgatttaaattcttgtttcttcatccagattgcatggatgatgaatctggctttctctctaaagccaattacctattccccagcccttacagcacacagtgactccagaagagttagctgcaagcagtagtcattatagtagtagtaactgtggctattattttgtggtagagattagtagaaggaagacctcacttcgacaatgaccgttcttgaaaacttttgatacttttctcctgattttcctatttccgactcatctttctcagtctcttttggtgaattctttttctctactatcttttaaataaataaatgttgatgtgcccaggcttctacactgtatcttctccccagatgatctcatcccacatttatttatttataaatagagatagggtcttgctgtattgcccaggtcttgagctcctgggctcaagcggtcctcccacctcagcctcccaaaatgccagaattaacagatgtgagctaccgatcctagcccatccccacactcttgaatttcacaccacccaaatttgagccactaactcagagttctccccatggcttcactatatctagcttcctcctgtgctccatctgaacacatattattcattccctcatataagatatgctgctcttcttgttttccctatcatattagttggtgctactagccaccaagactctcaagccaaaagactgaaaattatcctagtttacactttccctcaccccactcttaatcagtcactttattcttcctctgtgtatctgaatctcatccacttctctccatcctcacagccatcgcccgtttgcccacctggtttcactagactggactctaccctcaaatctcaccatcctccaccctattctcccattccccctgtcagacacttcctcacgttgcataaaaggttagttatcataaatgattcactacaatctgttcccaagctttaccctccagcactgctaagacacttcattttggcatgcaccattttgtaagatactcaaaatccttttcgggacaataaaatatacatacccttgatacctgaagtgtgtttctgaggccctgaagcgtttgcattactgtattaaaaactcacagttgcagtcaggcccggtggctcatgcctgtaactccagcactttgggaggccaagccaggcagatcactggagatcaggagttcgagaccagcttggccaagatagtgaaacctgatgtctgctaaaaatacaaaaaattagcccggtgcggtggtgggttcctgtaattccagctactcaggaggctgaggcaggagaatcgcttgaacccaggaggcagaggttgcagtgagctgagatcatgccactgaactctagcctgggtgacagagcaagactccatcttaaaaaaaaaaaaaaaccagccaggtgtggtggcttatgcctgtaatcgtagcactttgggaggccgaggcaggctgatcacctgaggtcgggagttcaagaccagcctgaccaacatggagaaactctgtttctactaaaattacaaaattagctgggtgtggtggtacatgcctgtaatcccaactactcaggaggctgaggcaggagaatcgcttaaacccgggaatcggaggttgcggtgagccaagatcatgccatttgggcggcaagagcgaaactccatctcaaaaaaaaaaaaaaaaaatccacaactggctgggcacggtggctcatgcctgtaattcttgtttcggaggatgcctgtttgggaggatcgcttgggcccacaagtttgagaccagcctgggcaacatagtgagaccccgcctttacaaaaaatttaaaaattagccaggtacagtggcatgcacctgtggtcccagctattgaggacactgaagtgggagggtcacctgagcccaggaggttgaggctgcagtgagccatgattgtaccactacactccagcttgggtgacagtgagaccctgtgtcaaaaaaaaaaaaaaatccaaaatctcacccagaccaatactgtatcagaattatcattttaacaatatctccagatgatttatatgcacattaaagtttgagaagctggccaggtgtggtggctcacaccagcactttgggaggccgaggcagataggttacttgagctcaggaattcgagaccagcctgggcaacatggtgaaaccttgtctctataaaaaatccaaaaattagcccggtgtggtggtgggcacctgtggtcccagctactcaggaggctgaggtgggaggatggcctgaacccaggaggcagagtttgcattgagctgagattacaccactgcattccagcctaggcagcagagcaaaaccctatctcagaaaataaatagtttgagaagcaatctttttttaaatgagtgaagaaatcagacctaaggagaaatctgatgaagccagagctgagttaatattgataaatggatgcagtcaggtggtctatacttaatttttggtgaggggaagggacagtggaggcagtattgattttgaggaagccaaacaggacagcctgatgaattcaagatttccagcatatatacatcttcaccaatcccaccaccttgctccagcctgtcatatcactgtgtctacataaaaaaaaaaaacaaaaaaaaaactccaaggccaaactctctgacctttctttccttctaaagaccaagccctcctcactagccccctgcccctccttagttaactggcaaagagatcaaagggcaggccttctgactggtgatgcctcagctgtagcccccaaacttgactcatccttttattagtccaggtaccacttcttcagaaagatgaccagccctcactgaccttccccttcctgctgtgctccaggccatcaaggcatgtgtcacccaggctggagtgcagtggtgcaatctccgctcactgcaacctccgcctcctgggttcaacctatccttccacctcagcttcccgagtagctgggtctacaggcgcatgctgccgcacccggctaatttttgtatttttagtagagtctaggtttcaccatgttgcccaggctggtctcagactcctgggctcaagctatccacccgccttagcctcccaaagtgctgggattacaggccgtgagccaccgcacccggccttgtactgttactgtttatgggaggcagtacacagctgggcttaagggcacagtcctggaatcagatgcagtcagatttgaatcccagcttcccttcctgcaagatgtgtgactttggctaatcatagtgctttactatccaaaagttggcaaggaatgggtgaactaatacaggataaaaacgcttgccctacttcacctgcccccagctcccggctataaacagtaaatagctgagctgctgcagcactcaggcaggttggccagcgctgggccagcaggaactggaagctggtgtggggcctgggactttggacgcatttccagctttctctgaaccgggctggcttcctagcagatagggcgggaccgtcgggttgagtgacggccggtggcccgccctgggcgtgacgttgttctagtgttgttgccagcagctgcacgtggtcggctgagtccgcctcagactcagagctgcgctcctcgacctcaacgccaggcggttactttgctgctcctcccgctcgctatgtcaacgtccactagctgcccgattcccgggggccgggaccagctgcccgactgctacagcaccacgccggggggcacgctatacgccactacccccggaggtcagcgggccgggcaggggtccgcaggctgcggacatattagcgcgtgcgtgttgttgcggggcgggggtaggggagggacagacctaagacttgtccgcaggcccctctacaggttgtagctttgggggagaatgtttggagcggaagctcagttcccaaaaacttctaagtgatgcaacaaggccatgagcctagcttccgggtgtttgggctgtaatccttcactgtggcctgggttcttggagccttacacacgctccttacccctcgcgactttgcttcctaggaataggggccagggccccctactgagcgtgacctcagccggaagcaccgggtcttgagaagtggagtagttagaacagttggggcagttgctccgtttttgtgctgctggctggcgtctgtttggttgggcgagcagcctgggatcacgagctgctgggctcccgacccagggattcctgccacgcggaagcggaggggaggaacagggcaggaccctttgaggacattatgcgggccaagttcctctgagctagtgtgaaccttataggacctgggaggggtcaggattagaacagtacgtttctcctccctgcaggagatagcccaggtaacagcactgggtggaacccttcacaactgctatttcacttcttgaaccacctgaggctgttagtctaggtctcaccttcactggtgagaccaaagcagaggtttcagagtggtagaggagcagcatgaagtacctgaactcaaagtttggtgttcctcttagagccaagatctgaagctctcccaaacataaagcccctgcctataccagctgggatgccccccttgctttatacccacatcttggttaggtctggaagattttaagcactatgaaggcttgtctgctgagaacctagctgggcttcagagccgatgtcctttgatacacagggaaatttgacaccaccctcacctccaggccccaaaaggcctgagtctgggaccccagtcacctcggtacccaagctcctgactcttacctcagtcccaaccccttgacaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccggtaaggaaagcaggaattaagaattgtcccagcctttgagttcaaatgccactgtgacacagtgcgggggttcagttccaagaggggtttctgcactgatgctgagcctgcagatcctcagaccagcaacctgtcttcctgccttttctctctccagatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaatg

SEQ ID NO: 38054 - DNA, 262053 bp, Homo sapiens; identical to SEQ ID NO: 37952

SEQ ID NO: 38055 - DNA, 6999 bp, Homo sapiens
cccggaacccgcggtcgccaccgcggcggcggccccaggctggaggcgtccgggcgcctctttcctccagcctctgggactgcgctgctcgcagtctcctcgccctgcctgggcttgagaaacctagtgcataccccaaagagggtttttgtgtatgtgtgtgtttttaaagggtggctatgatgactgggccttggagatgtgagactgggtaagtctatcgtttactttgcaaaagaggtgtgtgtgtgtgtgtgtgtgtgtgtgtgtgtgtgtgtgtgtgtgtgtgtgtgtctatgtggcggggtggttttccttccctctcctccctccccttcttcctccgttttcccttccttctctttggggcggggtgggggagggggagcctcgcgtcctggaactccgggtgcttctgcctgggctgctgcttgagcagctgtgcccggagcctccggtgcggcctgggtgctgggctccagtccgagaggctccatgctgcttactgcagggacgtacagggcggtgatccagtatctaaattctttgggagaaaatgaatagttcccccgcccccgccctccaggaaaaaaaaaaatctgagaatctgagaatgttcagcgcacccgcgaatttgcatcggaggtgcgtttccccgtcagaatgtcagcctccccaggctcattcaactttattttctcaaatttttggtctcctttgctagcaaggaggagggggaagggagtgggttgagaggaagctcttcgacccttgctaactagaactgaattaaagttgtaaacgctggagtttaatactggctggactgaatttgcaatgggctttcagatggggtgggaggtgaatgggggcggggaagcacagggagggagggggaggggacccaacctcgctgaatggatgtgcggatttgatccagcggagaactgaaatttcaaggtaaacgttttgctttcactggggtggggatgtttttgccgcttttaagccgggagacgtttaccgttgcgttgggaggtcggggatacttgcgaggtttatgcactgtggttccaattcatctcgacacgtctgggtggccacacgtgaatgattcgcaggcacactgatacatgtgcgtttgaatgcaggggcgtttaataacgcgggctggagtcgacttggggatcaggagcaaggtctccaggcttgaacccgctgtctcggaaacatcttggctttagtttggagttgcaattcgatattagacttcggtagtgaggcaaaggcaaggttgaccagagaaaaggcataggttcctagagtccagcatttctatcaaatgtcctccaccccattaaccaacgcagcatgcgcgcgcgcgcacacacaaacacacacacacacacacacacacacacacacacgctcattccatttatgtccttcctttaagagtgctgctgttgatcagaagtaggaagtggaaggaagccttcaaggggacaaaaagagagcaagaaaaaaaagggggagggggtcatattgattcctgtgggagatgaaattcggatattaaacaactgacctaagtcgcttacagttcttcctcccacctttctattttgcctcttaatcagcccaggcgtcctttccctgagattaaaaaaaagagagaggggagcgttaacaattaaatgtaataagcaactccaaagatggggatgctgtcgaggtggtagttccgtgcaaaccttgctattaccgttgcaaatagacgcggagcccaaggtaagggaggctttcgtgctgatccttggtgtactgattcccggtaagcggtaggaacgtcctttttaaactctaggcatcgggaggtattcggagattgcggataccttcgctgagttctttgtaatccatcgtgcagaactatttcagtggcttaaagatgcggtttggtagcgtcgctgacatgatcaatgagaagtggtcgcagggcgctctccgggaagcgctgctaagtggtaccgtgcatgcaattaggacgctgatgtgctttaatagcgtggtagtgaagtccaccatcaaagcaaatgcgctctccttttttctccttactcaaagctccgggagacaattggtgatttaagagcttcttggggctcctttgatgcattatattacagcctttttgcctctgaaaagtatcctttaggttcccaccgtggcatttctagcgatggtttaaaataccccaagtattttggctccttgcctctctgtgaacatgagagaccttcacggtgaactgttaactgaagaggctctgaaagaaagaagggggggtgggggctgggtataggtgaggtggggaaccttgtaaaatggtgcttcttttttcttaaattagaaccatgaaactgaactgacagccattttatgtatatttatggattggttttgaaaagggggggagaagagaaaactaaaatgggactttatctaacctgctcttatcttgtaaggagcagcatatttgtggtgtgctcatttaaaaaaattaatcaacctttaaatcaaaatgtataatagattttaataaaatctagagaatgtcaatgtttcacttggggaggtgtgtcatttgtatctcttccttttgggttttagagtaataatgttaagaaagagagagactttctgactgatcccttaaatttttgtcatattctgttatttccttgttttctctctcccttacaggaggtaaaatgcacacttgctgccccccagtaactttggaacaggaccttcacagaaaaatgcatagctggatgctgcagactctagcgtttgctgtaacatctctcgtcctttcgtgtgcagaaaccatcgattattatggggaaatctgtgacaatgcatgtccttgtgaggaaaaggacggcattttaactgtgagctgtgaaaaccgggggatcatcagtctctctgaaattagccctccccgtttcccaatctaccacctcttgttgtccggaaaccttttgaaccgtctctatcccaatgagtttgtcaattacactggggcttcaattttgcatctaggtagcaatgttatccaggacattgagaccggggctttccatgggctacggggtttgaggagattgcatctaaacaataataaactggaacttctgcgagatgataccttccttggcttggagaacctggagtacctacaggtcgattacaactacatcagcgtcattgaacccaatgcttttgggaaactgcatttgttgcaggtgcttatcctcaatgacaatcttttgtccagtttacccaacaatcttttccgttttgtgcccttaacgcacttggacctccgggggaaccggctgaaacttctgccctacgtggggctcttgcagcacatggataaagttgtggagctacagctggaggaaaacccttggaattgttcttgtgagctgatctctctaaaggattggttggacagcatctcctattcagccctggtgggggatgtagtttgtgagacccccttccgcttacacggaagggacttggacgaggtatccaagcaggaactttgcccaaggagacttatttctgactacgagatgaggccgcagacgcctttgagcaccacggggtatttacacaccaccccggcgtcagtgaattctgtggccacttcttcctctgctgtttacaaaccccctttgaagccccctaaggggactcgccaacccaacaagcccagggtgcgccccacctctcggcagccctctaaggacttgggctacagcaactatggccccagcatcgcctatcagaccaaatccccggtgcctttggagtgtcccaccgcgtgctcttgcaacctgcagatctctgatctgggcctcaacgtaaactgccaggagcgaaagatcgagagcatcgctgaactgcagcccaagccctacaatcccaagaaaatgtatctgacagagaactacatcgctgtcgtgcgcaggacagacttcctggaggccacggggctggacctcctgcacctggggaataaccgcatctcgatgatccaggaccgcgctttcggggatctcaccaacctgaggcgcctctacctgaatggcaacaggatcgagaggctgagcccggagttattctatggcctgcagagcctgcagtatctcttcctccagtacaatctcatccgcgagattcagtctggaacttttgacccggtcccaaacctccagctgctattcttgaataacaacctcctgcaggccatgccctcaggcgtcttctctggcttgaccctcctcaggctaaacctgaggagtaaccacttcacctccttgccagtgagtggagttttggaccagctgaagtcactcatccaaatcgacctgcatgacaatccttgggattgtacctgtgacattgtgggcatgaagctgtgggtggagcagctcaaagtgggcgtcctagtggacgaggtgatctgtaaggcgcccaaaaaattcgctgagaccgacatgcgctccattaagtcggagctgctgtgccctgactattcagatgtagtagtttccacgcccacaccctcctctatccaggtccctgcgaggaccagcgccgtgactcctgcggtccggttgaatagcaccggggcccccgcgagcttgggcgcaggcggaggggcgtcgtcggtgcccttgtctgtgttaattctcagcctcctgctggttttcatcatgtccgtcttcgtggccgccgggctcttcgtgctggtcatgaagcgcaggaagaagaaccagagcgaccacaccagcaccaacaactccgacgtgagctcctttaacatgcagtacagcgtgtacggcggcggcggcggcacgggcggccacccacacgcgcacgtgcatcaccgcgggcccgcgctgcccaaggtgaagacgcccgcgggccacgtgtatgaatacatcccccacccactgggccacatgtgcaaaaaccccatctaccgctcccgagagggcaactccgtagaggattacaaagacctgcacgagctcaaggtcacctacagcagcaaccaccacctgcagcagcagcagcagccgccgccgccaccgcagcagccacagcagcagcccccgccgcagctgcagctgcagcccggggaggaggagaggcgggaaagccaccacttgcggagccccgcctacagcgtcagcaccatcgagccccgggaggacctgctgtcgccggtgcaggacgccgaccgcttttacaggggcattttagaaccagacaaacactgctccaccacccccgccggcaatagcctcccggaatatcccaaattcccgtgcagccccgctgcttacactttctcccccaactatgacctgagacgcccccatcagtatttgcacccgggggcaggggacagcaggctacgggaaccggtgctctacagccccccgagtgctgtctttgtagaacccaaccggaacgaatatctggagttaaaagcaaaactaaacgttgagccggactacctcgaagtgctggaaaaacagaccacgtttagccagttctaaaagcaaagaaactctcttggagcttttgcatttaaaacaaacaagcaagcagacacacacagtgaacacatttgattaattgtgttgtttcaacgtttagggtgaagtgccttggcacgggatttctcagcttcggtggaagatacgaaaagggtgtgcaatttcctttaaaatttacacgtgggaaacatttgtgtaaactgggcacatcactttctcttcttgcgtgtggggcaggtgtggagaagggctttaaggaggccaatttgctgcgcgggtgacctgtgaaaggtcacagtcatttttgtagtggttggaagtgctaagaatggtggatgatggcagagcatagattctactcttcctcttttgcttcctccccctcccccgcccctgccccacctctctttctccccttttaagccatgggtgggtctaactggcttttgtggagaaattagcacaccccaactttaataggaaatttgttctctttttccgcccctctccttctctcctcccctcccctcccttctcattccttttctttgtttttaaaggatgtgtttgtatgcattctggacatttgaattaaaaaaaaagtattgtgatcctgtaaaggatcaccatagatgtggacaaatcattaaaattacagagctatatgatccataattgattagtcaaaataacttattgatgaaatatacaaatattttattgtagcacctatttttatatgcacatttagcattcctctttccttcactatttagcctatgattttgcagaggtgtcacactgtattaggatctgcatttctaaaactgacgtggtatcaggaaggcattttcaatcattcaaaatgtggagaatttaatggctaaatctttaaaagccaatgcaacccacccaattgaatctgcattttcttttaagaaaacagagctgattgtatcccaatgtattttaaaaaatagggcaattgattgggccattccgagagaattgtttgcaagttttgggttttattagaaaatatttgaaagtatttttattaatgaaccaaaatgacatgttcatttgactactattgtagccgattttcgattgtttaaccaaacccagttgcatttgtacagatccacgtgtactggcacctcagaagaccaaatcatggactgtacaagtctctatacaatgtctttatccctgtgggcagcaagcaatgatgataatgacaaacaggatatctgtaagatggggctactgttgttacagtctcatatgtatcccagcacatgtaattttttaaatagtttctgaataaacacttgataactatgtc

SEQ ID NO: 38056 - DNA, 104986 bp, Homo sapiens
aatgagatcctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggtaatgcctgcgcgtccccagcccttggcaacctagggcggcgcgccccagaggcgggagagtaacggctccgggacactcggccctgttgggtctggccacgggcccacgcctcctctgtaggttcccgggtcttcctgccccgggcttcccgtgccctaggcggtcagtccgcccgctccctcaggactgatcgccgggatccccgggtgagcacctcgcgacgcgttggtgattgcaggactcccttcttgcctcctcgcccctcctgctggccctgtcggggaggctgttctgcgtcccggtggctccggctataccccttgcgggcggaggaagcggagcggggactctggtttgggtgctaggggcactgggtcgagttcttagagaaacaggccttggtggccatagttcttccccgcgttccctctgtggaactctcggtgtccagagtttggggtgtagaagggcggatgaggagcgacgcgactctgaagagttgcagttgggctgtgagctgcaggatttccgccgtctctggtgctgtgggagccgatgggccgggggaggcgttcctgggaaggttaatggagtaattattgccccttctttctcccttcctacctatctagttagaattgggcctagaaccgggaaagactaaatgccaagtgggactgggggaaacgttgtttggtttacagaaactggcgtttggggattaggccccgccagggaggctgggcgcgccaactttgcatccctcagcctactccccaggaactcgcctggtttaattttttttgttttgttttgtttttttgagcgagttgaggtctgtattgtgtgtcttacgggtgacggttcgtgtttgggcgctggaaggagcgggctttctgggcgcccctaccacccccgccccataaccgctttccagactccgcctgctggtgttctctggttaccggagtgggtgttgcagagcctcgggtgcacctgctcctttctttccctagcaccttcctggtgaggacccctgaacaccaatataatacagagtttttgaattgaaggtaaacctggtatttatgtagtgacgaggttattttattatgaagtacagtagcttttaaatgagcaaacatttttaaaatcatcggatatacgaggttgttacatagtttgagtaacaggaagctcgatcaatcagaggagtaaactttggcatagactattaaaggatagttagggctaaccatctttgttacactgttccgaaatagatatcactttgctgtttggtaagatttcagaagtttaggggatttaagcatttatgcatatcacactattttccaaaagaattgaggtaacttaaatttaaaatatgaataagttatatttttccccttcttttgatctttctaaacatactttagaccaaaactgaagtattttttattctgtatttcatagcgtaagtaatttacttaagtgatacatatttttaatcctaattaggaaacagctttgaagtgtggagcgggaaaggagcagtttctgagctgcaaaaactagtttctaaacaggtaatttgacattattatctgtattatcctttgtattagagttggagaagactttatggtggacactgctgtcacagttacagtgcatgactgaggatcctctctgcttagtaaacaaactttctgggttcaccgccctgtttgctctgcttttcggcgtgctgctttggcctgccggtatatctttgttcggaaaggccctgtcattcctaattattaattactagaatggtttatgcagtaccgtttgaaatttatttgtcttcacagaattttttcaacctgtttgaatttgtcctataactggatagcctctctttccaaatccatttaatctcaagttctctcctacaacattcctattaattggctgttcatgaactctacttgtcgaacttgttataccttgaccgaaatttagttgtctaaaattactttattattattttttgtacttcgatctccctttcctggtataaagttacttgaaacattacttttagcgcatagtacattgtcacatgcaagtgacataaaggtattctctgtccagcagaataaagtcagtgttgtagaatgtaagttcactaggagaagttcaataattgtttgcaaagggcagtttggaaaaatggctaaaagataattagaagtttgttaaaagctttttagaaataattgctcttcagaaaaaaacctcagaaataaataacctaaatttaattctactcttaaaattttaagaaagttcattttgaaagttttgtagaaattggctgggcgcagtggctcacgcctgtaatcccagcactttgggaggccgaggtgggcggatgacgaggtcaggagatcaagaccatccggctaacatggtgaaaccccatctctactaaaaatacaaaaaagattagccaggcgtggtggcgggcacctgtagtcccagctactctggaggcagaggcaggagaatggcgtgaacctgggagcaggaggttgcagtgagccaagattgtgccactgcaccccagcctaggcaacagagtgtgactccgtctcaaaaaaaaagaaacttttgtagaaatcaatatatattcttgctttctacaaaagcagacagatttttattttatagctctcctatgaggacctgaaatgagactgtcatgagaaaatacgaataggtagttgatgtatatcttaattataattctcagtgggtttttttttttttaaactggaagactaacaaaacagggcaagaaaaatggaactcaagggaaaggtcacatgtgaatgtgtgtgttagagttgttaatactacagtgattgctgtatggtgggctttagtaaaataaacaataattacaaaattagttataagattttccttttagcacattggggaagatgatggataagacgaataaaaataaagggtaattgagttaacttaaattggaagacctgggttttttcaataggagatttggccatttttttctgaaggaggaaagtggatttgagacttggagaaactagtaaggctgtgagattcacagtacagaactaagaagacaaccagaaatacctatcagtactttcatttttacggatttgagtgctaggcaacgtgctatgtaatgactactacagataaaacagtgtgcaaaacagacagggtgcctttcttcatggagtaaatttacattttaaaagtatctatgtgtatgtagagtgtagtatatcttaatagtgatcacaggcaatgccattttatgatcatttccccactttttgacagcttgagaatagtagcagagaaaacagacagtggagtttagccagaattgagtcgacacagtacgcaagtaggtgaggaagtgaaggatgctagctagcaaggcatttttgcaatgacttagttgggtttgggtttgagtaaagaatcaagggattgatggatttagggagagagaaacgatcaaggggctggtagtattcaggaaggctaagagcagtttcagcaggaatcaagtgagagaagtagaatgcaaaaacttatgatcagaaagaggaacttcagaagttcaggatcctgaacaaattatcagttcagtattggaatagagaagatgagatggatattggaattgaggccagagtcctagaaaagtcattgcaagtgtttagttcatgcaagcagggaatgaagtagaaagtgaaaccatgcgccagttactgtcaggaaaagtacaggcatatcttggatattttcagaggtgattatgagtaatttaatgccatttgagaaaaaaataatttttttcgttactgatcactttgatttttttttttttttttttggagacagagtcttgctctgttgtccaggctggagtgcagtggcattatcttggcttactgcatccctctcctcccgagttcaagcaattgattctccttactcagcctaccaaacagctgggattacaggaacgccccaccacacgtggctaatatttgcgtttttagtagaggcggagtttcgccatgttgaccaggcgaatcaagtgatccgcctgcctcagcttcccaaagtggtgggatcacaagtgtgagccactgcacccagcctgattatttgattactttgaatttcttctttaccttatattcttatttcaaaggtaaactgtagtcataggtattttcatggtaattaatactgtgatattctactgtaatatgtctctatagttagaatcctgcaacgggatgttcttttttttggcgatggagtcttgctctggcacccactggagtgcagcagcgcagtcttggctcactgcaacctctgcctcccaggttcaagtgattctcctgcctcagcctccctagtagctgggattacagacgcgtgccaccacgtccgactaatttttgtatttttaatatagatggggttttaacatgttgatcaggctagtcttcaactcctgacctcgtgatccgcccgcctcagcttccctaagtcctgggattacaagcgtgagccaccgcgcccagcctaacaggattttcttaaaaaaaaaaaaaaaaaaaagtcattgaaagtagcttaaaattgccatagtatattttcatttttgtgtctttgtaaaaaaaaaaaaaaaaccactaaggctgttaaaaatagctaaatgaaacttgaaagtaacagtttcaacttcgtttagtaaggcatagcatgagtagaagtgcgtgtttaaagtagaaggattttatttttatccccgttcagctacccgtagtactgtcatcaatcacttctaccaattgttttcctacagtttcaactttcttatcttactgtctttctgtttaacttgcatggcaaaatttcaaccttgggtggattcagtggagtgtttatattgagggatatgagcactgctggaaaaaaatatctgtagtatgtgttatatgagtgaatagtctctcgtttccctgagtccgtagtgctgcccacggtcattctccattccctacttttctacgctctctcagacactgctgtctcaccctcacatttaatgtacagtccttcctacttcacaacacttaggaacacctttggtttcctaccaccacatctgctaagcagcctccaacccattccatcctttcttggtttttttcaattaaagagatgttcttcttcctctctaaagctaatcatttgtcttttgctctagaccccaatggcccccgctttctcagagcccacatgctagttgcttatctcctttctcttctgcatttttagtatctccctcttttttttttttttttttttttttttttaaagtgaggcggagtttctctcttgttgcccaggctgagtgcaatggcactatctccgctcactgtaacctctgcctcccgggttcaaacgattctcctgcctcagcctctcttgtagctgggattacaggcatgtgccaccatacctggctaatttttgtatttttagtggaaacagggtttcgcagtttggaacaggctggtctcaaactcctgaccttagatgactcacccacctcagcctcccacagtgctggtattacaggcgtgagccaccgcacccgaccagtatctccctccttaccaacaaattgtaaacgtactcaagatacttctattttaataaaactttccttatgaccgtctgtgcttgcttctcatcataggctgattccttaaaaatattagctaatgactttctttattttttccctcttccttccaataatacattccagttatggaattgaccctcactacccctgctgaaatttctcaccaaagtcaacagtaaccttgttgctaaatctaggaggatacttctcagtacttctcttatctggcaaggtaactgtttggtttcttatcacattctacttgatacacttttccccttttggcaggctctcctggtttccctcctgtctttctgtaccttattagtgtattagcgtgtccttttcctctgcctctctatttaataccagtgtatttaagatctggtcttctcttactctttatcgtctccctgagtcctctgtcccactttttgagtggatgactctccagcccagatttctctgttgagagatagatcgctatttgtcaaccggacaattttattgggtgtattataggcacatcaaactctccatttctaaaacttgaactcatcatcatcctctctcaacaaagaaaacttgtttcttttctgatcagtttaactgtgtgtcacatacccagtttctagcaacctttatcctttatcttttaactctactatcctttaactcttctgcttctttatcgcccgtgttgtaatacagtagtctgccctattctgtgtgggataccttccagagacccccagtgcatgcctgaaactgtgggtagtaccaaactctatgtgtatgttatttcctgtatgtatgtaactgtgataaagtttaatttatagattaggctcagtaagagattaacaataactaataagacagaatagtcacaacagtatactgtaataaaagttacaagaatgtggtctctgtcgctcaaaataacgtactttactcaccagtttcctgaccatggttgactatggggaactataatcctgtaacacaaaactgcagataaggtggggactatagtcaccaactcctattgatcctgcacagcagttttgcttgaattggtattctgtacatccttagtcttttcgttattggaatacttccttttttttttttttttttttgagacagagtctcgctcttccgcccaggccggagtgcagtggtgttatctgggttcactacaagctccgcctcctgggttcacaccattctgcctcagcctcccgagtagctgggactacaggtgcccgccaccacgcctggctaattttttgtatttttagtagaggtgacagggtttcaccgtgttagccaggatggtctcgatctcctgacctcgtgatccgcctgccttggcctcccaaaatgctgggattacaggcgtgagccactgcgcctgaccgttactggaatactttctgtacttgtaagtactagtttatattaatgtgtttacagaataaaatttagaaggcagagattctgtatttgtaatggtgacatttaggtggttaaagaggttgacatgaagagaaataacatgccattactcttatgagggagatacttagtatttttgggaaatgttgtgaatgtggccgggtgcggtggctcacgcctgtaatcccagcactttgggaggccgaggcgggcggatcacgaggtcaggagatggagaccatcctggctaacatggtgaaaccctgtctctactaaagatacaacaaaaattagccaggcgtggtggcgggtgcctgtagtcccagctattggggaggctgaggcaggagaatgacgtgaacctgggaggcggagcttgtagtgagcccagatggcgccactgcactccagcctgggtgacagagcaagactctgtctccaaaaaaaaaaaagaattcatccatatgcaattatttctttagcttcatactaatagttttactttttaaaggcatactaatgctgtgccttttaaacacatttggtgtcatcattaagttacaaagtattctaccccctatggcaatcacagtgtaacagtggatgaaattgttcattttgccaacctgatagattagactttagtaaattttgttttaaaaaatactaaaaaaatcatctgtttttcccaaactaattagagtgtacagttttaaaattgttttagaaacttattttagtagtgttcaaagtcgttagccagaaataggtctttggaacaagctctgcattttagggggaatttattgtgatagggaaatagaatgcgtaaaacattctttctccagatatattcttttttttttttgagatggagtcttgctcttgcccaggctggagtgcagtggcgtgatctcagcacactgcaacctctgcctcccgggttcaattgattcttctgcttcagcctcctgagtaactaggactacaggcgtgtgccaccatggctggctagtttttgtatttttagtagagataggatttcgttatgttggccaggctggtattgaattcctgaccttgtggtaacgccgaccttggcccagatatattcttaatacatttatcttactttactattacttcattattctattaatagaaagtattgctaacatactcttttaagataaaaatgatatgtaataattttgacttaaatatcttaattttcccttccaatttacgtttcaaaacaattgcttttagtacttttaaatatggcatcacttctgttgcctggctgttttattcttcagtattacaaattatgtcagtatatgtagaatacagtagttgcaaaatgttttatttaaatgagtcattttggttcactggatatacttctatgggtattattttttaaagttttaaaatatatttctagtataaataattacgtaaactgttcctgaaaatatgagacagaaaaaaagaagaaaaatcaccagtgcctaccctgtaaccaataattgcttttgtgaaagcactttaataaagtttcttagcttttgtttaaaaaaatttatgtataatttttcatactgcttttttacttttttatattactttttccatgatacaccgacaggttatattgtccaggcttcataattacatattttgaagggtacttagtattctacccagcaagtgtagtacagtttgcctaatagcattgattttgtcatttgacatttagtgttgttttttaatttatcacaattatagcgtaataaacaacttcattatagttctttccaccatatttaaggttgttttcttagattgcatatagagaggtagaattactgcgtcaaaaattcagttttagttcttgatacagtattgccaaaatgctttccagaaatgttatactggtttatattctcaatgtagtgtctgagaattccattttccttttactgtcattaggattagataatatgtaatttatatgaaagttagcaaatttaatagtttcttattttaatttgcagctggactttatatattcgtatttttttttgcaaactacttgttttgcttatatttctccggttttatttttttaaaacaaattctctgtataacaaaggtattaactatacttagtatttctttgagatttttttttctcccaagctctcatttactattctcagcacacttaggaatttacttttatgtgaataaaatctgttgaactttttattttttatttctttgtgttctaaatttagtaagttctctgtttttaaaaaccattcaattttcttgtctttttaaaatcttaattgatgtttaaaattctgttttaatctttgactattttgatagtatgatataaggcagcctttctcagttgggagagaattaagctccaataccctaaggcatctgttgtttactgtgaattaactttttttctgtgtgtctgggatggatggtactggatatgtaccatccttgggagaattgagaaagtagtgactcaaacgatttttcccctcttctatgattgaggtgaagaataccacttaaggaagactgttaaagctctaaatgtatctttttcaaatctgttagcaaattgttgtatcagtgctcactcctacatcatagaattgttgtgaggctttaatgacataatggacgtgaaatattttagcatggtgtttggcatgtggtaagcaaaataaaatgcgttagctgttactagtttttcttactacatttttctgattacatgtatttgagggtttttgttcctgagctagtactgatttaaccatatagacagcattgttgaaaccatatagacagctaatttggattagcattctaacctcctgacctctgttgctatccttgcttttattttacagatggtaacttttttttccgatatgtttattcttccagataaattttagaattattttgtcaagttctaaggagaatcccagtgggatcttaactggaattacattaagccaatctacatttagaaaaagtggttggttgtaatatttagtatcccatcatggaagatagtttttctacttattcacattttttctcccatattgttttatagagtttaatagtgcttcttgacatagagccaaattattactcctagttattttatatatttgtcactattataagtagcatcgtttaagtggtattggtgatattttgacgttctctagatttttaaaaaatacctactctttaagaataccaccttttctcttttcagtggtaatatttctgtttcatatttgtctgcttgatagaatttctgaaagaatgccaagtaactgatatgtagcattcttattttggtctttattggagatgtccttcatgtcttattttaagcataatgttgactgcttgtttatacttactttcaactctttagagaattattaaagtaatatatgctcattaaaaaaagagtgaaatataacaggaagggtcaatgtatttgtgatttttaagatttttaaaattaatacttcgttgaattttatcatttttattttgagataaaatttaatttgctatataatttgttaaagtaatatgttattctaatagatattctagcatcaaaacatctgtgggacaaattctactttttcagagttgataatccttttgatattttttctctagtgaatgggatgagttagggtcttagaattaaagcaacttggatttttatcattattactatttatttaatttttaatcttttttttttttgagatggttttttgctagtcacccaggctggagtgcagtggtgcagtctcggctcactgcaaccttggcttcctctgttgaagccatactcctgcctcagcctcccgagtagctgggattacaggcacctgccaccacacccggctaattttgtatttttagtagagatggggttttaccatgttggccaggctggtcttgaactcctgacctcaagtgatccgcttacctcagcttctcaaagtgctgggattacaggcgtgagccactgcacccagcctattaatatttttttattgccatttttagctgaatgaccttggccaaactgtctcttttgaatgtcagtgcttttgtgtgtagtttaatgacttttcatgtcccttgaattttagataaaattatctcaacctctcctctttcagctagcaccctttcaacctgtacaattccacagctagtggaaatccaaagtcttctgcaagattatgcagaaatcttactttctgatgatcatctctgcctttgaacctctacttccaccattgctgctgctttttctcatctctttgacccaggtaggaaattcagtccctttcttgattttcacatgtacaagcaaaaaccccatttttatggggaggattagagtttggtagtctttaccaagatttagagaaagcactaatacaaattaaactagggtagtaagcatcactattcttaaaatgtcttctagccactgcacttttggatgttttggccctagtcctgcttctctttccctaccttcttatcatcttgctattgtaccttcctgttaaaaccaaaattttcttcttgtttcttgcagagcagttctcccgtctttgactctttggcatacaactaatgcctgtgttttcagggtatcatcttcatcccaagtccattgtcagaacagagatactttctttcctgggagaagttctgggtctagctgtttatgacacttttcctactttattgttctaccctttggaactgtgttgaattaagtaagtaatcttcaagcatgcagactggtgctcacaaggtatattcaggggttttcctttccttctctgtcattccaactacctagctcattttaatcataatatgcctgtcacagctaaatcaatttgtctgtgatgtggttgacagtgcctcattttagttcataaaaatcagtgcttcaaagattgtattgctaaacttcatggaatgatttgaaaattgaatttgtttttatgtgttataaagctcagttcttaacttgtttcgcagagagttaattgttaaatccagtatggccacaggaggaggtccctttgaagatggcatgaatgatcaggatttaccaaactggagtaatgagaatgttgatgacaggctcaacaatatggtatgattccttactcttcatggtgtgttgttggctattaatgttaaaatgcagttttccccctgaccaaatttaactcactgatgctctttgtatacacttgctggccaagacattaagggaccctgggccgtttattatattaattgaagacacaaatcaaattgagtttttaagccccaaagcagatttactgttacataaagatgtaaaagtgttttttttatggaaaccatgtttaagacatgcagctgggttttaggaagggatttggagaaggaattgggaaattatcaagaattacgttttcaccaccctaactctgcttttgagtgcatctgcctaacacacctttctctttacagaccagttttctctcctctggtccatgtgatatactgtggctgtcccattgttctaaaccttttagttatgggtgcagttatgtactgactagttacctcttagttccaatttgaaattttgtagtatgattatcctaatttggattagatatgtgtttcttttttcagtcttctgtggcgagggtggggtgaggtgtaagtagtgtaacaggttggcaggaatattcactcatagattgggtggaaggacagttcataaagaagggggttttgttaaaataaggaaaatatcccaagtggtttactatactagtactaaaagaattttccagttggataaagtgggaatttacagacctttttgttaatgaattaggttatgtgagtttaactaagtaaataaaaatgttttctatttgaaactataagcactttttgtaattccatattagctgttaccatgtacatttttacctataaaaataatagctgtctttattgcttactaaatgctaggtactaattagttttaatcctattttgaaggtgacactattttagagattaggaaactgagactataggaagcaaaataaatagcctagggtcacacagtggagtgttttttcagaaaacagtaattaggtttagaacctaggttgatttgatttcagatctctttttgatacgtactgactttataggagatcggtaaaggtatctgtaatttatttcactatttataatagaaaatcacaatgtaaaaaaatcctcttggaaatattcagattgattttagggttggcatttgaggatttgtatttgttagtgatcttgataagaaaataatctcttttcagaaggatgggctataaaattaaggtagatgtaatgaggggaaaatgggttaatagaagtaaatatttgtctctaggagtataagtctgtcaaaaatgtcttgtcttttttaattttaaaactgaccaaaactttttaattataccaatctattttcctggtttgatacaggccatgttaatttttgcttttacttttttaaaggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcaggtttgtgaattatttttaaaaatgaagctattactgtgagaaatacttgaaatggattaaataatttgtcttaggaataaaaaattgagctgtttatgtaatttttaaaaaaagtttctgtgcctatggaaagaattttaatcactggggatggtcctgtcttctttagaaggaaatgaagtcccatttctaaacttgctaaagacatgcatttctggactttatactatgttatatgactaactcaagtgattttactatacaactaaattttgcattttggtaactgaataaaatggtattaagtaatggaaagttccagtttagtatatatatcattggctaagtgtgggatgtgctgggttacctcaagtttagaatgaaactattttctgtttataatcaccaaaataaagtttagatctaaaaacaagtagaaatgataataaattcttgagagatattttactcttagatctatatgtcatagagacacacacatttccaaaaatgtagaaaggtagattcaagtctgataatgatgttggtaatgatcatgtatcatttatttatatctatttatcaattattgaacacttaactgtatatcaggcactgagctgaatactttttcagacagttcttcatgtagacacaactttaattacattgattcattgggtccaaagcgtataaaaatactataagcaagtaataaaaagcaatatgagttaaagtgtgatccatggtcctaggacacgttgagcatccctaatacgaaaatccgaaatgctccaaaatccaaaactttttaagtgccaacatgagtggaaaatttaacacctgaccttgtgtgatggtctgcagtgaaaacgcgtcaaaactttgtttcgtgcacaaaattattaaaaatattgtataagattaccttcagattatgtgtataaggtgcacatgaaacataaatgaattttatgtttagactccggtctctttcctaagatatatctcatgtttatgcatatattccaaaatttgaaaaaaaatgaaactcctaacacttcttgtctgaaatattttggataaggggtactcaagctgtacttcatttagacttaccttgttcatattcgtcagttgaattgtctcagcaaagtgaagtctagaaaatgctaatcaaattttcatattgtagtgaaagactgttacagagccaaagctctttcaggtcttagtgcaaagctctttgtgtgcaccttctgaatcaatatctgatggcgaaactaagaacattggggttaaaacaaaattttgtcataaggttaatgtttgtgtgatttgatttctttttcatatatagagaagcattggaagtgattcccaaggtagagcaacagctgctaacaacaaacgtcagcttagtgaaaaccgaaagcccttcaactttttgcctatgcagattaatactaacaagagcaaagatgcatctacaaaccccccaaacagagaaacgattggatcagcacagtgtaaagagttgtttgcttctgctttaagtaatgacctcttgcaaaactgtcaggtgtctgaagaagatgggaggggagaacctgcaatggagagcagccaggtgataacgtttgtttcttttgctcattctttacacaaacctcaaaataccaacagtaaggtttagaaaattaggttacgcacacaggaattttagttgggtggaattaaagtgcttcactgacctcctttgttaatctgccagatttacttaaaatagagtaaatttctgtttatccaaaaatattttagaaatggcatattcaggttagttaaaggcttctgtttatttacaaaatagcatattgccagtttttagtaaagggggattggaaggaaagtgattaatagatttttgtaggaattttttaaaatggcaaatattcttttgaaaagttgtaaaactataatacatttaattaatttataaacattaggaaaatttatataaaaaattgtatgcagttgtagaagtaaaatttttcagatactgtagattaaaattttgaaatgtatttttgaattgacagtgattggagtttttagtattaccaattatgtcttgattaaaatctaagctggattcagattttttgcatgtgttaattcacacaataatccaagtgtctttggttatcttcgaaataaaaatttgtaaaactgttgctattgaactaattatccttagttttatatattgtgtactttcatgctttttttaaaaaaaatatttcccctgcagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgtaagtattcgacttttaaaataacatattatttttgtagtatctcagtgtgtatttactgatgacattctgatgccaccccagaggagttaacatattttcaaaaaatcatgccatccattataacaatttattgcccattttaatagttgtatgatttataccgctaaaatatttcaggctagagaaaatgaggaggaggatgttcggactatagattcagctgtgggatctggttctgtagctgagagcacatcgctaaacatagatgtgcagtctgaggcttcagataccacggtaagcggctttttggtaattaaagtgctggaaatgaaggtttaaatttttctcccagttttcaagatgttatttttataggcgttccttaatgaaaagtgtattccagggaagaacccctcaaattgttaatgctgtatgtgttcttctgtatttaaacacggaagttaagttttatttattaacactaaaaatagttttaatggttaatttgaaaatgtaatttttgatcttcagtttatagaaacattgtttttgtagtttgttttgttaagcaaagcttcactaattttaagaagcatcgaggaagttaaaatggatggtggaattaagggcaataggcaacattagtgattacttagcatgtagtcttttggaaataaccaagttcatttgtcactgaggacacgttaaggatattagaatttttcattttttgggctctatcctagtactggagcaaaaccagatgactgaaaaatcgagagaaagactagtaaatgggacaggatagcatttacattgtgacttattcacaatgagaaaaatgctgtaattgctgacttggcaaaatggaatttgttgaagtactgtttttctgaagaatagtaatttacagaactttgaggaaagatttctaaaacttagtgtggttcaatgctagggtgtttttaggcattttaaacaggcgtgcctataaccatgcattattaagcttttaacacctattacaggctagtaaagcttttgttttgagaggataagcatatatctcttcgggttttgaggtgttcaaaatgccattcagcattaggaatttgaaggtttgtttcctattagtattgacctgcataattcttacctgcctcctttctcttcccggaccttcctaatttgaagaggtgatttggatttcttttctctacattattttcaacaggagatacttagagagcctgatccaaacagttgttgaagaatggattttactgtggggaaattctttttctatttacagtggtgcgaggcataatttcttccttaggttccagcagaaatggaagggttaggacgatgtgggtaaaggaattctgttggggaggagtgggaacttgtatagatttattgtaatttatataaagtattcattgtgatggcaatttctttcataatataaaatgacggtatgaaagttgactaataacatgtagcagagtaaatgttaaaaatgtgctttaacaactgtgtggtatggtaattccgcaggatgtggtacttgcttagttacagtaagcaacagtctagtctacagaaaacttaaaagactaaatatactgctgcttggagggggatgtggattgatttttgtttttttttttttttaaaaaaaaggtggactggtactttttaaattgttttacaaggctggcttatatgttaaacaggagtttgtgttaagaatttaatatgctacactatttaataaaggaggaggcatcttttattctgagaattcggccgtgcattgaggacaaactagggaattcagcttcacaagaacaggtttcagacattgacgttactacaagtccaaaagggaaaggtgacagacctcagaatgacagggaactgaggcctaataggaaatatagccaaaaacgtggatttccctcaaaggtatactttacaatattaacttgggaagtctctaaatgagcacttcttctgttcatatttcctcttctttatttgcttttctgttgttgctattactcttacatattaattgttaatatagttgtcatactgtaatttgctttagtaaaattctgtcccttactgttttttttctactttgttatatacctctccatggattatagcttacagctgtttttaatttatattaacaaaggttttgaaatgtaatttattcccttttttataaattgcgagtataatttataacacgttcttaaaccttgaccatcagtcagttgccctttgtttctgatatttgtgtttattaatttagatggggccaggcgtggtaattctagcactttggaagactgaggtgggcggatcacctgaggtcaggggtttgggaccatcctggccaacatggcgaaaccctgtctctactaaaaatacaaaaattagctgggcacggtggcgcacgcctgtaatcccagctactcaggaggctgaggcaggagaatcgcttcaacctaggaggtgtaggttgccgtgagccactgcactccagcatgggtgacagagtgagactgcgtctcaaaaaaaaaataatgaaataaaaataaataaatttagatggtagtttgtcagattttttggtttatatttttatttttggaaacccctttcatttgctttttttagaaaaattatccagttgacttggttgcctctttttttgctggttttttctgcagtgtttaattggttttttaattttccatgatttgcataatggcattccagatagagttaaagacaactatttgtagttccacataaaaagagtttgaataggccgggcacggtggctcacgcctgtaatcccagcactttgggaggccgaggcaggcggatcacgaggtcaggagatcgagaccagtctggccaacatagtgaaaccctgtctttactaaaaatacacgaaaaattagccaggtgtggtagtatgcacctgtaatctcagctactcaggaggctgaggcaggagaattgcttgaaccctggaggcggaggttgcagcgagccgagatcctgccactgtactccagcttgggtgacagaacgagactctgtctcaaaaaaaaaaaaaaaagagtttgaataaaaataccatttataaaagtgcatgtatctgttggcaggagcaaagtactattttagtaattgagtataggtaagactaatttcatatgttttattactggtttattacctaggactacactttcccattttgtggctattttatgggtttgttgtattttttttttttttttggtgtgtgtggctatttacaaatggtaaaacttcacctctagtattttggcagtttttttattttttctggttcctacaagaatttgagagcacagtttgaaattagttatgggaatcttattatatcaaatatcaagtaaaatgtgccccagttcaccagtagagtgaataaagtagctgattattttaaaaactagtggcattggagaagagcaaataaacatgaagcataataggtaaccattggaattttattctctttaatccttctgaatagtgacaagcgaaatttaagagttaacagttaatgcagtatctgccagttctttttttcttaaggcattacatataatttaaaaaccactttgctgtttttaggtttctttgaataatatccttataagtgattattattcttttttgaattctcttcttggcatttatttcattttgactttcttgattcttaaggctgtctcgttgttctgttagtattctatttgtaaaaacattttaatttcttcaggggaaaaaatcttaattctcaccacctgtgtttatttttttctctactctgcaggaactgtcattcttaccaccccacccctgtttcctccttagaatcttttcaaaatgtagtattctgttagaatagtggaaaacacagttgagggtcttacatgcgattcaaggttgaaagcaaccttgagacttaacgcatgatatgaaatgattgatattctagagctgcctaccaagggcacattccactttatgaaatattttaagacatgatgacatcttgtataagatgtcagaagaaggcaaaagaaagccttctacgagtagccatgcgttcattgttttcctatactcatggcccccaacttaatctcacctcttaaaatttataagctttctttgtaccttgtacctgtgttttgccattattttcatcattgctagttatttcgtgtgagattgccctgtcttttaaaccagctatggttcttcagacatgatgtcttatacttctgtatttagaacccagcacataatttggagcagatagtatgacgtaaagaagactagagcctaagaacctgatttcccttaactgtgacactggataagtcacaactttatcttctctaggcttatagttcctcaaccttcacatgaagaaattgaagtacataattatctgaagctgtcaaaatacattaggatccattaataattactaggagaacctcagttgagtagaggaaaggaagattgagggttctctgaaattggactactacatatttacaactcagggtttgatgcctaagttatttttttaatctgtaaactaaaaatatagttggtgaaagtgactttttcaaaaaaagtttaaagaaaaatatgtgtttgaagaattaatatacacctagcatcctttttggatttctattccaggtgccatcttcctggtatgttattactcctacctagatatttttattttctcccttctgtatatttcatcataggctgtactcccatcttttggctcagtttttttgagcatcagtctgaaatgttgtttatatgaatgtgaaagttattaagtagtaatatttcactaattttgaaaattgagaattcatttttagattagtgagaaatctgaagataattgtgtttaatagcttagaattctttatgattaggttatcacagttttgtgactaataaggattaaagaactttttagaaagtacgcttttttctcatttgcatatttttttctcctaattataatttatgctttgctagaggagtatttgatcaacctagagagattttgttttaccccttccattgatatctgtacctatttgatttggttttacattttaccgttgactttgatgaaatcattataaaattatttttgctgcattctgagagggctagctattgataattatccctacccttcaaagttgtttttttcctaatgatgtaaactgtctggaaataagccagactaggatgaatttccacggaaatggatgtaaatatttacaaggtaactccccttatataggataggagagaactgagtaaacagtacttaatttgttaaaagtttcagtttattagaggttcaagacaacagaaaaacctctaataaatattggcttaccaagatccaggtaggctatttgtttcccatgctcatgaagtctagagatagtctaggatagagaggcactgactaggcacctctgatgtttacatgaaataatctaattatagccaacttcctatttgatcataactttcttgaatatttaactctttgccatgtacttatttgtttacttattaattttatggatttccaagtcacagtgtaaaatattaccacagttactcatgctcattcacaatactgatgagttctacttggggaggtaaagaaatttttatatagtattgtaaaggatgtcacccagaagggagtttctcttgagcccatctgcatgctccataatttctctgggaatcaaatgtacatagcaagtgtagatcagtgcatttttactttcaaaagaaatctttgaacttctttgctctctttagtcatttatttgaaatttacataacccgacaaaaatttgttagcagtacaaatttaaaattgactaagtgaaacaaaagtgaaatattttatgtaaatattaggtaaaatcgttcaacttttaaaataaaagactttttaaaaggtaaatcggtgatgaaaaatacaattacggtatacgtttcgatgtataatttagcttgtaatatattgtttccaggttgtatttaaatttgtctctgctttgcttttccattttcttgttggattacattttgaatagttttaagattaacacttaaaatttcatcattttttgtaagtgccacttatttaatccatccctctacttttagactagatgataacctcctagcattttcggggaatttggaagtagttacttccattttatgtcatcagactcagatgaatgagcataatttaagaggaaaataatgatgcctttgatgacgaatataaaattcgttattttcttagatgtctgataatatgatgtgattaaatgaaaatctttttacataagattatcaaataaaaaatgtatttttaaaatttcagtcctttgttagaaatagtaggtgtgcctactttctaggttttgttgttgtttttaaatattacttctagtcttttttttttccttttttcttttttctttgagacggggtctcgctctgtcacccaggctggagtgcaatggtgcagtctcagctcactgcaatctctacctcctgagttcaagcgattctcttgcctcagcctcctgagtagctgggataacaggcgcacaccgccacacccggctaatttttgtatttttagtagagatggggtttcatatgttggtcaggctggtctcaaactcctgaccttgtgatctgcccacctcggcctcccgaagtgctaggattacaagactttcaggtcattaacccagtataatgtgctccttttctgtaggggcctagattcttcagtgtgtgtgtgtgtgtgtgtgtgtgtgtgtgtgtgtgtgtccatgtgtccgtgtccctcttggccttttatgttttgtatatctttttcttttccttttgttcattcctcttcctgctgagccattgattatgtagctttttactgtgaaattacctcttaagtggcaggctatatatatatctctgtgtcatcattctgttcttactcttttttcttgatgtctactaaaactatatttagggttgtatatttaataatttgttatcaatgtgtatactttgccattgataattgaaaccgcaacatggattttaatagtcagatacaagtattgttggtcttattttccaggccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctggtatgtcacagtctgagaatattctttttgtaaggaagactcatacataattgtattgcagggtggatgctgattattacataatcagatcttgattgttgtctagtttagaaaccttcatatgaggcttatactttcctgtgcttttctctggttatgcagaaaaggttgcagggacaactggccatcatactataccatgcagatagccagatctctctccttttcatcagagagtacccttaagaggtaaaagagacaggctgtagttctgtttttgtacctcagactgataaggctcatgatgcgtttatttcctttttttctattttattcagctaggattgtcattctttgcttgcctcccaagaaagggttaaaaccttaagtgaggcagtgagtaaatttataaagtgtctttaaccttcaaggttagtagtagctagtagctgttattttaattaggtatccttttgtatatgctagctccttggaactatatttatagtgtatacattcttcgtaagactcagaaattttcttcctcctttcctcatagccatgtgtgaattagatgaaagttgtgttgaatttcttagtattgagtctaattttgtacgtttatcatcaccttcaaacttattttagtttctcgttaaattgcaaaaaaagatgattagttattaaaagtcaacaaaactaagttatgttttctaatagtctatcccccactgtctgcttttagtaataatttctcttctttgagcgctttgtttttgcgagtgagttaggttctcactgaggctaccctgttgtgaatcagtttattctgctgtccaaacctagcccactggctcacctgtctaatccctgttatacctaatttaagtttgcattttcacaaggaacgttatgactttcaaataacctctttttttttttttttttttttttttttggagacagagttttgctctgttgcccaggctggagtgcaatggcatgttctcggctcactgcaacctctgcctcccaggttcaagtgattctcctgcctcagcctcctgagtagctgggattacaggtgcgcaccaccatgcctggctaatttttgtatttttagtagagtcggggtttcaccatattggtcaggctggtcttgaactcctgaccttgtgatctgcccgccttggcctcccaaagtgctgggattacaggcgtcagccaccgtgcctggtcaataacttactcttttgtagtaatgatatagctgtatagagtactgtatacagtaataattacaaagatttttgtccccatttctccattgtaaaatttaaagtaccattagcttttatatttaggaaacagataatttaggaaaagataattaaaatgctttaacataatgactagtactagtttggttaatgactaaccttttaaatatttttcgagtttggaatatcagatttaaaagctttcctttggtagttaatattaatctctaaacttgcataatctcctttgatcatcagagatttctaggttagtcagagctttaattcttatttctgttttatagagaaggaactctacagagtttgtggcttgcctagatttatatagaattttagcagaattacatttcttgaattgtaggtcaggggtcttgtttctttttctgaatatgaacttttgaaagtaagcagataatttctttttaaaaaatactattatgagtcagagaataggagtataatgcacatgagtttgaacttcatactatttcaaaaagaattttagcttagtaattttaaaacaaatttagtcttgtatttatgagattttgcaggggcatgctaatgaaaagccatggaaagctacaattacagtatttaatctagtatatgagacattatcttgggataattatgttacctcaaagagtgtccctttcaccatttaactaacaagttacatataattactgtaatttctttcttctcagcatagagttttgactagacatataggattctatatagccttgaaattctcagttctcagtggaaaaaaggtagtgttttcctttaaaacagaagcaatttataactaattgtcttttttctttatcttttttttttttttgagacaggatcttgctctgtcacccaggctggaatacagtgggcgtgatcttggctcactgcagcctctgcctcgcaggttcaagtgattctctcaccccagcctcctgaatagctaggaatacaggcgtgctgtaccacgccgggctaatttttgtagttttgtagagatggggtctcactgtggtgcccaggctggtcttgaactcctgcgctcaagtgatctgcccaccttggccttccaaagtgttggaattacaggtgtgagacactgtacctggccaccaatgtctgttttagagttggagagttagaagtcaggttaaggatggagttatttgttagtagaacagtgactatcatgaaaattgttgtcacaaaactgctttatgaatatgggggcattttttttaaattaagaagataaaaaccacagtcttttagtatgacttgtatcacaaacagccacttcaataaattatccattttactgcaggggtcagcaaactatggtcagctgagtttggctcattgcctgaaataaagttttagggaacacagccatgcccttttgtttacattgtctgtggttgcttttaccttgtaaaagcagagttgggtggtcgagacaaaaactgtatttcccacaaagtttaacatatttactatttcaacctttaagcaaagtttgccagcccctctaccggagaattgattctattcaagaacatggagattgaaacctgtcagaatcagctgtgcttttttacactatcactttccctttcactcctcactgatcttagacctgctccactgagtcactactattaattggaatgtaatagtaaccctccttgtatgttgggacaggaaaagatgaaccactttaccagagttttgtgagcatccctttatttttaagttaggtggtaacttctaataaaatgattgttggcagatagatcggattgttaactagtttcaagttacgtatgtgagctttttaaattctttttttaaatttatttttagcttctcagagattaaaaaaggtgtttgattatttacattaatcagtagttactaatttctttccagttgttgcagaaactgcaggtagcttatctggcgtcagtatcacatctgaactaaatgaagaattgaatgacttaattcagcgttttcataatcagcttcgtgattctcaggtaacctagatgttttagtatagttgagtttaaaaaatcacattaattagaacagtgattcagaaacttcagtgagcatacatatcacctggcatgattgttgagcagtgtaggtttctgattggtggggtcccccccaccttcaaaattacgattcatggatttggggtgggcttctccacgtctcagtccaatgctggtggcctggggactatactttaagaatcactaaattagaggagagtttactttgaaggaagtgattaatgaagtttttctttgtatgctactggatgacgtattcttttttcctctaaaagacttaatggtcacaacgattaagactttgctttaaatctgtgtccttcgactagatacatgggattctatacagccttggaattctcatttgaaggaatattttactaacaattttaagaaagttcttaatttgagagttagcaagtgttataatttgatgcactttgtaagtgatataaatgcagattttcaatatgggggccttgggtaagaaaggatgaattaatgcctctccattggaagtgagtatgattgaagatgcagtgtctcttgtcttcttgctgaccaagtgaaaatgagagaatatggcccaaccactttggagagttatatagcagtacctagtaaatttcttctggtagacctggggcctactttagagaaactctcacatgttcagaaggaggtagatggaagaatattcatggcaactctgtgttaatagcaaataaccagaaacagcccaaatgtccatcaacagaaatgggctaatgaattcttacatagagtgaaattctttatagcagttacagtaaataagccattgctaatgaatacaaaattcaagtttaagaaggatcccacttaccttattttaaaaaaagtctacatttttaatgtatgtatacataggcattagaaaataaaaacatgtagagaatggtagatgcctgattccaggttggggttacctttggagtgggtaatgacattggaaagggtacaaacagagctttagttaaatctgtaatgttatatttttcttaaaataattgatgcaaatatgggaaaatcttaaaatttgactaagcataatgggagatattcattatatgatttcctaagccctagtggattcttgcaaagtttcataattaaaaaaaatttaaaaaaaggccaggtgcggtggcttatgcctgtaatcccagcactttgggaggccgaggcgggtggatcacttgaggtcaggtgtttgagaccagcctggccaacatggtgaaaccctgtctcaactaaaaatgcaaaaatgagccaggtgtggaggcatgcacctgtaatctcagctgcttgagaggctgaggcaggagaatcgcttgaacccaggaggcggaggtttcagtgagttgagatcacgccactgcactctagcctgggccacagagtgagactttgtctcaaaaataaataaataaataaataaataaataaaaaataaaggaacatgagagagaagtggtgggaaaaattgataggttaagaagttaaagtttacagtggtagttctagaaagaaggcaagagagagaatgagatttttgaaggtttattttatgtaacgtggcattgttattacttttgattcaattactgatgtctagtgaatccaagacctctgtgtggtcatgtgtctctaaaactatgtagagtcagctctcagtatctgtgggttccacatccatggattcaaccaaccatggatcaggaatattttggggggagaaataacacaacaatttttaaaatgcaaatttaaaaatataacagctatttacatagtgtttatattgtattaggtattataagtagtctagagctgatctgaagtatataggaggatgtgtgtagattatgtgcagatactacaccattttatataagggatttgggtatctgttgtttttggtgtccccaggggtccttgaaccaatccctcatggatactgagggatgacttcatatgttaatagtggcatatcaggaaaccgtatttaatttgggaatagtaagggtatatacttacctaccagcacagcctagcaaatatttctttctctttataaagaatatttatgcatttaaaaaatgagaatgcatttaattgcgttagtcttaattcttcttttttgttgtttttttttaataagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatgtgagtaaatctggttcagcagtattgggtataagacacacaagtatatatactgtcacataataaatttagtatttggtgaatgaacacatagctcctcaaaaatatttgtagggacttaagacttgcatatgaaaagtttctaagttgcaagccaatatatatgaaagccaaataggtgataaatcagttttataattcagaaaagggaaagaataaagttggaccttgaaaaattagtaggattttaataagggaaaggtagaagagaaggcaactgtttgatacgtggacatattaatactttgtttcttaacattcaaaattttcccttaaagaaaagttaatccagttagtactttgatttaaaaacccaaaactgtgaaacatagtgtgtattaaaaaaaacaaaaaacaaaactatgaaaaacttttatatatggtttagtctagagagcccagaacttccaactgctggatttatattcatttttaaaaaatatataaataatcatctcaagcaggtataactgcgggagttatcttttttgctccacacgtgtttaaccttctttgtctaaatcagatctagtcttcagttcctatcctaataccttttcaaacatggcccctgtctcatatccaaatagtaatagaggctcaagcattagaaattgaagtcagtagggacaacttccaactagtctttaaacattctagctgctgtctaattaaagaaaagatgagggatttaaaaataacaaaaccattgtctctggagcctctggtccttattctccacctatctccttttccttttccacccacaaaagaaccttaatattcctgtcctaaaacatactcctttcttttctctgacttctgctagtctctttctcctctagagtataatcccagtttttatcctttacaaacacatgaatacaactaagatgtgtggctgggtgtggtggctcacgcctgtaatcccagcaccttgggaggctgaggcgggtggatcacctgaggtcgggagttcgagaccagcctgaccaacatggagaaaccccgtctctactaaaagtacaaaagtagccaggtgtggtggtacatgcctgtaatctcagctactccggaggctgaggtaggagaatcgcttgaatctgggaggcggaggttgtggtgagccaagatcgtgccattgcactccagcctgggcaacaaaagtgaaactccatctcaaaaaaaaaaaaaaagaaaagaaaaaaacaacttaacatgtgaaagttgcgcttaagtccttgtcgtcagttttgtatgcataaagtagcactccgtatactgatgactcttaaagcctatttttttcctcactgggaagcagtgtgagagcagcagcaaaaggtagactcgtcaaggaatagaatgaggagactgctggaaaccacctacaggaattgtggtactaaagtgagcaacaaataatgatggttcctttgagaaagatactggtaaatgacagcacctttgaaatggtaggaggtagagaagtgcaaagattcttaatctttaattcctcttgaaagcatgatttatatttgatagtaacagaagttaaatagaaagtaattaaatttagttcaaggaccatagaggattagccattatctaaatagcaggtttttattgctgtttaatatttcatggtttgaggtaccacagtcacttttaacacttttctttctctcctggagcaagaaaagttccttcttggtgtccagatgtgacatccccctgatctgtgggtatgaaaaactgatgaagacctaatcagctacagctaccctgtaaagattacagattgagtactgcacatgattcatagtggccctgtttaacttaacctagaaccaagtttatcaagttagttaccaagtttactcgttagttaaaactaactagagtacttctctagttagttttccaaggtagaatatcattattcttgtcaatttccatcttttttctttcctttctgttttaacccagtggttatattgtaaaggtgatagaacctgtggaagaaagaggtaaacaagtctttgtacattttgatgtgtttaattgtggagtaagttaataaacaattttctgaaatttaaatctgcagaaattaagttgttaatttttactttttagttttcaatatccaagccaactgtatgtgtttgtttatggtaactggtgattaaaaaaaattttttgttgttgtgccttcttcagcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagtaaaacatttataatcattgtttacatgaagttaaataatagggataaattctgtttttttttttatgttgaaaattctgcaaaacgagatttatttaatattgttgtaaacattcttaagggataggtagaagaggcgtgtgtgtgttgtgtgggcataatttgagttgtctaagagatgtgatgtaacatagtttctgtgaactgatgttactttcttgtttttcaaataaaggatcaaaaataagattacagttaaaatatttctatattcagatggtttagagaccaggctgtagaatcagacagccctgaaattgtatcacacaaggctgtgttaccctgtacaaataacttagccttactaagcctgtatttcctcatctgcaaaatagggatgataatatacctgttgataaatatgttttcattaaaaaacgttggcgcagttcctggcacttacagtaagaactcagctaacttaatttttatttttggtaaacgtagtatgtagtgtatagatctcatatgtgcagacaaatcaagaaccttccatacatgctcagtaatgtctgtatacctgattttcctgagaggtagtatttagtagtacttcacacttttgatacttgagaaactagaaatctttttgacatcaggttttctgctattaacatttacacctgcttaaaatgaacaattaaattgaaattggttttcttacacttttgtccctaaaacagcataagaaaataatgtgagattttgagtaagctgtacttggcattaacctcattattttacagtcataccccctggagagttcactaggtggatattccattaggtctaaattttgtttctgttagctgctatgatatgaaaataatgtctgtattattttgctaaaatgggtgtaaatcgtatacataaattttttgtttatcaggaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcggtaagaacttttctggggatgtttttccagcatattcattctgtcttgatacttataatgtgggaacaaaaatacttcgttgtagtatttactatttgccttttatttaagctttctactattttggtcagtgtaatcatctctgccctgtgaagaaagatgaatagggaagtatggagtacaatagttcagtaaatttgccctttgttagactgaattcgagtaaatcatgagatgtatctaacttagcattttgctgtctttttctttttaggcgtaattttcattttttcagatgtttttctacttaaatagcacatatgcagaagttaatgaaaagcaggagtcgattattcaatttgaatttaaatggaatagccaacaatgtgcttggtttggtgttattttattagcagttctaaacttggatttctttctctctttttttgtgccttaaatgacttcaggctgttttctttcttctagaaatccacaagtagcttccacttggaatgaagtaaatagtcatagtaatgcacagtgtgtttctaataatagagatgggcgaacagttaattctaattgtgaaattaacaacagatctgctgccaacataagggctctaaacatgcctccttctttaggtatgactgactgtatttacatataattttgctgtgttattcttacaaagtgggttttcgttcatgtgtgctctttcctttaaaagttactggttttaattatacatgttttcagcagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggtaaatattgcttggtcttttaaaaacctatttgtcaaatagtacagtcttaagtaaaatttgtgtatgataattactttggtttaattatactaatacacatttatgtatcatatgtgaggtttaaatttttagcactttacatgctgtatgtcagaggtcagcaacctttttaaattaagagtgagttggttagatagttgcggctttgtggcgatatagtatctgtcacaatttcacaatgcaaaagcagccatacataatacataaatgagaatgattatttgccaatatagctttattttattataaacaatatagctgtttttatttacaaaaacagaagaggttttgttgtttttgttgttttgctgacaactctggccttatattatgtacaacttgcagcatctcaatgaggtagacattaaataggttaaagagatcttaattgccgaagtttatatgactgtccaatccagaattcagacttcctgataccagagcctgcgatcttaacctactgtatataaaagaaaaaccatatgttatcttattcagtaaggttaaagttagaactattaatcataaattttaaaaagcagtttatacatattttgtattatagttacacaattaactataatgtacaattgtatatttatacaaatgtaaaaatatacaattatagttacataactattaacacaaaatatgcctacacttataattgtataaatatgtaattaactataattgtattaccgtgtaactattaacacatttataaaggtgttgtgtatatatatataaaaatcatataaaatggtttttgtgagtgaaaaacctcaagttttattaacagtttcttttgaaatgctatgtactttgaattactcaagtaaaaggtgagcgtgctctctcggttcaaaaaaagtacgtatttgtatttatttattttttggggacaaggtcttgctctgtcacccaggttggagtgcagtggcatgattttggctcactgcaagctccatctcccgggttcaagcgattcttctgcctcagcctcccgagtagctggaattacagatgtgtaccaccacacctggctaatgtttgtatttttagtacagatggggtttcaccatattggccaggctggtcttgaactcctggcctcaggcagttcacccaccttggcttcccaaagtgctcagattgcaggcacaaaaagtacatattactaataaactctgtctttacctccattaataatcctattcttcttcactgaagttgctaggccttttctctgcagttaggtacatcactatgcacctatttttaaaaaaatacatgacgttttgtggtatgtttctttgtttttacaaactgtatatataatacactaagtattattttatagctttccttttttccccactccacattgtctcagagaactttcatgtcagtatagttctatataattataagtaattaagaaacacaaatatgataattataaaatataaataatactgcatatatatatatacacacagtacatagttatttgtagctgcagtacagttttcagtatatcgatggactttagttaatgtataatagcatccagttactatatacttgttttcaatctttcgctatttagaaacaatgcaccaaagaatatacttgcacaagcttttgtgcatttgtgttttttaagaaggatttggagaagtggaactactatgtcagttggtgtacattttaaaggacacaacttaattggtctctagagagcaattttctatatgtatttccgtatgtatttatatttctatatgtatagaatttttgatatgtattcatatttttctatatgtattttttatattttaagcagtggtatgtgagagttcgtttctccacacccttgattgtgttttattttattgatataccgtagcttgtttaaccattactggaattggccttttccaaatttcccaattataagaagagttattgaggtgagataaacatgtatgcaaatacaaacgtgtgtaaacaaatatatattgaacacgtgtacacatgtatacaaacgtgctttctttactgctttaatctttttatgtaaattttacagactagtggtatttactaaggtatgaattggataatgtcttgaggtatcaagattgttttaatgtaatgatgctctttcaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaaggtatgttaagcttttggccttcatttaatataataaaaatttagtgcctgttttggagaaggtgctcagctaggtactgtgttatgttgtgcctaatgcttcatcacattttattggagtccataaatataatgtcaatttaattgtagagagaaattttatgaggctaaactacagcagcaacagagagagctaaaacaattgcaggaagaaagaaagaaactgattgacattcaggagaaaattcaagcattgcaaacggcatgccctgacttacaggtaattatgaaatttatttctaattgtctgaaaaaagatgtttaaaaccttaggtcaactgaaagtactcttttttgtttttgtttttctttttttttgaggcagagtctcactctgttgcccaggctgaagtgcagtggcgtgatcttggctcactgcaagctctgcctcttaggttcacgccattcttctgcctcagcctcctgagtagctgggacttcaggcacccgccaccatgcctggctaattttttgtatttttggtagagacagggtttcacagtgttagccaggatggtttcgatctcctgacctcgtgattcgcccgtctcagcctcccaaagtgctgggattacaggcgcgagaaactactcttttttttctagtattaaggtgacagaattatatctagtaattttgtgattaatgaagtggatgaactaatgaagagttggggttatacgtttacagtgtaaaagacagcacataggaattgactcattattttcattcttactgggctggctggccatagattcagaacatgtgtactcataactgtttattatgttaaaatattctgatttgacttttgcagttatggaccagcatttccatcttttactggcctgaaataatataataaaatctttaagccaccataagatatctaaggaaaataactgtatgtggtttaaagagtaagttgtatatacttttgcttattaactaggatcttatacatgggtcttgagattgaacagaaaataagatatctttggtgatatcaaataatcagttaataatatgggaaggggataataattccttctgatattttcccagagtttattggctagcttttttttttttttttttttttttgagacggagtctcgctctgtggcccaggtgggagtgcagtggtgcaatctcggctcactgcaagctccacctcctgggttcacgccattctcctgcctcagcctcccgagtagctgggactacaggtgcccgccaccacgcccggctaatttttttgtatttttagtagagacggggtttcaccgtgttagccaagatggtctcagtctcctgccgtcgtgatccgcccgcctcggcctcctgaagtgttgggattacaggcgtgagccaccgctcccggcctattggctagctttatcttcagttaggttgtgttttcaaagaaaggaaaacagggcaactgtgttcattttctaaacccttgcctttcctactgtatctaatcctttttctctccttatctccaatctaaataatgtctagagaaatatgttgcaaaggtgggttaagtatacaaaattttccattatgttttatccctgttgtttctgttgtttctgagggcttgtgtttgttaacctcagcttgtgttttcatctttgttttcttatttcatgttatcttcggatgatgatggaagtcagggtctgatagcagattaaatatggcactagagccttagtgccatatttaaagtaactgcttttatgaaattaatataattgctttaattcctcataacgttttttgtgaattcctttttagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgaggtattgtaaattgtactctcttgttcctgagttagtcttttgttttcctttttttttcttcaataaggcacatctcaagaaaggaaactgaatatccttgaaacatgtttgtaaatagtagtctgctttgtgccttttttagtagacacaaaaatgtaatagattataataatataagaaagataaaacattttaatttttaaactttaattgaaaagttttaaataattttttctaaaaagtaattatcttttaaaaatatccatgttctttgttagtaaatatttggcagaaatatataggggggtagttgcagcaaatagtaatcatttcagttagaaagacctatcctttgacattttatttatatgtggtttgtagaaaatataatttttcctaaataatttctgaagtatatttgagttctacttgtttctattaataggccatgtgcggtgactcacacctataatcccagcactttgggaggctgaggtgggcagatcatgaggtcaggtattcaagaccagcctggtcaacgtggtgaaaccctatctctactaaaaaatacaaaaaaaattagctaggtgtagtggtgggcgcctgtaatcccagctactcaggaggctgaggcaggataatcacttgaacctgggaggcagaggttgcagtgagccgagatcacaccactgcactccagcccagatgacagagtgagactctgtctcaaaaaaaaaaaaaaattggctgatttttttgtaatcataactatattattattttaaccttcatggacatgttagtgtgaaaaggagagaatgagaatagaaacctttgttgatactgacaatactagtagtcttttactcttttaggctacagcaaatccaaatatttatttaactctggtttcttaaaaaaaatagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaagtaagagagctgcataaatcacttttctaaaaatgtcacctgccgaagattgacctgtaggctaggcagccacatttctcctctacatcacagcacaaatctgctatttcagtgaggctactgtttaactaccacctttgtgacccagtttaattgaatccagccactttctgttctgacttctcgtagcatcagctttctcttttgtcttaaattactatggcacttgatcaaatggtgatacagattttcttatgtgtataagccttattagttaagtttataaaaagaaaatgcttgatattttgtagtgcttttctgtcaggccagaaataggcccttttttgcttaaattgagtatctgctgtttgtaaggttcttaaggatcttaaaacattttattataatcatttagtttttaggatttcagtttaaaatgtccatatttagaatatttctaaaagagttggtcatctataagatcagtgaattatttagctatatagtagtaaccatatcaaaaattttgaaatatagatttgtttatgaccttcccttttgatatcctcagatggcatttctggaatttctggagttttgcaccaagccctactctcttctcagatgaacttctattcttggggtcccaatatgcattttactgatcagactatatctacaatattttattctgttctgggtactacacgtctgttcttctacagagttcttcagatagttttgatgagcatctggtttcagaatcattggtctggatttttgctgtccagtatggcagccactagatataggtggttatttaaatttcaatcaaatgaaattaaaaatttattttctcagtcatattagctgcattttaagtgctcagtagccatgtgtacctagtgtctactgtattggatagcacagatacagatgattgccgtaattatagaaagttctgctgaactgcactgatcttgaaaactccctcaagcaaatgttaagggtagtttagctttgggaagtagtcccaggggatatgatgattatttaaatgtatttgaagaattgttttgaggaaggcaaactaaacatattctgtatataacagcaatagggagagtgccacccgtagcatagttattgtgattaaatgaaattttatatacagacatgtatatgtatgtttgaaacaatgtctggcacatagtaggtggcagagtatttaacttatctccagaatgacatctgttttatgtctcttaatcactagaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatggaaaggaaactaaaaataggttagtttcagtattttaattttgtgcttaatttaagaggctcaggtctttttgactgacagcaagcacttctgcagttctccaagccaactgaatgtcctacaactcaattcaatttttacactaactactcagagttagtgcagacccctcaagttaaggggctcagttcagtaagactgccctcacctcagacttcaatttcaactgcttggtccccacgttacccacacttctgtgcaacatggctagaaatttgggagttcttacaatccccttcaggtttatttgctagaacaactcacgaaatacaggaaaagacttacttacgtttcctcatttcttataaaggattctgaactgccaaatggaagaggtgtgttaggacagtgtgtgggttggggaggtgtgcagagcttccatggtttcctctgtgtgtcccaccctccccagcactttgatgtgttcagtgacccagaagctgcctgaattctgtttacggttttttaggagatttcattgcttaagcgcaattgataaaattgttgactgttggtgattgttctcattagcaaaaattcacatctggttgaaaggggcttgttacggataacaaaagacattatcacttgggagattccaagggttttaggagctctgtgctaggaaccaggcacaaagaacagatagatattttattataccacaagaatgttgttccagtagatccaggtaaactggatcagtcttcactcctgctgttgagaattaagcaaaaataacaaattgtagatagtgaaaagagtctgccaacaaagatgttattacattgttactaataattataactgaaaatttcttcatgaataacagatggtgaagtagatacagtagctccacttgatgaaatactatgtggttgaacttaaagcgtgaagaatggaaaactacttgtgacataataaatatttttattttgcagaatacttaattatatggacactgctgtgtaaaaacatacatgaaaaagactggagactaatgaaaactaataattgtacaaagctaaagatctggacttctcccccctctatattttttaatactttgtatgttcttttaatttaaaacagaatattggcccataggcctgagtatcagagtttattgctgtattttaaaaaccaaattattatgtatgatgacttaatgctttcaatcttgtgttaggtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcaggtaaaatttgctatgaaagtatatttttcgtctatttttataacttctgaagcaatacaaatttttctcaagtcatcagtaactattaacaaacattttctttcaatagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggtaatctgtttcttagaagtattgagactgtataagagctaacattgagcagaggttttacagttagcttctgggagaaaagagcaagaccaaattgcatatttggacattctctttcccttgagaattttataagtggtgatttacctaatgtttccttttaataccatggatttctgtttttataaatttatgttattgaattttacttatattttggcagattttatggtgtgtaaattgtaccacagtgaagctataaacaaacaaaaaagtgattttcttacagttttaccgactgtcggacagaagtactaagttcatttcttgttccagagggaaagttattgaattaagccttatagagcaagcacgtatttgttacagtatcagagcagtttgtctgcatgcttttgaatcatttttttacatgtattcttcctgaatgtactttatatatatggcaatataactgattcttagattactgacttaaatctttgtaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtaggtgacttaacctaaagagaaaataaataaaagcaaagtgtttggaacaacgtaatttgtctattgcctagatgttttaacattttcttttggagtggggtaggaaatgtttgcaaagaaagttacaaactcttttttttttttttctttttgaggcggagttttactcttcttgtccaggctggaatgcagtgacatgatcttggctcacggcagcctccacctcccaggttcaagggattctcctgcctcagcttcctaagtagctgggattacaggcatgtgccaccgtgcccagctaattttgtatttttagtagagatggggtttctccatgttggtcaggctggtctccaactcccgacctcaggtgatccacctgccttggcctcccatggtgctgggattacaggcatgagccaccgtgcccagcctacgttgttccttttaaaccaaactttaataatacggttgctaatgaaattaagtaaactacttaggaatgattgcttcaactatttattaagaggaaagagaacctgttcaatggctgctgtatactaggcactgtgtaaaacgctgggagagtaaagatgaataagacagtgctctcctaaaggagtaccatgtcttgttagggggatgctaatagactaaaggagagcacatttagcttaagcttttctttggatggttttttctgcactcattatgtaccagacactatgtaagttactgggatctaaagatgagtgacactgatcctttaaggaattcagggtctagtgaggatgctgttaatgaatgcttatagtacagtgccacgggtgccataacagtagtgcaaatgctgggaagtgtcagcaaatcagttccgccgccaaaaaaaaaaaaaagagttgatatttaagctaaagaatgaatagaatttatttccagagagattagaaatgaaagggctttctaatagaaccacttagagttataaagcaatgaaatagtacatcactcagggaatttagaggtatttaagtgtggctagtatttaggggaagagtaattgatgtggttgaagagtggcagagagattttatgatgtgcaaacaagcttaggttttatattgcagacgagggtgccattgaaggactttgagcaagggataacatgaaatttatattttagaaagattacactggtgaaagtgttcgggagaagttggaggaaaggagtgaagatttagctggtgaacagaaggctgtcataataatatggaaagaatgatagcttggccttaggccttgtcagtagggatcaagaaaaaggagtaactgaaagacattatagtgatagagtgaataagttaagtgaccgattatatgaggtgaatcatgaggaggagttaaaggtgttggcagggaatataggaggagaaaaaaggttgagagggctttgtgaatatatatatatataatcacaatatatatgtactcaatacttcttacatacatatattacagtgttatgcccagcaatgtgtatatatatggatgtatatatgtgtgtgtgtgtgtgtgtgtgtgtgtgtgtgtatatatatatatatacacaccacagtgttttttctttataggattttcaagacagtggcataaaaaatttaagagactttttagttcttgggtgtcaattaatattggcagcaaacatcacatgagtagacttttaagtaataagaaattgcaaatgctcttcctttttactaaaatatacttcatacccacaccaactctatataaaggctcttcattcttcttaacagtacaatttttgtgaaaccttcccagtctctttccccacacgttgttagtagcctcttgcaaatagctctgatacataacagtatttggtaagtatttaattatattctactttcccaataaaaatagagtagaaacaacataagcgtaggagtcatacagacctgagatctaatcatctttttcatttattagacgtttgatttctaaccgtatttgctcactggtaaaatgaatgcagtatctattttataagttacttggttttaagtattaaaccaagtaacatgtaaagtgcctgcagtagagtgtgtcacccagtaattgataaatgtcaggtaccattatttctaacttttagctcttaagggagtggggattattaattgtctttgaccaatgcctaaaacatagtggcctaagctgtgaacagtgattggataaatattagcttttttttttaattaacagttttttgttttggtggatttgaatgacatgtttaattaaaactgtcttttaatttcattttaaagctaaagacatttatttatttttctcttacccattgcttttactgattaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggtactgattgtaaacagtcttttattgcttaaacattcacttttgtgattacatctaattatgtgtaatttgaaaacacaactagggaggacgtttgtgatgatttggcttgatgatgttggaaatatgaaactttgacgtatcagtagatgagatgccagatacttcctggtaaccctggtacattaaaagttgtttggaaggatgtggcgtaactcataggatttgttttgtctctaatttgatacctgtctttacggttaaagcagtttgctgttcaatgacttagggctggaaactaatattaactgctagaagatagttgttaagtgatgatccctttttttgattcctagctcttgattagaatcacttcctaaagcctattcaaatataatgttgagtactattagattataaaaacaacttttgtctcataagttttgaggatgcatggtattaatgatatttaggatttcttctgaaacagagtttttgactcagtgtgaaaggttggctccgttgaacctagtctgtcagatgtatctctctgattgtctttcctactccataaaaatatatataattcacattatatttctctttagctatgtgattaggaaggtctcaggctcttatattagcattttgacactgtttaattactgagtcattaactgggatttttttttttttttactcgattaaccaataactctgagaattccaactttgtattcaccactaggagtgctatgattaacatccgttactttgttgactccttttttttggttgttctatctttttcctgttaaatctcatgttgctctataaaggtattctgttgtcagaagcctaacacagtgttagttcacagttgccattcagaaatgattgttgaatgaatatccatcacgagcagtaaacatttattcaaagcttcggtgaatagactttcctattagaatgtccctacttcattattttcatataattgatagtaaaaaattactctggttttaaattatttatatcatttttaggatggatctgaatgtctaatattattttagatatttggcctacttcagattagacctcatttcccaaaatctcaactattgtaatttcatggaattaaatgactagagataaaaagtcagataaaatcctgtagtcttattcaggggtcagaaaacttttcctataaaagactagatagtattttaggccttgctggccatatagtgtttatcatagccattcatctgtgacagttttgcacaagagcaaccataggcaatatgtaaacatgagtatggctgtgttctgcaataacactttatttatgggcacagaaattttattttcatataattttcatttgtcacaaacttttaactttttttcttccaactatttaagaatataaaagccattcttagctctcaggtcatatggaaacaggcagcaggctgaatttggtctgtaagttacaggtttctaacccttgtcttgagttaaatcctgtaggtcactgtctcccagactattaggagcagtgttgttgttcacgctaggttctgtgataaagttttggacttgttgcccactaccacttttaagagatttataaagcacattggcatattaaaagttgtgagatattttacagacctgtttaactttgttttatgtgttttctccccaacctagacgaccgatgagtacctattaaatattaagggatgctagtgttcagcagataaaatttgagaaatgacagtagactaatagaactacggacttaaggagtggagaaataaattgctaattgaatgaccaattgtattcaccaaattcttgttctacttgaactgctttaggtgaacacaaatccatgtatgttcccaagccctctgctatagctctttttgagccattcttccaacttttgggtcttgtatatcccatcctcccttgatttttctttttgttgttttttctagaggcagggtctcactttgttacccaggcaggagtacagttgataacgatcatagctcactgcctccttgaattcctgggctcaagggatcctcctgcctcagccccctgagtgtctaggactggaggcacatgccactgtgcctggctcatttttaaaattttttttagagacggggtctcaccaacttgtctgggctggtcttgaactcctgggctcaagcattcctcctgcctccgccttccaaagtgctggagttacaggcatgagccactgcagctagcctgatttttctttcccactgttttccattgctaatgctagatctttgataaggaacttttgccagtaaaagtggtttagtgagatgggtccagaattaaaactaatttactaccttagcttatgtgatatttgcatatttaatgtgtatttttgtgaaaacatttttatagcctgttgacaattttattcacctaaatctactcgagtagactataaattcagtgtatttggagtttttgtaaactatagttgttaacttataaaaacttgttttcattggtaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcagtaagtgttgaaatttgttgaatgttgatcagtgtaaattttggtaatcttactttgacatgttgacatagatatagtttcagtaaggctagatgtgcaggtgctgttctagacttagttgaacagtcatttttagttacctttatatatataatttttttttacaaaataatattcgaaatagggtttaattttctggattaatgttgtaaaacatggcatttattttttgtacttcttaaagcttcagttttgtagattattgaaaaattgccaaatgcccacgtttactattttttttcttttgctattgtatcagatcctgcatccaactctttggtcatgacttttagatggattcttgattgattagtttaaagaatagtgggcttctaaatacattgcagtttttgaatatcatatgataaaaccagttttaaaacaggctggcttaagtccttctggaagtaaactcatattttactcagtcttgccattgaatgtcatattaaagttgtttaaaaaatttttttaaaattttctttatggtgttagtcatacctcttacaaaaataggttttctgtgatttttgaattatttactgaagtgtagtactaggttaaaaatagtttcattagctaaaatctgcagtgttacagctgaaggatattctttttatgtttgcaaaggatgggctatggccttgaaaggttgttctgagtttaaggagatagtatttggtgcctaaggctagttgcggtggctcatgcctgtaatcccagcactttgggaggctgaggcaggtggatcacctgagagcaggagtttgagaccagcctgaccaacatggtgaaaccccatctctactaaaagtacaaaaattagccgggcatggtgggcgtgcctgtaatccagctactaaggaggctgagacacaagaatcgcttgaacctgggaggcagaggttgcagtgagccaacatcatgccactgtactcccagcctgcgtgacagagcaagtctctgtcagaaaaaaaaaaaaaaaattggtgtttaagaacaaagtattctaggcttataatcaggaaagtttgaaatgcattgcacactgctaactccctttcttggaagttcacaacacatacaagtatagtaaatgccctgagaaatcctgtagtaagaaaatacacttgtaaactttggcaaccttcatcttaatcacttttggataatgaaaccttagaaaaatctaatgaaaaccacagatacaagagaatattggcacatttttaaaaatttcagtaattcatctatccttgaagtccttggctcctaccttgaaccccatgtgaagaatctgacggatggtttaaaaagcaagtttgaacaggagtgaaagaggtgacatttttcttagcatacacattatcagccttgaagtaattttctggttataaaggtttaggagaagctggtttatttagtaaattaattggtaatctgaagctattcagaaagttactgcgcttttccaagattactgttggtgctaccagagaagatttaagtagataatggccatttagagacagggccgttaggcaactcagaactttctatttcctagtgctttgccctcacagagatgctctttgtcatataaataaatgaagaaaagctgacattttaaatttcagcattgtctcattcagatagttaatttgaatctgatagggcaatacttcataaacttgagtttcacatgaatctccttaggaatacagttttaagtgcagattctgattcatttgacttggaagggacttgagagtctgccttcctaacagactctcttgtgttgccagtattggtctgtggactacacttcaagtagcagattttacaggaaccttagctaatttatggctatgaccacctaaccctagaaatattggtatgttttaatttttctgaaacccctttattctcgggaattacttttccaaatatataattcagccttttaacttcaagacaaagattgacattctgatctttgtgctcttgtccttcatattgaagtataaaaatacctgctgtttgaaatgtacagtcacatttgctcaacaagcattcaagaccatctgtcagtgagtgccccactttaaggcacacacacacacacacacacacacacacacacacaaataaaaggcttgatagcagaatcaaactatacatagcagagccgaagtaatatggggtaaaatcaaattagctcaatccttgctattcaaactctgaactgtggacaagcagcattacatcatctgggatattattagaaatgcgtgcttttgggcctcaccttatgccaactaaatcagtatgtatttttcttcagtatgcattttggcaagatttttggtatgaagatatgtacgtgaaagtctgaaaagtactgaactagaacactggtttatgtggtttttgttccttttgtgctataggaatggtcaagatttgttagaaaaaaggatttttactgtatctttaacctccacctcccgggttcaaacaattctcctgtctcatcctcccgagtagctgggattacaggcatgtgccaccacacccggctaattttgtatttttagtagagacggggtttctccacgttggtcaggctagtcttgaactcccgatctcaggtgatccacccccattggcctccggaagtggtgggattacaggtgtgagccacagcgcccgaccaatttttattatatcttaaaggaagtggtaaatagaggtgggtggggaaaagtttagaaagcctttcaaattgttactacagtaagaaaagtatagagtggggaacaagcaggatgagaggaattgggaacggatatgacagatatttcagcatagtgggaattacactgctgtcttgagagatatggtacagccagttatactgtcccatacttactagactgatccaaatatatatgtgttttttgtgcatgttgacattctttcagaagtagcttgataaatctcatataactttgtttcccatgatggtaatgtgttttaatccttagaaggtctttatatatgaaaatagatattgcatatgaggtaagaatatataaattatgtaataatcgtattttaaacttgagttcagacttagaccttatgagttgaaggtgatttcctgccttactgagtttttctgttatcagacctataatttgtttacactatactcttctgatattattagtagtagccaagattttcttcactcttttcttggaaaattggatagaactgttaaggtacagccttctgggttcttactgtccttgaatcttttcatttcttccttcctccctttcctgttgcacactaatgaagatggacatgaaatggacgtgaaacattaggcaaggcaaggcctgacagatttggctggtaaacaactagtcaactttttgaatttagacagttattaattacttaggcagagaaaaaagtagtccaaggtgccatttctctgtgccccttgtctcacacttgaaaagagtgacaccgaaataaaaggggctagctaacgattgtcccttgaatggtgggacaccctgttgctgaggaatcattgttatactgcagctaagcctgtttagtctgcaaatgtaccctacaaggttgaggaagaaaggtctcatgtttcattagaacctgagaggagatgggaaactctcctgacagaagcatcctggggcaagagagaggtgagtggaaaacgtccatccatatagcaacttctcacaagcctctcttgtccatgttccaggatgattccatggccttctgccaagacagcttgcactgtgattcagaccttaacctctctgcgctctttggacatgtgcaaggtctccagagtgccatggctgatctctttcccttcagtggaggctcaagtagaagtactgtttcttctactaatgtcaccccctcatgctgagaaaaacagaatgagaaagggaaagagtggtgaagtggcataggcgataacatccttatctctcatcagtcacacattagtaccttaactttggaaatctagcctttgatgtttttaatttgggactcatatataaaaccagttttttttttttctcttttcgtagcatcttaataattatagcctacttctcttcacagtttcagctattttggaggatgactgtatgtattcctttttaaagtacctattgggactccccactgagaatttcgtatatgccacattaagtgcattttaattttgattaaaatttattcatcacttttcatgtgatacagtaacagcatttaaatgtttaatttcacttatataaatgttcatgttagaataacatacttaaaatctttttctttagatcattgtatgttattaaatgagcaatagtactaccagtcatgtcattttacatattgcttttggcactcatactctttattgctggttttatattaagatcaataataatcaagaggtctctcttttcagtaaatttcatgcagactcggtggcagaggctaaactttagtttgagagaccagtgaaaaaacctggaacctaaagttgagatgatgaagtcttacataatggccttggaaatagagagggagggctgaatctagatgggatatcacagataataaattgacaatatttgggaaaattatttgttgttagtagacctgtgcggtgatctggaagatgcaagcaaggctttagggtctgctggctttttcctagagtgtcaggagcatggtcagatctccatgattcttggagaaagctatgttggaggagatccttgcaattcctcctgttattaacccttccccttacccccaagagtagcagtgttttgctactgcaagctactagttggcagaaaggttattgagtaagtaggtggcagtcttccttaaccctgtacatgggagagcattagtctttgcagctgaagagactaagcagtagagaagattcctctcattgtcttgatgagggactgacagcttgctagcgaaaatgttgcttgaccacaggaatgagacttccatgcaccctcatcttgccattattaaagctatccagcatttgggtccagccttaagagaaggtgagagtcatgactaggccagtgaatataacagtgcatataaaagggacctagttaccagggagaaaacagaagtagaccactgaaagaggcaaaacctagtgaaaatagaattattgaacaaaatattgaacaaatacacttgaacaaaataataagggcacataagcagattgaattataacaaattctttagagctagaaaaaaatgacattaagttttaatgtttagattatttaaaaaagaggacacgtgctattaagttccaaattacaggcctagaaaatcagggggaagaattatgtcattaaatggaatgaaagtactaacagataaaatcaagagaagacgattagagacttacaagaagttctgaaggggaaaataaaaaaccaggtggacaagcaataactaaataatagatgggatgaagaaagacttgagactgcagatcagaacagctggctgttgtctagccaggagagaagtgagggaaacacacaaacacctatgcagagtctggcaaaatccctgaattccaaggaaaaagtaaaaatcctctaagcttccatatgaaagaccaagttgcatacaaagaaaaagaaccaaaccgacaccaggcaatcttccttaccacacaagcagaagtagaaaaaagtggaatgacgctacacagttgacaaagaactgcaactcaggaaccttgtactcagccaaaggaccctccacatgtcagaatgaaaaggagatactagtttatcctatctgaggaaaactaaagaaacaacctgtgaatcaaaatagagacctttatacaggggaagataaagaagacagagaacagtttaataaagaaaacagtagatcagtctcactaatataaattcaaaagtaaaaataaaatattagcaaattgaatctgccattgtatcaaaagaattctagactatcaacactagagtttatttcagacatgtaatgatgatttgttaccaggaaatctgtcaacataatttattctatcaaagggacaaataatcatagaagctattctcatgagaatttgaagtaaaatgggtataagaaggcagttatgcctgtaatcccagcactttgggagggcgaggcagttggattgcttgagcctggtaggtggagtttgcaatgagccaagactgtgtcactgtacttgagcctgggcaacagaatgagactcagtctcaaaagaaaagaaaaaaaaaaaaaaagcagttatttgagtgtaataaagactgttagccagtgtacatcattgtaaatgaaagtactccagagatatttctatctcagttaggaactaaacagggattccttctgtcccaccatcattatttaccattatttgggaagcattaggtcaaataattggaattataatggtagtaaatattggaaaaggaaggaagcaagttttatgtgttcttttctagtggcatttttgtatactaagaaagcccaagagatactggaaagtagctcctagagttacaaggtaaactgttaaagtggctggttatggaataagtgtgtgaatatttttctctgttgtaatatccagtagcatgaaagtggagaggaacgctcttctcatagtagtactctaagtgtttgagtggggggtatgaaatgtaaggaacaaatttaacaaggaaagtactaggtctataaaaagctataaagtatttttgaagaacatcagaaagattgaacaaatataaaaacataaccatgttcttaagatggaaaagatggaaatgcataagattattaaataccatttctcctgagattaatacatacttttaatttgattccattttgagtccccagagattgtttttaaaattaaaaacaaaaaacaacaaagcttatgtggaaggacagatgcccaagaatagtcaagaaaaaagtgaagctagtgggacttgccttagcagatatttgatcatcctgtataacttgtgtttctaaatgaataaaaatggcattggaatagctaagttgaacacataaatgtccaaaagtaaaaccccaaatattggaatttaatatattgaccgatgtgtattttaattcagtggaaagagggtaggtatagccacctatccatgtggaacaaaaaaaaaaaaggaatttctaccttgtatatataccaaaatattttaaaaacttgaaaattttatagaatatatgtataacctatcagtgggtaagaccttttaaaccaagtcatgtcacataaaagataacaataagaaaggcaaatgtatttgactactctccctctataatggatatttgtatatatcggatgtgattcttatgtctcctaatattaaaaattgctaacttggaattctagtagagatttggggtcatgtaaggtctgccatatacttcgaattggaatatactcattaagatgagtatcaaagaacagtgaaggttagatttattactgttagctcatgcttccaaagggtattgcaaagatacctccaagacatatttactgttttgtattctatttataccaggccttcctagcattgtaaattgagttacctgtactgttacacaatggaaaccgatttcccttttagtttgagttagttgcaactgataacagttgtcactttttttactcaagggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcaggtatgttcttttttggtttgcattaatataaggaggttttcagcttagatttgaaaagctataataaagcaggtgttaaaattggtgtttcacacgtatctatcatgtggaaggttttatagtggaaattatagtacacattccttgatactgaaaaataaaaactgaaaatattttgtgttatactatttaatagttttggacacattttaataaaattctaaacaaaggatagttacaattgtggaactcttcaaattctgaaaatcttatctgattaagaattagatatgaaatcatgtcatctcctgcttcaatcctttggcttactgtgcctacaggataaagtctgaatgccttcatggaacgtacatggccatcagggatttggttccttcctgcctctccagactcatttctcaacacactctgccttgaacttttttctttctgtggcactgaactggagtttttgtatagctatcacattctttcttaccttggtagctgtttttctatctcaagtcctttctgccttttttgtaagttcgtttctctgctggactcttaatacaattttaattctgaaactccattctaatccaagctaggatagtttcccctttctcctgttttccttgtagcttgtgtaaacctattttgttgccttaatcacattattatagtatttccctgtttgtcacttttttgagtcccttggcagcagataaaagcaccagtagtttcctaatttgtaaagagcatctcaaagaaatatggagagagagaggcaataacatgacattagactatagtggatagaccttaatctagtagctttcattgacattagtataaaatgcatgcgttttttgtttaaaaatgataacagcagctatcttttgtaccatgctccattattttcaaattaccaacaaatctcatttgagcctcataatgctgagttggttttatttccatttttcggaggaaacatggtcaaagagggaacttttttttgttttgtttttcagtactcataaaggctcagtaatgtaaactggtacaactttcctggaaagcttcagaagtcatgcccttaatccagtaattgtacttgtagtaatccatcctaagaagacaaaaggggaaaaaaaaaaaagacattaagatttagtgttgtctcaacagtatggtttcaactatgtataaacaaaaatttgaaagcaaaaaggccggaagaaaatgcatcaaaatgttaatagtggttttatcatctttaaactcataatgagcatttatcattttgtaatcagaaaagaaacatcacatttgtttgcattttgaaatgaatttctcaagcttacattgctaggaaatggtaaagctgaacttagaagctgggcttctgttaagtctgtgttcctttctgcaaaaatatcaatcctattcttctgaacccagaattttactaaaattttataattttcatctccttttactctctaccaaatagtgatatcttcaaaaaataaacagtccggtagaggtcgaagaaggacactaaactgaaagtcttaataaactgagtatcaattacttaaataataattggacatagtacttcaggccctattactgttacttagtgaaatataatgattgaattttggtgaattaaaaaatgtttgaatatataaatatacacaagtttacatatttacattctgaaaagattaaaaaaaaaatttttttttgagaccgagtctcgctctgtcatccaggctggagtgcagtggtgcgacctcggctcactgcaacctctgcctcccgggttcgagcgattctcctgcctcagcccactgagtagctgggactacaggtgcgtgccaccacgcccggctaattttttgtatttttagtagagacagggtttcactgtgttagccaggatggtctcaatctcctgacctcgtgatccgcccgcctcggcctcccaaagtgctgggattgcaggcatgagccaccatgcccagccctgaaaagatttatttttagttttaatcattaccctaaaattccttatagcatgtaaggcatgttactttttgtaactgtactcataacatatgattattagagtatagcataataggactgctagtattaaattacgcagtcttcttctcccgtgggtgttgtgggaggttcaccttgatgtgtatgcttctaaaaatgaatgatagaagtttattatgatagtcatcatcggtcgccttaatatacgtttatagcaaaccttttgagattttttttcttgagattatttttaagtagagcgtaagccttagttcaggcaaacaattttaaagaaattcgcttatttctttttttcattcacttattcatgttatagaccctgtctttactactcatacacattttatgttcatccttatgtctgccctttcctacagcacatgctaggagaatactacagcagtctaacagaaatgcatgcaatgaagcgccaggtaacaatctgcgtagttttggtgtccactttttgttaattttttcccattggtcctaaaggttttattgtcctgatttttttcttttttaaatttagctgagagtatatatgttatgtgactattgtaaaagataatttatattcataaaattctgaacccattcatttataattcttggtaaaatttgctgcttttgttttcatattctgttagtgtatgtaacctaacacattcataagggtaacagaaaccttttttacggtttagtacttgatttgaggttattttgtacttcttcaaagcattagtatttcttagacctagaaatatagttacttttatagtttatctttccatttcagtcagcatcttagaaaagtcatcaaacaaaacaatgattacatgcaaagacgtgataaataaagatcatggaaattacaaagattcccaaatactattttagtctctaatataagtattctcattaaatgtggttctttgtgatttagagttgtaaatatttttttaactcctcttgcagctttacatgaatgaaaagtaaaagccagtttgaatggaacctttaggggaatctaaagatacaaaacaaggatccagaactgacaaagctgaatatatcagtggcactttgaaaataaggaactctgaaaataggatataaaaacaagatggaattagagaaacctgattaagattagggatttttccagccaaagctaataaatttcagttcaggaggagaaactggcataaactttccacctcttgactgcagaagtggtgggggaatgaagcttgtgtttaaatggcatattcattatttgagaataatttaatttttaatgatacgcaatttagattgataattttatcacatacagaggtattaaatatgtcattaaacagttatagctttgaaatgaattttttaaattaagtatgattaaactgcaatatagtatataagataaaagtttgcatatcaaaattctttttacctggatttttcccattagaagagattgcttacagagataattttggttcctgcttattataataagtgtcatttttgtgatagttcataccttaaaactacgagaactttagtgtatcacttgattttatacctgtaactgaggcaaaatagggaagttgcatatttattgttacatataattaatatatttttctattgatatcttatattagtaatgttattatttcatgcttgtggaaattgagacctgaagatattaaattattagccaagtagtggaaaatttttctattagagcacattctttttccattttcttattcctctcacaaaaatgagtttttatgatcttgtatacttctttgaaagcgcaatgtattaagatactcaacattttaaatggatacctttgagtgtaataattttgtgttatcaacaagtaaatttagccgaattgtagctaaataatagagtgatgcctagattctgtgaaactgaaaacttcagttggatcacttgcctgctccaatatacactgagtatgtaaataagacacaatggtgaaattgacctattatgttaggttacagatttggttactcatcatcacagcacttttctgtgtgatgtatgagatttgataattagtagactatactggatagaccttaatctagtagctttcattggcagcattcagtttattctttttaacattaacaaaatatacaaacttccttttctgtaatgaagtccatattagcaaaagcaaaaaagaaattagcacttagcttatttctaagtgttgaaagattttcactgatttttcctataaaatgtataatattttctgtatattttatatgatcagaaataaacatggttcttagtaatgctaggtaatgttattcattaaagtttcatttttagtataaaatgcatatcttgatattttaagattttatttatcttggtaatattaagcttcttttctactttaaaagctctgaaatagaattgtctaaaatagaatttttagataatttaaagctgagagtaatgatactagctaataaaagttgtcatgaaggtacttcatcaatattaactttctggtcttttatgtattccagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggtatctggtacctaacataatttttcctaccctattatcaccttcttcatgattatctctggttgctgtcttagactgaagcatgtgccatatgaattttcatctgttctctatgtgctttcttgacattttatttaaaatttttgtatagcttaagtagcattaaagtattttttttgagtactttttcagtgttttgtctacttcctcacacttaacctgtgagggtagaaacagtacatttttccttccatctgcttttatttttgaatctgtaatataaatgaatgattaagcatgtatgttttatataaatgatgatcttattttcttatttaggacatagtatccagacatatttctgagagccatgaaaaaggagaaaatgtaaagtcagtaaactctggtacttggatagcatcaaactcagaacttactcctagtgagagccttgctactactgatgatgtaagctgataatgattagtgaattgtagatataattttagtatgcagtaaataaaagttaaatagattattgtcaaattgtaggtagacctaatatatttgattttcagctttttttaaaacttgggtataatgtgttattttattttgagggcgagatataatatgcaatcaaaatatggtagcaaacaccaaaaattatgtatgtatgatagattatgaggtctgagatagccatatttatgttgttattacccagtataggggctgactcttaaaagacatttacaaatgtatgttgtatttatttaagacattcagtaaaacaggtatcagattacagtaaaaacacttgaatgaataaatacaggataaatcaggtctttgggttaaaaaaaaaaaaaaaagcctagacaaaagtcttccaggaaaaaaattgtaatttaatgtattctaattcatggagaaaattttgaatagagtaaaaaggacctggaaatggagaagagtgctaaggagaatggtataaattcagtaagctgtgtcctccaaatagcacttagcacatcgttgattgaataacagtgacagaactgctagtatattgaggagataatgtgctaggtgtttgggaatcacctatttcaaggttcaggccttgattttattgtaaaatatttcatgtggtcgtgggatagcaaatacattcctttttttatgacaactctagcacctagagatacatgggtaagagtttcgtagttgattagcaaatatcagctataggtagagagttggaatttactgtttctgccttttgttgaagtgttaatactaagttttttctgaagccagtgttttctcaaaggattgtctttccttttcagatacagtaatttctgagtttttctgaatttttgctctttaacttctactcgtgtttaaaataataacttccccagctcatcttttctgtttaaaatgttttcccactggactctgactcctttagtactataacataaacctgtgtctaaaaactacatggttttaattaactttgcaatgtgaaatgtaaattagtgtcagtcagtgtttgctcctttggattgttataactaattgaaaattgtgtattcctttttgtgggaaatgaaatgcgacctgcttgaatacattaaaaatagatgttaaattatattaaggtttattgggcactgaaacaacttgagagagaatgaacagtctccattcctagacgtatttttcaataattttatatccttaattccagtgctttcacttttatccaagtttcatacaggcagcattacttccatttattttaagagattggagcacattggtttgcaccatcgatagcacattttgaaagttgagctacagtttaggataaagttaacctaagaaggttttaaagttaaatgaaatttaaagatgctgtactacttgatacgtaaggacttgggatagtaattgtatttagtattacttttaattaagtaactaaatcagttctttgatatttcttccaaaacttaaattcagcattaaggtcaacatcttccctttactaatgccatttaatcagcagcaccacaatatccagtgttgatactcacagatctgaagcagcagtgtccagtagaactttctatagtgatggaattgttttatgtctgcattgtctaatgctgtagccattagctacatgtggctagcaagtacttgaagtatagctattgtaactgaggaactaaattttaaattttatttaaatagccatatggtgttttttgtattggacagattcagagcctcattctctagatgcttctatgcttcttgagcttcatttttggagcttttacaaacgtatattaagatgtgtaagagatacctctcttgcctagggaagagagaaatgaaagtgaaactgggaatctgggagctgtaagtcaaggaggatggagtggagacactgaggtttaggaagaagaaaacacactttgtgtctcctgctcccgatgataataaaatggtaaaagcacatctgtcttgaagacttgaagcacatcaagtcttacttgaaacagtaaaaaaaatggtttccctattcctaaaatacgttccttaatgtctaaatttcctttaatcagggacaaatgtttgatttcataattgaagataggaaactttaaaaagatcattagttaagggaaagaacacaactgtaaaatgtcataatcaaagtgtaagtgagacaccctaccaccatcacactatacacaaaattaatttgaaatgacctaaagtcgtgtaaaagccaacactattaaaacttttaaaagaaaatgggaaaaaattatgaccttgacataggctaagttttcttaggacagagaaagcactaactataaaagaaaaaattaagaaattagacttaacaaaaataggaattttctgcttttcaaaagatactgttatgggaaaataatcccagtatatatatctgacaactgtctgatatatagactgtataaagcttacaactcagttgtaagacaactcagtaaaaactgggcaagagatttgaacaggcacttaatgaaagaagatatatgaatggctaatatgcaaattaaagccacagaaaataccacttcacatcaagaatggctaaaatgaaaagattgacaataagaagtgttggtgagaatgtggaacagttggaactctcacagtccttatgagaatgtaaaattgcacaaccacttggaaagcagtttggcagttgcttataaacataaacgtggcatgtgacccagcaatttctcttctaggtattcatccaagagaaatgaaaatatgcatcacaaaaacacttgcacattaatgttcatagcatctttagtcatgatagcctcaaactgaagcatcaagagataaatggataaacaaactgtggtatatctatacagtggaatactgtgcagccattaaaaaataatttctgaacttctgaaacacaaaacatggattcatttcagaaacatactaagtgaaaagtcagacaatgaagagtgtatattggctggttccatttgtatgaagttctacaaccagcagaactgatctacagtgatagaaatcatgagtagggtgtggtggagattgactgtagagggttgtgaagaaacgtcctgggccagtggaaatggtctttatctttagggaatctggttacatgagtgtatacatttgtcaaaactcatcaaactgtacatttaaagtgagtgcattgtatattaattatatttcaataaagtttattttttaaaaatgcaaatgatgttgtgatgttttcttttctgatgtgagacaaccaggtagagtaagctactagacattgttagcatttggagataggagaatgtccctgagagtatagaaataatgtaaaatgttaactttgccaaattagaatttaatcagtagctgtctttgtgtgtgtttatctacataataaatattctgcaaggctacttatatcactgttctctgtgactctgtattcagcgtttaataactttggttatattatcatcttgtttggacagaatactgaggaaacttatgaatatcttttaagtgtacaattttatgtaaatacttagttatctctgttagattattaatatgaaattcttagaagtattagtgatttttgtttgttttactgtaacttaggaaacttttgagaagaactttgaaagagaaacccataaaataagtgagcaaaatgatgctgataatgctagtgtcctgtctgtatcatcaaattttgagccttttgcaacagatgatctaggtaagcagaattgtttataatcttagaaacaactttaagttgatctggtccagtctttgaattggcgttgataaggaaacaagtctagaaaggcgaagtgtgtgtggttgaaagaatgtggacttaattatctatcagtctaaaatcaagaatcttctgactcttaaccctgtgagcaaatcatccaacatttttgactctgcatatactaaggaaatgggaattttaacctaccttgctatgttcttgtgaaaatataatgtaacttacttgcttgagttcagaaaatgttaatttccttttccttaaaggaaaggtcatcgtttaaggtcatctagttaattcatgggaacaattcaggcctcatctaatcatatttttaataaaaatattaactttgtaatttgagttaagcagtcagttttcttaaataacctgtagtgaaaacctcaagtaattctcaggcatagcaaatggttttggttgtttttttttgtttgtttgggtttttttttttttccccctctcccatcagctgtaaaacaaaagaggtttagagggttgcctggctgcagtggagaaaaaattcgagtcctagacttggaaaggaaatttaaggaaaagaaaaatatgtagatacttgatacgtttctagactgtggccaatcaaaagagaacctgagaattcagtcatttgccatccagggtgcttagttgataaaataatgtaatgtcctgttactctagtgtttgttcacgtgatgaagagaagacttagattatttcaaaggtatttttccactataaagaaaaggacttagccttgccctatcattacattcctactgttcgccaaaacaaaagtcttccttttgcttattgtaattattgaggactcagccttagctgacctctaagtaaatgcttatttgggtctgcattgagttcatcccattacagagaaaaattactgtgtggcctgccaaccctcaccccttaggttgtccctctctttctgagttgccagaatacttcgactcctacgtattttctttcatttactggtatttttttttttttcttacaaacctgcaccagtagctgtgtctgaagtagacatagaattgggaaatttcattgataggcctttttcttacctaatttgcttgttttaggttgcgttgttttcatcagaatttgcatgacattttggaattcacttgtattgtttaaatgaaacaacaaaatgaaataaatatgggcttcagagtttgataactaagtttaaatccttgttcctacattgaactgtctgtgaaagcttgagcaagttacttaaattttctgcaaatgaaagtaatgtcatctactatataggattattttaaggattaaataagtgtgacaatgtatatgaagtgctcaagtagtatagtgtgtagaacttgttaaagctaattttcctcccttttgtttggacatttttttattaatgcattttgaggaatatatgaaaaagttcacttttacatactcaaaaaatatttttgttccaaatgtaggtaacaccgtgattcacttagatcaagcattagccagaatgagagaatatgagcgtatgaagactgaggctgaaagtaactcaaatatgagatgcacctgcaggattattgaggatggagatggtgctggtgcaggtactacagttaataatttagaaggtatatatttttgttttcggtaggtttttggagaacaggtggtgtttggttacatgaataagttctttagtggtgatttctgagattttggtgcacccatcgcctgagcagtatacactgtacccagtgtgtattgtttgatccctcacccccttcccaccctttcccctgaaaccccaaagtccactgtatcctgcttatgtctttgcatactcatagcttagctaccacttatgagtgagaacatgcaacgtttggttttccattcctaagttacatcacttagattaacggtctccaactctacccagatggctgcaaatgccattactttgttcctttttatggctaagtagtatgctgtggtgtataaataaataaacaaatatatctgtctatctacacatatatacatataccacattttctttatccgctcgttgattgatggacatttggactggttccatattttgcaactgcagattgtgctgctataaacatgcacgtgcaagtatctttttcatataatgacttcttttcttctgggcagatacctagtagtgagattgttggatcaaatggtggatctactttcagttgtttaaggaatcttcatactgttttccatagtggttgtactagttagtttacatgcccaccagcagtgtaaaattgttccctttttaccacatccacactaacatctattattttttgatttttaaattacggccattcttgcaggagtaggatggtatcacattgtagtttgtgctttgatttgcattttcctgataattagtgatgttagagcattttttcactcaacatcaccaaaaagttttttggccatttgtgtgtcttcttttgagaggagttgtctatatccttagcctactactactacttttttttttttttttttttaatttgagcacagtcttgctctgttgcccaggctgcaatgcagtggcacaatctcagctcactgcatcctctgcctgccaggctcaagtgattctcatgcctcagcctcccgagtagcaggcattgtaggcatgtgccaccatgtccagctaagttttgtatttttagtagagatgggatttcagcatattgtccaggctggccttgaactcctggtctcaagtgatctgcccacctcagcctcccaatgtgctgggattacaactgtgagacaccacacttggccttagcccactttttgatggttttttttttttttttttcctgatttgtttgagttctttgtagattctgggtattagtcctttgtcagatgcgtagtttacaaagactttctcacactctgtgggttgtctgtttactcagatgattatttcttttgccgtgcagaaactttttagtttaagttccatctgtttatctttgtttttgttgcatttgcttttgggttcttggtcatgaagtctttgcctaagccagtgtctataagggtgtctccaatgttatcttctagaatttttgtggtttcaggtattagattttgaaggtatattttttattgattacaagtaataataattctatgtaaaaaatttaaatatgtgatatctaatggtggttttattactactttattttaattgataggggtgcttaaactacaaacatgtttctttgtattatgttagcataaaatcatcaaatttaatatttttcaaatttcaacataaaggcatatatgtatatataataggctttgttaggctaatgtattttctttttaaaaattagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggtaagcaattattttaaaaaataaacgaaaccttctatgttttgttttttaattcatacagaagaccttattgtgataaagttcaacggtataggtaaacaacaacaaaaaaactatcacccataattttttcaccctaccaacattctctgaacctttcagtaatattttatacacatgtgcatattctgcctttttcatttactatatcataaacttctttctagatcattatttttctgctgcattttttcaggatttatcacctttatttttagttttagtttttgtgagtgtatagtaggtgtgtatatttatggggtacatgaaatagtttgatacaggcatgcaatatgtaataatcacatcatggtaaatggggtatccatcccctcaagcatttaacctttgtgttacaaacaatccagttatactcttttagttattttaaaatgtataattaaattattgactgtagtcaccctgttgtgctgttaaataatagatcttattcattcattctgactactttttgtacccattaaccatcttccctattccctactacctttcatagcctctggtaaccatccttatacagtttatctccatgagttaaattgttttaatttttagctcccacaagtaagtgagaacatatgaagtttgtctttctgtgcctggctaacttcacttaacataatgacctccagttccatccatgttgttgcagatgacaaggtctcattattttttatggctgaatagtactccattgtgtgtctgtaccacattttctttatctgttcatctgttgatggacacttaggttgcttccaaatcttggttgttgtgaacagtactgcaacaaacatgagtgtgcagatagccctttaatacactgatgtcttttcttttctgtatatacccagcagtgggattgctggatcatatggtagctcttgctgtattttcagttttttgagcaacttccaaactgttctccagaggggttgtactaatttacattcccaccagcagtgtatgaaagttcccttttctccacatcctcgccagcatttattattgcctgtctttgggataagtgccattttaacagaggtgagatgatttctcgttgtagttttgattgtcatttccgtgatcatgttgagcaccttttatgtgcctgtttgccatttgtatgtcgtcttttgagaagtgtgtcttcagatcttctgcacattttaaaattagattattagattttttcctatagagtttgaactctttatatatgctggttattaatcccttgtcggatggtttgcacatattttctctcattctgtgggttgtctcttcactttgttgtttgtttcttttcttgtgcagaagctttttaacttgatgtgatcccatttgtctgcttttgctttggttgccagtgcttgtggggtatcactcaagaaatttttgcccagaccaatgtcctgcagagtttccccactgttttcatataatagtttcatagtatgaggtcttagatttatgtctttaatccattttgatttgacttttgtatatggtgagagatagaggtctagtttcattcctctgcatatggatatccagttaccccagcaccatttattgtgaagagactgtcttttccccactgtatgttcttggcacctttgttgaaaatgagtttattgtaggtatgtggatttgtttctgggttctctgttctgttctatcggtctgtgtttctgggttctctgttctgttctgtcggtctgtgtttctgttgtttgtatgccagtaccacgctgttttggttactatagctctgtggtataatttgaaggcaggttaatgtgattcttccagttttgttctttttgctcaagatagctttggctgttctgagctttttttgtggttcctataaattttaggattcttttttctctgtgaagaatgtcattggtattttgatcacaattgtattgaatctgtagattgcttcggggagtacagacattttaacaatattgatttttccaatccatgaacatggaatatctttccctttttgtgtctttttaaatttctttcatcagtgttttatagttttcattgtagagatctttcacttatttggttaattcttaggtatttaattttatttgtgtctgttgtaaatgagattactggtggcatatagaaatgctactgatttttgtgtgttgactttgtatcctgcaactttactgaatttgttgatcagttctaatagtattcttgtggagtctttaggcttttccaagtataagattatatatatatcatatacaaacaaggataatttgattcttcctttccagtttggatcccctctatttctttctcttgtctgattactctagctaggacttccagtactatgttgaataacagtggtgaaagtggacatccttgttgtgttccagatcacaaaggaatggctttcagtgtttccccatttagtatgatactagctgtgggtctgttgtatatggcttctagtatgttgaggtatgtttcttctatacccagttttttgagggcttttatcatgaaaggatgttgaattttatcaaatggtttttcagcatcagttaaaatgatcatatgggttttgtccttcattctgttgatatgatgtattacattgattgatttacctatgttgaaccatccttgcatccctgggataaatcccacttggtcacgatggatcatctttttaatgtgttgttgaattccgaggtatcggttgtaatgtctcctttttcatctctgatattatttgggttttttgtctttttttcttagtctggttaatggtttgccaattttatgtatcttttaaaataccaactttttgtttcgttgctcttttgtattttatttcaatttcatttatttctgctttgatctttattatttcttctattttgggtttggtttgctcatgcttttcttgttttttaacatccattgttttcgtatctgttatatgtatgtttttggatttcaggttaccatgaggattgcaaatactgtcttataactcagtattttaaaccgataacactgattgcataaacaaacaagcaaacaaaatgaaaacttatgcaaatgttaactttgtttccctgctttttaactctttgttgtttctctttatatcttactgtaccatgtcttgaaaagttgttgtagctactatttttggttggttcatcattttgtctttccacttaagagtagtttacacaccacaattacagtgttataatattctgtgtactttctattactggtgaattttgtaccttcagacgatatcttactgctcattaatgtcttcttttagatggaaataaagtatttagtatttcttgtcagacaggtctggtgttgatgaaatccctcagcttttgtctgggaaagtatttctccttcgtgtttgaaggatatttttgctggatgtactattctagggtaaaagttttcttccttcagcacttgaaacatgtcatgacactctctcctgacctgtaaggattctagtgacaagtctactgccagatatattggaaccccattatatgttatttgtttcttttctcttgctgcttttagggtcctttctttatccttgatgtttggcagtttgattattaaatgccttgagatagtcttatttggattaaactatcctggttttctgtaaccttcttgtacttgaatgttgttaagcttactacctctgtctctctctaccccctctttaaggccaataacttagatttgtcctgttgaggttattttgcagatcctgtaggtgtgctttattgtgttttactttttttttcttttgtctcctcaagttgtgtgttttcaaagagcctgtcttcaagctaattctttagcttgatcaattctattgagagattgatgcattctttagtatgtcagttgcgtttttcaactctagaatttctgcttgattcttttaaattatctcaatctgtttattaaatttatctatgaatatagaattctgaattcccggccaggtgctatggctcacacctgtgatcccagcactttgggaggctggggcgggtgatcacttgaggtcaggagtttgagaccagcctggccaacacggtgaaaccccgcctctactacaacatacaaaaaaaaaaaaaaagtagctggacatggtggtgcgcacctataatgacagctacttgggaggccgaggcaggagaatcgcttgaacccgggaggcggaggttgcagtgagccgagattgtgccaccacactctagcctgggtgacagagcaaggctccgtctgaaaaaaaaaaaaaaaaattctgaattcccttcctgtgttatcttgaatttgtttgagtttcctcaagacagctattttgaattctctgtctgaaaggtcacatatctctctccaggattggccactggtgccttatttggtccctttgttgaggtcatgatttttggtccctttgttgaggtcgtgattttctgtatggtcttgatgtttgtggatgtttgttggtgtctgggcattgaagagttatatataggccttgtatcttgtaggcctcacagtctgggcttgtttgtgcccattcttcttgggaaagctttccaggtattcaaagggacttgggtcccaagcccaaaaacactgtgctttttgcagactcatagcggtataccactttggtgattttggataagatccagaagaattctctgaattaccaggtggagacttctgttctcttcctttactttctttcaaataaatggaatctctgtgttgaaatgcctggagctggatggagatggggtgatggaggcacccctttggtgacttaccactgtgactgtgctgggtcatacctaaagccagcacagcacagcactggggcttgcccaagaccctctgtaaccactacctgactaccgcctaaatttgcctaaattcgctcaaggccctagggttcctactattagcaggtggggaagccagccaggtttgtgtctttcccttcagggcagtgagttcccccaggtccctaatgggtccacagatactgtccttgagcttagaaatctacctggtattctgtcctactgtggctaagctggcctttaaaccacaagacaaagtccttcccacttttacctctgctttccataagcaaaggagtctctcctggtggctaccactgtgaccaccggcccatgagttctgctaatattcatttaaagcccaagggctttttagtcagcttgtggtgaatgctgccaggcctgggactcacccttcagggcagtgggctctcctctggcccagggcaggtccagaaatgctgtccaggagccaggttctcgaattgcggatcccaggagcctgcttggtgctctaccccactgtgatcgctctggtacttaaggtgcaagacaaagtcccctttttcctctacttttctcaagcagaaggaatctttcaccatagccatcacagctcagtatacgttggatctcacctgaagccagaacatctctgagtctcacccaaggcccatggcatactacatgggtatcactgtcagttattcaaggttcaagggctctttagtcagcaggttaagattaagccaagattaatccttccaggactgggtctttccctttaaggcagtgggtttccttctgggccagagtgtatctaaaaatgtcatcttggagctggggcctggaatggcgacctcacgactctgccggtgccctgttgtagctgtggctgagctggtatccaagatacaacacaaagtcctttttactccttgctctcgtctcctcaagcagaaggagtcacttgcattgctgcagtcagtgctgcctggggttgggggaggggtggcgtcagcaattcaagatggtctttcctaccctcagtgtccctttcagcaatacaaagttaaaagcaggtaccatgattgctcacctggtttttattcttataatggtgctttttttgtgtgtagttgttaaaatttggtgttccagaaggggaagatgattggtggaggcttctgttctgccatcttgctccacccctgcctttttttttaatggatccacaacattcattccaaaatatttataaaatgcctacttaatgccaggtttggcagacctagcagtgaacaaggcctttgttctcatggagcttgcatgctagagtgggaatacactctgaaataacataagtaaataaaagacatataagtaactgtttatcagttaatgatacaggccatgctcagaattaaaatttggtgatatgatggtgtctgttttatattggatgatcagggaaagcttctaatgagggaacatttaagtagagatgtgactaaggagccagtgtaaaccaggattgttctagacagtgcactggccttaaggtgagaattagcttcgcgtgttgaaggaactagagggaaagtctatatggttggaggatatttgtatgagactaagttgaaagggaggcaagggctaattgtataaaatattacaggccatggttagaagtttggactttgctcaaagtttgaagggaaactcctagaagattttaagcagagaaaaaaagtctggcttgtttttagaaaattgattataagggggtcaggagtgcagtgagatcagaagagaaatgatagtggcttagataagggtggtgataaagaaatacgtaattgggatatagttaggaaatcagtaggtcctactaatgggtagagtgtcgagagagagagaaaactggctaggaggaaatacgatttaccaaaatgaagaaggcttgggagaagggggagatgaagagctctgttttttttgaggggggtggggtttgagacagaggctcactcttatcacccaggcgggaatgcagtggcgcgatctcggctcactgcaacccttgccttctgggttcaagcgattctcccacctcagcctcccaagtatctgggactacaggtgcctgtcaccatgcctggcttgctttttgtatttttagtagagatggtgtttccctatgttgaccacgctgacctcaagtgatgcacccgcctgggcctcccaaagtgctgggattataggctcgagccactgtgccagccaagagttttattttgtactttaaaattgaactgtcttttagacaatcgtagagaggtcaagtagtcatttggttactcagctaattccaggcacagctggagatagacataaggtagattatagcatatagctgctgcctaaagccagggcatttgatttgagaatagaaaggggccttgcaactgtgatgtgggaccaggtgattcagcatttgtaagttgtacaaaagcggagccagggttgaccaagaaggactgcaaggagttagttatgttgatggctgctatgaggtcaagtagtcataaaatacaattttctattaattattttttcagtccctgttgttaaatatttgtgtttattctggtttcttttccactattacaaacacttattgaatgattgaaggtaatctgtttacttttgtttctctagaaacaatttttagacataaaatttttagttcaaaggtcataaacatttttaaagctttttagacaagctgattgtccttcagagaaactaaccagtttatattcccatcaacattgatagtatcagactggtaagcagtactattaatttcatttaacaacattgatcagggcagatggagacatgtgcaacaaatggaataggaagacaggacttctttctgagatggcattcattacattctaatttaaaatggaagttttaacaattagaagtgaaaagtaattgttttcttttcatctagatatggtaaactacaaaatacattgtcactgggctagtttcttatattgtactcatacttttctttgtaagacatgtaccacagagaattgcttccattgtgctcatatttcttccctcagcagaagtaattgcttttttttggaatgttttgagagaagagagatctttgagaaagcacctgtagaaactgctttctctgtatctgactttacagctgagaggaaaaagtcagctgatcgtgtccagattattccatgtaaaaacagaaacacgtagccttgttctgggcaattgcaacagttcctaaatggccttactatccttttgccgctgcttctaacctttcttttttttttttttttttttttttttttttttttttttttgtggagagatctgttaaattttttttttctttttttttttttcttttttttattatactctaagttatagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagttgacagtcccaccaacagtgtaaaagtgttcctatttctccgcatcctctccagcacctgttgtttcctgactttttaatgattgccattctaactggtgtgagatgatatctcatagtggttttgatttgcatttctctgatggtcagtgatgatgagcatttcttcatgtgttttttggctgcataaatgtcttcttttgagaagtgtctgttcatgtccttcgcccactttttgacctttcaactctcctactagagttgttagcacttctgaggccttggcacttgctaatacttctgcctggaatgctcttccttcacatacctacctgcatggcttgttttcttgaactcaactgtttggtcaaatgttaacttttgctgagtaaacctctgccttatcctttacctgcttagtgcttgcacgccacctttaacctatgtaatatttgtctgcctctccatgctaaaatacaagatccatgacatctgagatgttaatctcttttggtcactgtccaaaaatagtacatgcacattgtagacactcagtaaacattaatgaattaataaatgactggaatcttcaaccctcaactgtagttgagctctttagacgctctaagtgtgaaaacaactggcccataggataaagaccaggttcattgtcactcataaaaccttttacagcttggtctggcctcttaagccttgtgtcctacttgacattattgaaaaaggcacattgcccacattatgtcctttacctagaatgaccttctcctctttctctgtcagtttctcctgtttttcaggagccagcccaaatgttattgcatgtgtttacaggcagaattccttcctctcttcactgttcctgagatactggattcatgccttcattatagcacttatgacaaaggatcataattatttgtatctcccccctagaatagtatctcatagtacctacagccaagaagcacttaagatactggataaaaagaatttgagggataaggcataaatacatcagttttaccaagtgttttgtgaatttatttcctgttacttataaatatatgtatatatttaccttccataaaagaatatacttataaattttaagaatatagattttttatatagatatttatctcagagcttgaaaccattgcctcaagtgaattggtttaaattttcttagttaatgcttgctttcatcttaggcctaaagtattgcctttttgcttttatacttttattttagcattaatagtacaataaatatttgtcaacatgtcttttaaaaactaataggtatgcttgtagtaatatttatttgatatgtacagttactttataagggttaaaaaaaaagcctaaatgatctatccttatgcttagggagtgcagccttcagttaggaaattgattgtttttacttttttgtgtctgatttgatggaagaattatgtaagttacatgctatctgctcagaaactgttatacaataaaatatttaatacttgagcgaaatagaagtcaccttgagtctgtgaaatgtttaaaaagtcttgaatttaaaagaattacattttttaaagtgatttttcttaaatgtctaagatattaggaaatatcaatggtattttagttggctaaagtggctagtgacactcatttaataggttttccatttgaccttttaagcgctactagcatatctagagttacctaaatcacaacacttatcttgtcaccttgtgtaaaatctaaattgttccttctcactttacctgtgtagccctgatttaagtgatttcatttcatgaggaaatgaaataataaatactaatttagcatttcaaaaagtgtctgaggccagtaaagagtagaactaataatctgattttaattatttatgatgtctcatttcacttcagatcttgactttttttgtaggactgtagaacttctttgttaattatgcccaggcagcattacacccagtcacctgagttagacttcttgactctctttatgtcatcactagtgagtcaaaaatgtattctcctccttagagtcatcaatttgacttcactttcttctttctagtagcatgaccttaattcatattcttaccttttgcttagactacctgtcgtaataggcatgaagtgcatttttactaagccgtgtcctacccaaactccttagtcttcaagtggcttcactgctggatctggtgtgctttccccctctagctactctccatctaggtacattcacttcacattattcaacattttccatatctactgttactttttcacgtattagctgtttgtacaagttgtcttgtctatccaagaggtaaaatactttcactcttttctgcctggctgaaatatttcttcagaaatatttgttgttgcctccagtatgctcctacagctccttagagcacctagtgggtgctttttaaaaatatttatttattcagtaagtaatgtctcctgtgagccactgtattttgtgataaataagaatacctgcagttaaaaaagtgttatctaccagacagcacggagcttatagtgattatttatatacgtatctgactcctgcatagtatttgactctctgaagacagggacagttgtgttgttgttgttgtttttttttttttttaaatcgcctgtcttgacacatacattattttaaatgagcttaagtctgagaggggaccttgaacatctagtttggcaccctcattttatagatatgtattggtgggggggactgaactgagaaaaggtttaggatttgcttaaatggatttagtagaataagaaggattagaaccttgagattacttgatatcgatgatttatggactcaacctcagaaagttaaccatgattcatattattttgtagctcacacatgcttctcaaggaagtttaagaagagacacttgactgaagtgatttgttaagaaagttagggggtgatgttaaccctcaagacatttcagaatgtctaaaggtatttttagttgtcgaggtggtgtagggaggaggtgttactggcatctagtgggtagaggccaggatgatgccaaatatcctacaatgcacaggatgtcaataatgtgaaggttgagaaaccctgagttagaaaataatagggaattgggtacaaggtgagtatgcttgtaagagtatttgaaattaactgaatgaaaacagaaagattggcaaaatggaaactagcatgaatagttctccttaaggtacagaaaagtacagaaagaaagtgctgaaaagtactggatcagccagttcttttactggccatcatctgctttcgtgggtcaaaattgccaaacctctcaatacgtatgaataaagtaggagtttggcttttcttatgaatggatatttctaaacagacatctgaaaattgaggagcatctacggcaagaaaattaaaaattaacattttgtattatatggattgattttctttttttaaacaataggtaagtttatattctaaccaactaggatttttctcaggagcacatggatgaagtatgctcctcgcagcttctaacttcagtaaggcgcatggttttgacccttacccagcaaaatgatgagagcaaagagtttgtaaagttctttcataaacaacttggaagtatattacaggtaagagtttatacttgtatgatttaccaatatgtactgtgtggtaaggttttttttcggggggtgggtgaggcattttcttgcattacacaatttattctggtggacatccaatctagcgtccatttgggatgatgttgtaatactttttagttgtcacttggttaaaataatattgtattattaggtcctgtttgtatcttcatttaatttggtcatctctaaggcatgtctcttataagcttttactggtttggtttatcttctcactgaaaacattttgagtttgaaatgtttacaaagtattctgtggctgtttctaaaataattggctaaagtaatttgactaatcagggaaattttggaagccagagaccagctggttgtagagactttttagggtgtaccagtacgcttaaattatagtaagtcagtaactgggagagaatttgccttctaggagacatttagcagtgtctgcagccattttgtttatcacagcaagtagtgtggagaaggtaggagggctgagaggaggacaggtactggcaactaatgggtagagaccaggaagaatcttgataaacatttgacaatacacaggacagtaccccatagcaaagtattatctggccctaaatgtcaacagtgccaaggttgagaaatcccatgttagtgttaataaaattaccttgtttattccatatgacaaacatctttacctttatatttacctgaatgtttttccattgagatagttcagtgatgtgtatttttactccacattaggtgatacatttttcttctcatctttattacagaattttcttatgaaacttggctttgcttcttatttctgtgtttaaactggttttagataatcactattaactttttttaaaccttgggcttgatgcaaatttgtatcactgtaattttccattttgttagtattaggactaaaggacaaattgtcctggccccgttagcagttattagtactaacagataatttctaaggactacaaaacattgatggtgttgtgcattgtaggaaactccattttagaataaggctgaaagagaaattataatttaaatattttttatcaagatccatgtagcccttcctcagttttgccttctatgataattgtggacagatcccaaagcattaatttctaaagacttttttctcagtctaaggtttgactgcttttctttcatcccgttcttgattttttcacaagaggacatacatgaagaatacaagttaatttacgttaaatattgcccagagtattgaaaaatttttatgagctagagcttaaattaccatcttctacatttttccttctgaaacccgttcaagaattgttttttccacaaagcacccagcatatgtacgtttttaccataactgtactagataagatagtcttttggtgggggagaggagcaggcattgaacatcatagttgtttgcctgtttgctaaatagggtagtccatattttagaaggaaaaagaggagtggttttactaaaaatgtatacagtatacttccttatttgaagattctcaacctaaaataatcaaaagggtcagaatctactttaaagagagtttattcaagcacagtgttggagggatagctgcctgggaagcacagattccaaagaatagacatcagaagtttgggatcatttatatcaggggtccccaacccccaggctggtgagcagcaggcgagtgagcaaagcttcatctgtatttacagtccctccccacggctctcattaccgcctgagctccacctcctgtcagatcagcagcagcattagattctcataggagtgtgaaccctactgtgaactgcacgtgtgagggatctaggttacatgctccttatgagaatctaattcctgacctgtcactgtctcccatcacccccatatgagaccatctagttgcaggaaaataagctcagggctcccactgattctacattatggtgagttgtataattatttcactatatgttacagtgtaataaagggcacagtcagtcaatgtaatgtgcttgaatcattccgaaaccttcccccaagctatggttgggggaaaagttgtcttctgtgaaaccaggtcctggtgccagaaaggttggggactgctaatttatgtggacagagtttagagaagcttaacagagtttcagcatctttctatataaggctttaatgcatagttacaacagtctaattagttgaggtgatgtttttgtttcagaaaaggtggaagatgagtcttttctgccccctgatctgacttaggtacaggacagtaaaggaggcagttaatctgtaacaaacatcagtggttgggaggcaggaggtctggtctcttgatctttcctagtcatttacagaacaagaacagtgaggaaaagagttaatgtgttgtctaagaagaagaaatcaccaacgttcaagttgccagggcttaacttcctccttgacataataaatgtagagggtcttgaaatcctattttcttttacatgatcctatatatcaacttgaatagaactaatgtttacttttgaagaaaaatttaaattagaatggttgtcttaagtaaaggaggaagctttaaacatgatcctatatatcaacttgaatagaactaatgtttacttttgaagaaaaatttaaattagaatggttgtcttaagtaaaggtggaagctttaaaagtattctaatggtacatttagaggtggaagattttgtcttttcctttcatagcacttagtatttattactgtagtatatattgtatctcctgtactgtcagggaactttctggtattagaaatccctgtctgaattcatttgtgcccagcagttacatcaaatagggactaaatatagatgaccatatatgttcttcccttgtgtatactctttaagcaggactagcaacattcccacttagtaatatagcagtattctttagtaatactaacaacctatctttccttagtaatcataaacattagttttaagtttttcagtacttaaaagtaatagtattttataattgaagtttactgtctttaaaaattatttggtttatctttgaataggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggtaaataacgttcattttgatttttaggataattgacacataaatacagttcttgatcattattattaactgaaatcacattttacctcagcaaaagtagttgtttttagtaataccagttaatcacattataagtcattacatatgctagtcacttgtggaatttgaggactaacagcagttgctaaagatcaggaatgcgggcaggaattgatgttaaatgtacattgtcagataaccagttcacattattgtcctgtattcaggtcttgaaagatgagagaaggactgggatctgatcctgggccagtgccaggtgcctgccatgtctgttattgatccctgtagattcttcgagaatatgcattacccagaggtcactcccagtcaacacaaatgcttattagttagggctttggttttacctccctgtagtttgttctgccttgtcaaattaattttgatcacaggtgagattggatgactgttctgcctcaagttgaggcataccaggaagccttttccctagatgtgtacccttttcctgaccctcttttatgagaaggaaacaagccaagacccaaacagagatggctcttctttcttagaatctaaagtagacgaagtcaggctgtccatttcacacttttcatgatatttattttctggatataaataaatttcagacgttgctaagagcttgatgaaaataaaacagcatgatactataataaatgattagaaagtaatacaggccaggcttaggtctataatcccagtactttgggaggctgagacatgagaaatgctaaattatgtatctaagtatgttgctaaattctgtgtaattgatttgttttaaaggctaaaaggattcttgaagatcatggctcacctgctggagagattgatgatgaagacaaagtatgtgctaattaatttttgcctaaaaatatggctgggcgcggtggctcacccccgtaatcgcagccctttgggaggccaaggcgggtggatcacgaggtcaagatttccagaccagcctggccaacatggtgaaaccccgtccatactaaaaatacaaaaattagccaggcgtgtgcctatagtcccagctattcaggaggctgagacaggagaattgctagaacctgggaggcagaggtggtattgagccgagatcatgccactgcattccagcctgggcaacagagctagactgtgcctcaaaaaaataaaaagcctacaaataatgcttttgaaacaatataaaattattttaacagctttcaccttaatgtttgaaagcagactgtatcatcaaatgacctttttcctgacacttttttattttaaaaataaaactagactatcaaaaatggttctttgtattttttattagataatgatcattattaatacgatagacttactatataccttttacacatgtactttaaggaattaattactcaaatatttttgtgtctaggacaaggatgaaactgaaacagttaagcagactcaaacatctgaggtgtatgatggtcccaaaaatgtaagatctgatatttctgatcaagaggaagatgaagaaagtgaaggatgtccagtgtctattagtaagtttaaaggctctgtactatctttatactttagttttttgtaggtcatttattggaacagtttggtggagtgtaacaagtataaaattaagtgtcaaagaactctgattttgaatttcactgtgaccctgactaaattatctagactttctgcactgtaagtttttaatacattctgtttgaggatttcagatactgtatataaagcatctgtgccatgcaggaatgcagtaagtggtagctattgttaagattatgtgctgaaatttactaaaaattgtgtattaatcaacttagatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtattcccgtattgactgacacacttccatcagccttattttaactaatcaaacttccatcagccttattttaactaatcaaagtagatccttctaaatattcaggtttcatgaatgcaagcctcattaatatgcttattaaaatctgaaaaaccagtttattttttatgattgttttttagagacagggtcttgctcagtcttctgggctggagtgcagtggtgtaattgtagctcattgctcatagcctcaaactcctgagctcaagcgatcctcccacctcagcctcccaaagttctgggattacagacatgagccaccacacccatccaataatttatacgttttaaattatacactgtttttagtggtgtgattaaatttcacaccggccctctccttcctatttgggttgtgaatcattccattgtccggcatgtctacactgtatacactacctgcttgttaatcacttaatagccatctagggtagcagatagacttgcagtataacagtgttcaaacaacccttatttgacttaatggccccaaagcacaagagaattaattattctattattagttattgttaatctctcactgtgctccatttataaattaaactttatcatagataagtgtgtaggggaaaaacagtataaatggggtttggtgctatccacagttttggaacatacactctatggatgaggcggtgcttttttatatgttattttcctccctggtctagatcttttcttctggagttggatattttactgtgatgtgccttgttggggtcttttttcattatttgcagtggatactcagtgattgttttcaagttggtaaatttttaaattctctttattactgccacaccattttctcttttctctccttctgtaattatcagatattattagtactcatggattgatcttctgattttctcctcttttccttatcttttggttttactttgagagattttctttgactttaacacttgtatgaaattatttttatttcagctgtcatatttttaacttctgaacactttctttttttctgattgttactttttaatagtgccctgttatttcacagaagcattaccttccgttttcaaatgtctgctgaaccttggttctttatattgaacagtgatatatcaaaaagcaagttaaggttcttttgggcttcactgcaggtagggcatttggggagacagccagcatattcctacaaacttctaaatgttagtatctattggtcttttctttgagatggtttagattcttcaaattagggtccttcactgtcgtcctgcctggagtgtatgagcttggctgctgatattctgaagctagattgggaatggggctgaggtcccaccgttatacaggcatgcactagattattctgttttcagtattctatttaggttggtgcaaaagtaattgtggttttggtcattttcaatagcaaaacccacaattacttctacaccagtctgatactttactgtgtcatttgtgtctccacctctactcccagtggccccaggtttggggctcactagtttaatttctctaaaatataatctgccattttctgttgaggtgggaggagagaacctacgtaggcacattttccttaaacagttttaaacaactaccaccaccgtttcatctccagctcctgccccaacatcatcatgtcttcctttctagatctgttacttacagttatgaggtgaatctcagtttttgtttcctctccctgctgaaggcatttagctttgttcatcttcctctcgtcacttcctccttcattcccttcttgtctgcattaagtgtcttttagagtctgaaaaaaaatgaacagtgcagtctgttcgttccagttgtattatactgtgtgtgtgtgtttttaaggcaacaaggaaaccctttaacttagccatcttgaaatcacaaccaaagccgcctccttgaaatagttttagaagatacttttaaatttctttgtatgaaggtcttgggttggacaaaaactacacactagtaatcatctcttttatagtgaccatatatttcaggccctgctattaaaacatttttcccttctaggtcctacaacgtgactttaaaaagacagcagaaagcaaaaatgtcccattggaacgagaagccactagtaaaagtaagaaatctaaataagtctttgattttaagataatttcctttatttgctttaaagctaaaaaaaaaaaaaaaacacacacagaaaacactaaaattcttagtttgaaagtactttggacctgatgtatgtttttcttctccctataaatcctttgtagaaaacataagaatttgtttctataaacaataaagaaaaggtgacaaatatttacctgcacagacaaaaattctgtcaagagcatcgcatctttagatacaaataatggtagatttaaaaaaaaaatctatttgtaggccttattactgaaagtcctaattttttagaaatcaggtggatttcaggaatctgagtcttaaaatgctcccaggtgattttgatcaactaaatttgggaaccattgataaggaaaatttgtagttgccttttctttttggtcttaaatatcttgattgctcttattcaggcgtattgtctttattagtataatagtaaaatttaacattttttgcattacactaatgttaagactttcttttgatgacagatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgtatgtatcatttacatttccaaatatttttacttttcatttctgtgcatatttcttcattttcagattagcattctccacatgtaaaccattttgtgtttaggtttagaacatgttggaacatttttctaattcacactttaactttagcagaagggtaatagtgaattaagatgaccatctcaaaacccacatgctgttttataattttgagaaccaaagggataaaaagatttcatcttaagttcggctctgaagtggtaatgatgcatgaatcctcctttatcctttatactacctattcttctcaactgtttagaatatattgcaaattttcaataaacttaaaggtttacacttgggataggaaataaaacagtttgacaacagaatctttatacagtgaatgataaaaaaaaaaaaaactaggaaatctgtactcatgatagtacttactaaatgaaaattcaagtgaagcccaggtctgaaaaatacttgagcagaggaaagcaaaaacctttaaagtaattaatcttgcttaagctgcaaacataaatgaaacttcacttgggtcatttctgataaatgcttctgttagaaccaaagcttaaccccagcctgtcataagtagccccctaacatatggatatgtgactagggactttctgagaaggtacttgataaaagacaattttgtaattgcaaaccaagcaaataatttattttacttccacattttccaaataaatacttgcctctgatattttgtcagtggaacactaaatctcttttggtctggtgttcccacttcctgaattgcttcttactcaaataaactgtaaaattttattgtgtctcagatttgtcttttacagtttggtgtcagagtaggatttgaaagagaccccctgtggcctctggaagcatcgaggaaccaggcaaaaggtgtccattgtgctcactgctttctcgctgcatctggaggtcctgggtaagtccctctcggatttcaggctccacagtttgtgtcctgagctctctgagtttatctgagtaattttattttgagactgagtctcgctctgtcatccaggctggagtgcagtggcgcgatctcggctcactgcaacctctgcctcctgggttcaggtgattctcctgcctcagcctcccgagtagctgggattacagacgtgtgtcaccacacccggctaattttttgtatttttagtagagacagggtttcaccgtgttagccagaatgatctcgatctcctgacattgtaatccgcctgcctcagcctcccaaagtgctgggattacaggcgtgagccaccgcacccagctgggtaattttattttttactggatccagaggtcgaactagatgtttgacagtaactagactgggtccagttggcagcctcaggtaggtgaggtttagaaagatagggtattatgggttcattaacacctaaagactctgggacccctctttctagaactctagcaaattttatgtttagaaattaggaacatgaaactatgcctttaactatgcctttctggagaaatggttacactttaccagagaagagaagagttaaagttacagtggagaagttttaatctagataaaattgtttatggggacattagaaaagaagggatcctaaatgccttagaaacaatgggaagcagtttttgattgttgtatacaggcttctaaaagacataattccaaaattgccttgctaaaagattccttgctaaaggcaaataagacagatgaaaagcttaagcagtgaattgacaaccaaaataaaatgaattgtatgtagggagtgatttcactctgacctgttactctgcttatcctcctctaattattctgagtccactaacccatttgttcagtcatcttaatccttttgcacaattaccctttcactctggacgatgtgacagaaaggaagttaggctaatgctttgcttagttagaccctcagccaggacaccgaggtctggctcctgtaagtacttttacttctgggtcaaaagctgaactcagagccatagcaaaagattttccaaatcccaaggaaaatccaaaacagtttgctgaggaatgtagatttagaatgaccctgggcttcctgatttctgtcagtttctacgcatgatattagccactggggaagcatgttaatggatgactacggcaggatggcataagcctcagaagagtattgccaaccctttaagagctacttctgtggatagcccaaaagatgctacaaaaacaactggaaaacatctagaagctatccccatggtctttccacaaaagattgactagtccaaaaagttgaatctatttctgattacacggctaaattggaaatctcatttgttaaacattctggtcttaaaatacagcagggagtatttcctgcgggaactgaaatggtttttatggttttattcattaatagtctctgactagagtctggtgacttgattaaaaaacacaagattggatggcaagtcactgatatggctatattagtcaccatagctgaacattttgagagaacattagaactagaaaaaaatcagtttctgtaaagaggccattgaagaaaagagtctccacgcttgaccagtcctctaatggacctacctgtgttgggccagactatttcctcattagatgaagttcccaaggctgggccaggcatggtggttcatgcctgtaatcccagccctttgggaggccaaggcaggcagatcacctgaggtcgggagttcaagaccagcctgaccagcatgaataaaccctgtctctattaaaaatacaaaattagccaggcgtggtgacacatgcctgtaaacccagctacacaggaggctgaggcaggagaatcgtttgaacccagtgggtggaggttgtcgtgagccaaaatggtgccattgcactccagcctgggcaacaagagcaaaactccatctcaaaaaaaaaaagttcccaagggtttgactctgaagacaataatcaacaccaatgggacatcaagggattctctggtatgttactctccataaggcccttaaacaaacatggggaggaaactaagatcagcatcagtgggagtcacgtacagtgttggtggataccttatccactttcaaccccatgctaataaatcagccagtcccttggaggaaagaaaatatttcacgtttccaatcaagttcagagaatcctctgtgaaccagtctaaatgacagttggactaatctcagaaaagcatgccttcctacaatatgacactaaattgagagggcacttaaagttctctctggaaggaaagttaattttagagcttcctgacccttctaaacctgaactgctctgtttcctacaagcaggaattgatcatattgaaactcactcttataccaacctagacctttctgaagtacccagatgtttgtgggcttgtttctcaactgacaaagggaagattaaaagtggtaagcctataaaaatacaaatacattattccaagccattgcctaaattgccctcatgccccctagggtcagaggcaatccaagggctttacccagttatagaggatttaataaaacaattccttgtacttgtctctataatactataatcctacagttaagaaatccatcacacctttaatcccagcactttgggaggccgaggcgggcggatcaggaggtcaagagattgagaccatcctggccaatatggtgaaaccccatctctactgaaaatataaaaattagctgggagtgctgatgtacacctgtagtcctagctactcaggagactgaggcaggagaatcgcttgaacccgggaggtggaggttgcagtgagctgagatcgtgccactgcactccagcctggccacagagccagattccgtctcaaaaaaaaaaaaatatgtatatatatatatgtgtgtgtgtgtgtatatatatatatatatatatatatatacacacacatatacatacacatatatatatataaatatataacatataatatataacaaagttggagatttgttcaagacttaaacatacaataaattgtcaatccaagatttcctgctattccaaatcctaacactttgttatctaatgtgcctacagattctaaatggttcacagtgtaatctttctttcctctgcctttttcagtattccagtaagccagtagttctctgcttatacctggaagaaccagcaatatacttggactgtagtgccacaggggttcgctgaagctctatcttgtttttctcagacattataccaagacctgtcaaccttacaattccatagaaattgtattctgtctatatgtagataatctttcatacttttagcttacaatggacataaggcctcaatggcaaaactttagttctgtagagcggctgtcctcagcctttttggcaccagggactggtttcatggaagacaatttttccatggactggggtaagggggatggtttcaggatgattgaaatgcattacatttttgtatattttatttctattattattacgttatataatgaaattggtatacaactcaccacaatgcagaatcagtgggagacctgagcttgtcttcctgaaactagatggtcatatctggggatgatgagagataatgacacagcatcaggcattagagtctcataaggagcacgcaacctagatctctggcatgagcagttcacaatagggttcaagctcctacaagaatctgttgccgccagtgatctgacaggaggcagagctcaggtgagaatgtgagtgatgggagtaggtttaaataaaggtgaagcttggctcgctggctccccccaccactcacctcctgctatttggcctggttcttaacaggccctggactggtactgggggttgcagatccctgctgtagagtaaaggtccattacataggatgtgatctgactgcagagagaattttcctcttaactgaaataataaaaacaatccaagggttccctaggcccacaactaaggcagttaagggagttcattggtcttatgggatactgcagatcttgagtcccacatttctctgctggcttcccccttgcctgaatttagaaaaatctctgtcccagagctttgccatgggaagataattaggaacaagctttcaataaaataaacctggccttataaccccttcaggttcaggatacccaagttatttaaaacctttcactttgggattatcaaatatgataatccatccttaggagtccttactcagaaacgtggaggaagctactgacccattgcttattatacgttacagttaaatcgagttgtcagagcatatccaaaccatctaaaagcagtgacagcagcagctaaattgataggaactttatctgacctagtattagggaataaatgttacctacaagttacacgtgcagttgaaagctcattaccttccagtcagatccaacatgtcttaataagtagactaacattttatgatatccttctcctgtcaccttctaatctctatctcagatgtcagtctgcttaaccctaccactttgctgcctctgtctgaacaataggaagaccaaaactgtgtgtgtggtatcataactattgactcctcacattgacttatggaaaacttcattaaataattctgaataaatacattttattgatggatcctatgaaaaaactgtagagaagaaatactgagcaagacatgctgtaacaactcagtatgaactaatagaaaagggaattctttctcagtttaagtcaggacaacccgaagaattacgtgatctaagacttaaccatatagcaaaatgccaatcattttccatttatacagataataggtatgcctttggagtgagtgatgattttggaatgttgtggaaacaaagggtttctcacttgtagtggaacccccatcagtactggacctctgccagatgagcttctttcagctattctgctgccctcacaagtagctcttaataaaaatgatgctcatgctcgtaggactgaacctgagtatcaaggaaatgcatgtgtggacttttatggccaagtctgaaattgacaaaatatgcattttgaatgaactccacagaattgaccaagatcaaatcactcaggataatttgttcagtaaacaatgctgtgcacttgagttgaaacaacaaaaatggaatcttaaaggttgcaaatttcatgctcaacaaggactcagtgaaggcccagacagccagctggtccttcctgagtccttcaaactgtcattattattaaaggccctgcactctacaaaccatcatggtgaagaaaaacgtttcagattatgaaaaagattatgaaagcagaaatggcttacagcagtgtggcttgtcaaactcataaagctggaaagacccttaagatttctgccacctgctagaccatatgtaggtctgcagatggatttcattcagttgccaccctcattgaggtatcagtacattcttgcggtagtgtacctgtttgcaagatagattgggacttacccttatagaaaggctgatgccacaacagtagcaaaaaattcttaggaaatgtatttcctttatggggcttttctggagagatctccagtaataagggaactcattttcctgaacaggttatcagataaacaggattttcaaactcggtggcactaccattggccttgtcatcctcggtcttctggaaagcttgaatggacaaattgtatcttgaaactaaaattagctaaattgtcagctggattaccttggccaaaaattttaccactagccctaatggcaattacatcaacccctacagaaaaacacaaatttgaccccttatgaaataactggaagacctatgcctttaataccagaaccccatgtatcacctgtatttgttagctctgaaatgactcaatactctaagaccttaatggattatgcaaaagtctatttctaccagctgaaggaggctttttgtgaactgcctaccagtgatgatctatgactggcttccataacttagaacgtggagattggatcttttggaaacaacagcagagaaaaattgcccttgagcctcattggaaaggactgtagcagacagctcttactactcacaatgcagcaaaacttcagggttttcagccttgggtccatctatctcaagtagagagagcttccttagactcttggacttgacaacctataggtgacttaaagatataaaagggaaagcctttccctaggagcaggtggcatcgtgaagtaaacaacttaccaccacaatgaaacgactacatttaaaacttttctcattaagttttgatttggttttgcattaacacaaaatgttcaaacttttgttgggaacttttcctactcaaacagaatatcctctaaggtctgatgttcaaagaatagccactctcactcaaccaaagcaattgctggccatgtagtcatatagatgaatggaatcacaactaataccgaaatctactcccacacacacttgggtgagcaattggttttatgaaaaggtttggtatccttcccctagcaggttggttgatatttatggttgactgacttcgcactgggaagaagttacagaagcaaaggtatgtcctgtaactactattgattttattgctggtaattttatcactatggacagaaaaccttaatggaactgggcctaatctagccagggttccagtctccctatatgcagtcagactttatgatttaacaccaattagggagactgctctcctatataatgacacatatttaaaatcagaacttcaccatgatacccttgactatattagtagagaacggactgaaactgacattggttcaaaggaaactctagaggcaaatggaatacccctgtagtttcactgtatacaatagggtttttaagatcagtattcagggcatatttgaaaaggaaacaagtcatccttatttggcgatggtacccatgtgtaatacatagaagtgtttttttattcctctttctatttaaatcataaccattctacctggcagtgtgcagatgcagatatgacagagaataaccatgacaatcacatcattcccaattggtgggtaataggatctcctttgcccctttctctcagtaatactggattattcatcttgtatggcaacaaaatatataaatgttttcacctatatggtctggacactgtggtttgggctatttcctacctaaaatgaccagatatgactctttaaatggttgtgaaattcttaatctggggttgtttgtacatgaagtgatcccttacaaaagaactccctgtgatctcccaaactcgaatatatgaaggggttctagattttgttctttggtaagatcgctttttctttagctggcagtctctgaattggaaaaatggcttatggatatttcagcaacccttgaaaaaaagttttaatgatactttcgatactcttcaagcaatacaatctgagatgagtcatttggtctcactggaactccagtagaagtttagctgctcacagggatgagctttgggtgaaacgtattgtttttatgttaattagatattgttgccccaaatttaaaagatcttaataaatcagaattttttttatcagataagcaaggcctcctccattgatttattcagttggttaaattttaggcccctgggaatctttgcttagagggatctttaagttcttgctacagttactgtgttttcttcctttgtgctttatatccccacaaggggttcaaatgctttccagcagccactcacacgtcagatgattgccatcagggaagctaacactgtgtaaacttgatggagggtgcatgactgaatcccaacataacttttgatgataacaactttacctgacttttcatcccaacttctgtgtcagtagtggttacaggataatgctactccatttggccaccctcaagctgagagggcagccaaaaggggggaattgttaaagcaaaattaaaatggagatcaggcctgaaaatacctgaccaaaacccccataaaacaaaggcctttaaaacagccttaatcttccttgaattgcaaacataagtgaaacttaacttgggtcatttccaatcaatgcttttgttggatagaactaaaaggagtttgagagcaacctgggcaacatagtaagaccctgtctctacaaaaaattaaaaattagccaggcgtgagagtgcaggcctgtggtcctagctactcaggaggctgaggcgggaggatcacttgagcccaggagttctagactatggtgaactatgattgcccctgctgcattccagtctgggcaacagagtgaggccctgtgtcttaaaatttcttcttaaatatatatttacagttatgattcataatttcttagaaagggggcttataatctttgaaaaacgttagtacaaagagtaactcttctaactcttttgtttgcctcactacgagtacaattatacatttaaaacttcgaaaattactggttagatttattcttatctgatcattgtctagttgccatagaagacatttaattgaaattaagtcaaaggtagattataaaagctcttgaatttgaattttagtcagggatcctactgaatgtttttgtgcaaggaagtgaaatggtcaaatttatgggctgtgaagattaatctgctgactatagcatatactatcaagctagattgggggatctactattatataagtatgaaatataagctgaacaggagcagggtgagaaacagtgcaagaagaagaaaaacctaagatttctacttggataattggtagaattatgatactattaaaaatcagaagggagaactaggagggaaaaaaatagaattcaagtttaggaaaaacagtttaaggtgatcacaaaagacagttactaaattcatacctcagctttctaacagccccatcagagttgatacactgaaaagtttgtaagtggttacttacattctgctgggtacagctctcgtgttcagtaaacatatgaaaaaacaagagttgtctttctgtttttagtcctggttgtaactatttcttcagcatgtatgaactgcccccctgcctttttttttttttttttttgtgacaaaatggtaacagcttgacagtatgtttcacagctgtgattgtagcttttcctatgaactgcatatttctaaattattcatagagctgaatgtagaagaaaacgaaatgtgatagaattactgagaaaataattcactatttctttacatggatgactggtttggatctagagtatgtatttttttttttcattacattacaggaagcagaatctggtaatataagtcaaaagtctgatgaagaagattttgtaaaagttgaagatttaccactgaaactgacaatatattcagaggtatttagctgtctttaattaaacttgtctttacataacaaatactgttaaaatgaaaaatgatttgtatttttaattttcattccaaaggcagatctaagaaagaaaatggtagaagaagaacagaaaaaccatttatctggtgaaatatgtgaaatgcagaccgaagaattagctggaaattctgagacactaaaagaacctggtaagagttatcaatttaaatcttgccatattgaaaaatcattgaatcttcatactactattgtgttttattttttaaatatgctactactgacctgggagatttaagccaaatactagaaagaaagtgtaattctgtaagaattttagttcaactatttataaaacagtgtcagataatttttttctattcacatctttagttttaaaaaatgtagacatgctggctgggcgcggtggctcacgcctgtaatcccagcactttgggaggccaaggcgggtggatcacgaggtcaggagatggagaccatcctggctaacatggtgaaaccccgtctctactaaaaatacaaaaaatcagccaagcgcggtggcgggcgcctgtagtgccagctactcgggaggctgaggcaggagaatggcgtgaacccaggaggtggggcttgcggtgagctgagatagcgccactgcactccggcctgggtgaaagagcgagactccctctctgaaacaaaaaaaaaaaaaaaaaaaaaaaaaaaaaaaatgtagacatgcccatggtttaagaaaggtacaaaaatattataaatagcaaaaacccacttttttttttttttttgagacagagtctctgccaccgaggctggagtgcagtggtgtgatctcagctcactgcaagctcctccgcctcccaggttcgcgccattcttctgcctcagcctcccaagtagctgggactacaggcgcccgccaccacgcctggctgatttttttgtattttttaagtagagacggggtttcaccaagttactcagatggtctcgatctcctgacctcgtgatccgcctgcctcagcctcccaaagtgctgagattacaggcgtgaaccaccatgcccagcccaaaaacccactttttattattgatttttagttctttaggagactataactctaaatattatgattcttagtttttaagatgcagataatacctcttttctacccgatgacaagtatgtatctagccctacctctctctcctcctcctctcagtgttcatattatttttgtttgttctattttttactttcaattttggttaagtatatgtgcattttgttccatcaactttggtcattatcccttgctgctcctcctctgctttcttcctggttctctgttcagttttacccatattcttacattactaaggctattatatacgcttacattttgttttcgtaatataattaaatggttctataccttctctgaggttgcttctatataaatatcattcattgtagagccaagcgatagtctcagattttctgtatgagtctaataacacagctctggagccactcaatgtttcttgcatcaggatcaaagggttttctttttgttgttctccatcagttcatcagttgatgaaaattgcatgatatctcattgtttttgtttttcctggaaatggagttgaggagaaggaaagacccttcagatatcagaccttcagttaatttctgttttcagcccacttctacctgttagaatatggtacccttctcagttgcagcctcttgcaagtgtttgaactgcagcttcctccactgtcattgggtatgcttccatctgcattgagcattctggtaatttgttgatatcccctcttctgttttctcacaaccagtcttttgttggtgtagatttattctattctatagttgttttcttttcatagtggagtgtttttagagagacacgaagtatctgctcagtctgccttgttgaatcagaaacgcctcacctattctttttttactgtgtgctattagggaattgtattagcaagctaatttaggatttcttttataataacgttatattaaaagtaaaagctttaatgacagagaacaatgttaaattctagtaattcgataagtaatttataaagcatttttattctgtttttcagaaacggtgggagcccagagtatatgagatgtcttcagaggctcatctaactctgtccttacatactcaatgcatatatgaaaacaatactaaataaacatctgatctgtataaaaatgtaaattagtttgacactgcttttttgataggtgtggtcatttctccccatggtagtttaaaacatcagaaactgaattctggacagatttaagccttgacacactgtgtttttttttttttcccccttcttttttgggtcttcatttttttccccattgtgatgtttggtaacgaatttaaaatgtagttttaaataaagtttggacttatctataaagta

SEQ ID NO: 38057 - DNA, 54843 bp, Homo sapiens
cgtgtatatgatgaagaagtggaggagccagtactcaaggctgaggcagaaaaaacagagcaggtacttgtataaaatcactcttagctgagtttctgactttgaaaaatgtggtggagatcgatgtgttatgtgggaactgggggatggtgggcggggttgggaaagggagggactgctcctgacagcagcccaagaggggattctttcctttgtttctgaaatgtagtgtattaactaatacagagatcaaatccttgaattctgatataagaatagagtagaagtcagcaaacttcttttgtaaagggccagatagtacatattacagatttggagggtcacagaggtcatttttttcctgtggcttcctgagttacagatggaccagccttcttcctgagatcttctcacaccagagcccaaaacatagctaagaggttctgggtcacactgacttcttagcactccagcagagatttctttttcttccactcaggaaggcacatggactgtgaataagtttattattggagtagctttgattttgttctcatttattcagaaaatatggatcacctgtaaaggttggccctttgtcagcaattattacttgtaacagatgaagctgttagactaggaaaagggtattcgaaaccagctatagttctgcctgttgccagcattttttaaaaaaagttattttattttattttttatttaaaaaaattttttattttgagatggagtctcactctgttgcccaggctggagtgcagtggcacgatatcagctcactgcaacctctgcttcctgggtgcaagtgattctcctggctcagcttcccgagtagctgggactacaggcgtgtgccaccacgcctggctaatttttttgtatttattgtagagacggggttttgccatgttggccaggctcgtctcaaactcctgacctcaaatgatccgccagccttggcctaccaaagtgctaggattacaggcgtgagctactgtgcccagcaggttattttatttttaatagaactcaaggatttgctagccatttaagtgcagtagtatctggttataccaattcagggtttaatttgaaggtgataggtatttagtgtactatttttaaaaactgctatatatttcatacacattttcacaaactcagtacaatattagctatttaactcagaatcaagcatatccaaatagaaaaatacacaaccaagacaaaaaagttcagttagaaagacttcagtacttgagataaaagactaaaatgctcgtagggtttttttttttgcctttggccctcagaacaacactgtgtggtttggttccttctagaatatttgtagagggggaaatgacactaaatatttttcggtatttctcacaatggcacacttgtgtctgcggggactgccattgagaactgctgttgcaggaagaagacacctgagggagattctcagcctgttggtgatatgaacaaaccttttttcttgagtggggcattgttgtagggtatacacagaatagaccggagatgaaaatgacccccttttgatgtagaacagatttataaaataattgtaattgtccagtattttttttttgtctctttaaactgtaattgaaaaatgagacctctgtgaccttccttctaagtcttaacacctaaaattacccaagggataaccagggctcgtgggatagtcatggtgagtctgagagtctaggccctccagcagtggggaaacagcatgcattcattgttgggatacttctccacacactagttgtacctctgcttttgtagacgatgacccttgagctctggaaccttaggtagtttgatgcatgtccagaaaggggcaaacttgggatttaaaacttgcagtcttactccaaagtctgtgtcaaggcattcagcagaatttgacttttttaacatttttaataagtttttttggagcttgaggctaggctttagagaacattcacagtattcttttggggcagtatcagtatattggagacccatactgcatggtatttattttgtaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggtgaagacattcaacttaaatatttattgcacaactattatgtttgggctactttaattgggcacacgattagtaagtcatggacttaacctctgggaagtgagtatgtcacttagtagtctcacattgactccaccagaaagactcgctttacctgagcactgatggagtacttgtgaggcgcaaggcaacatgtcaagttggggtgcaaagatgcagagcatggcctctactctcgaggtgtgtgttgcagtctggtgggagagaggagacatacatacgaataaccattgtaaatgccctgagagagaattgacttccagctggaattttggggcaaagatgatatttgaattggggtttgaagggtggggaggctcaaaagagacagagagtgttgggaacctgaaattatgtagcttgggctaaggaagactgcagaagaactgaaaggcatttgggttgtttccggtttgggcaattattaaatacaaatgaagctgctgtgagcattcatgtccaggctccctcatagcctagtgagtgttggttgcttgacagactttctcccacattgttcaaagagacaattggggtgacacagagtctctcggtagtgaacacagaaagttaccacagtgacacacaaggccttccgaattaaaacatgccacagaaccaaacccttttttttttttgagacggagtttcactctgtcctccaggctggagtgcatggcacgatgttggctcactgcaacctctgcctcccgggttcaagcgattctcctgccccagcctcccgagtagctgggattacaggcgcccaccaccacacccagctaatttttgtatttttagtatagacagggtttcaccatgttggccaggctggtctcgaactcccgacctcaggtgatccgcctgccttggcctcccaaagtgctgggattacagacatgagccaccgcacccagcctgaaccactcttctagtcattctgtagctgcacatttctcttccagtttgagctttgctgagtcacaccaaattgaggcagatcatttggcactgaccggtacacttgctgcttggattttcactgtatgcctttaaaagtcagcagtggactctgggaaatggattgcctggaccacacttgatacttccaagacacacagcactttctctctttttttttccccttgcagaggaagttgtggaggtacacttttcttttgtaggaggatttggggatgtcttctgagtcagtgagaattagtccaaattaacgctgtctttgccttatgctccattggttgctgtgacgtcgttgaacctttactttaaccttcccaatctttctgttgttgtgtgaaatgtcagaattattctcccctgccccagagtcctttgacaaggaagagatatcattgccaaagggcaatgcctcacaggggacagggcagcatttccttcagcagtggaggtaggaggctgtgcaagggtggagcactttcttgaccctattttttttttttttttgagacagagtttcactcttgttgcccaagctggagtggcgcaatctcggctcactgcagcttctgtctcctgggttcaagtgattctcctgcctcagccttccaagtagctgggattacaggcatgtaacatgacacctggctaatttttgtattttttagtagagacggggtttcaccatggtgaccaggctggtcttgaactcctgacctcaagtgatccgcccgcctcggcctcccaaaagtgctgggattacaggtgggagctactgcaaccgaccaaccctaaatttttaatgtgtgtgtggtgtgggactgacaggagtagacggctgacatgggcagatctccagcatgtgctgttggggccacagtctcctgccctcactctgttttctcatctggtcttattttaccaacttcacttttctaaattcaacagtgtggaaccactagggggtattgttcttctgtttattgagttataatcttttttatttatttatttatttatttattttgagtcggagtttcgctcttgttgcccaggctggagtggagtgatgtgatgttggctcactgcaacctccacctcctgggttcaagagattctcctgtcttagtctcctgagtaaatgggattataggtgtgcgccaccacacccagctaatttttagtattttcggtagatattgggtttcaccacgttggccaggctggtctcaaactcctgacctcaagtgatccatctgcctcagcctcccaaagtgctgggattacaggcatgagccactgtgcccggcctaatctatttttatattaaaatatatagttatattatgtctcattagtactgctttttaggggacagctcaccagaatgttcagtttctttccttggtcctcctcttcttggaccttatactaggaggttgtacccttttccctgtttgcttgctgctgatagacttttggtaggcttttgccatttttgttaaattttgttaattaggcccttggggagggagattctgtgtgatacagctttactttggcatcttttttttttttttttttttgagatggagttttgctcttattgcccaggctggagtgcagtagtgcaatctcagctcactgcaacactgtttcctgggttcaagtgattctcctgcctcagcctcccgagtagctaggatgacagttacccgccaccatgtcccgctaatttttttggatttttagtagagacggggtttcaccacgttggtcaggctggtctcaaactcctgacctcaagtgatccacccgccttggcttcccaaagtgctaggattacaggcgtgagccatggtgcccggccttaccttgacatctttacctaggatttgacttttaaaaaaatcagtgaaaaaaagaattttttttttaacttttagtcctgctgtgtttcttattctccaccttcgttatgtagcttgtttgggatagtcagatggaacagggtatcaggtggcacatgtaagtttgttttcaactgaaatgtttgacagcctattcctttcatgatgtacaggatctatacattgatcgtcctttaccatatctcattgggtcaaagctgttcatggaacaagaagatgtaggtcttggagagctgtccagtgaaggtacttttcttcaccaaataattttgttccttaacatttcttttttattttaaaataatttcaaattttacattaaagtttcaagaatagttcaaagaactctcatatacccttcacctgggtttaccagttaacatttcaccacatttgttagattgttctctacatatacgtaatattttgtcttgagcctatttgggagacatcgtgctcatgccctgttacttctaaatgtttctctgtgtgttttctttttttcttttctttgtctttttctttttttgagacagagtctcgctctgtggcccaggctggagtgcagtggtgcgatctcagctcactgcaacctccgcctcccggatttaagcgatttttctgcctcagcctcctgagtagctgggaccacaggcgtgcaccaccacacctggccaatttttgtatttttagtagagacggggtttcaccatattgtccaggctggtctcgaattcctgacctcatgatctgcccgcctcggcctcccaaagtgctgggattacaagcatgagccaccgtgcccggctgtttttctttctttctttctttctttttgagccggagtttctctctggtcacccaggctggaatgcaatggcgcgatcttggctcactgcaacctccacctcctgggttcaagcaattctcctacctcagcctcctgagtagctgggattacaggtgcccaccaccacacctggctaatttttgtatttttagtagagatggggttttaccatgttgggcaggttggtctcgaacgcctgacctcaggtgttcctctgtgtgtgttttctaagaacaaggacatctcttgtataatcacagtagaattacaaagccaggatattttcctggacataagggtattatccaatctgctgctatgttcacattttgccgtttgtcccagtgacaccctttacagtctctctcttttgttctgtggtccgggactcaatccaggaccagccaccacatttggttgtcaaatcttcagttatcttttaatctgatgccatttctcagcctttctttgctttttatgaccctgacatctttaaagagtacaagcaagttttttttttatttgtaatgaataatttttggggggagagatacttcaagactacataaatatgtaattcctcaccataatgacactttcaattccagtaagtgggtatagatggttttatcaagatctctgtgatgctgttgtatggtggtttgtgattttgagctaaggacattttcttgtgaatattggtgtggtgacccttatctctcttctcaacagaaggctctgtaggcagtgatcgtggcagtattgtggacactgaggaagagaaagaagaggaggtaagggctgtttggtatgaccaggtcacggtgggcagcaagcttaatttaagatgggcctagcaggctaagtaaatagcataactgtgaattcgtaatctgcttccataaagcttttaacagtgatagaagccacattctgagttttttttcccaagggttagatttcctttttgccttatgtacaataatagggaaagctgctttcatctcttccactattatcctctctcccaccttgccaccaaatatctctttcacccaatatatttttgagaagggcagcttagatgttttggtggaatctctgcctgggatatagtctttgagtatattctgtctttgaataattctaagggaaaaaatctacatttagaacttttgtaaactataaaacctagagcaggatataccgaaagccaccacttacattctattttgctgctgccgctagcgctttcatatccacagagcataatttcatttccttgtctagagtttgagtctgtgggccttgactacagttgaatctgtagttgttctttagatgggatattcgttattgcaaaggacacagccatgttgcaggagagtcctcgagtatgggatttccgaaaggagacagtgttgtgtatgtgcttttctcttctggttggtccccctttctgcactctccctgcccgcctttcttccagtcctccaaagaaaaacctgacagcaggaaatgagcttttcttaagtaactttcgtataacaaaagcagtgctcattaggggaatcccttgcttttagccaccgatgtggcacttctatgtggcacttcatcaatagttgcttgtagcaactattgatgtccccttcttgggcctaatgaagtagttatttttattattttttttattatactttaagttttagggtacatgtgcacattgtgcaggttagttacatatgtatacatgtgccatgctggtgcgctgcacccattagctcgtcatctagcattaggtatatctcccaatgctatccctcccccctcccccgaccccaccacagtccccagagcgtgatattccccttcctgtgtccatgtgatctcattgttcaattcccacctatgagtgagaatatgcagtgtttggttttttgttcttgcgatagtttactgagaatgatggtttccagtttcatccatgtccctacaaaggacatgaactcatcattttttatggctgcatagtattccatggtgtatatgtgccacattttcttaatccagtctattattgttggacatttgggttggttccaagtctttgctattgtgaataatgcaaggaaatagagacagtatagtccaaaatgtaaaataacacaaactgactttcagtaatttagttagttaaatgtgcaactctttaaatccaaaggcaagagttgaaagtgcaggtgatgtgaacaaattgttagaggcatttaagtgaaccacaaaaattacatgttaactggaacaacccttcacaatattgccagctacccagcttatctgcaccttgatacttaaggtgaccagtagtcagtacaaagagactgagtgtcagagctttttctccacttgacatagaatcagcctgccccagagacttagacctgcaatcatttctgtgcttctaagtaaagcccatttaacaacaaagccttttcttccccacaaaggagtcagatgaagattttgcccatcatagtgacaatgaacaaaaccgggtaaggctcatatattgaaatgactttgtttttacattttaattgaagcatagtatatatactaatattactttggaatgatttatgaccaagtgaggattttttcatgtatacaatttattttcctttaagcatttcatgtatttaggctaactacctcctttgtatatattttttccaattttgctttatagtttatttttcttagaaaagaagtttcaaagaagtgaaaaacacaattggaaaacagagcctctaaaagaagactcagttacccaaactgaactactttgcatgagtccctcttctgttttaaaattggagacaatctagcagtaacattattgagtattcacaagatgaaaacttcttaccctactgtcttagcacggttatcttaatttttgaatagctaaaggcgtattcttttcatagtgtgcatctttcattttctgccattttatgttaacattttataaatgtatccttatttattattattatttttttgagatggagttttgctcttgttgtccaggctggagtgccgtggcgtgatctcagctcactgcaacctccgcctcctgggttcaaataattcttctgcctcagcctcccgagtagctggcattacaggtgcccaccaccatgctcagccaactttttttgtatttttagtagagatggggtttcaccatgttggccaggctggtctcgagctcctgacctcaggtaatccacccaccttggcctcccaaaatgctgggattacaggcgtgagccaccatgcctggcctccttattttgaatagcctttgcagtttgcgttgtaaacttctatacttttaaacatactgagtatgatactgtcatagtctctaaatgtataagggaaagagtttatttctagagttgtatttttgatgtaataatgtattcaatattttcttttcttttttttgagacagagtctcgctctgttgcctaggctggagtgcagtggtgtgatctcagctcaatgtaatctccgcctacagggttcaagcgattctcatgcctcagcctccctgagtagctgggactatgggtgtgtggcaccatgcccggctaattttttgtatttttagtggagtcagggtcttcccatgtttcccaggctggtcttgagctcaggcaaaccgcccacttcgccctcccagagtactgggattacaggtatgagccaccacgcccagccaatattttcatatatagaaatcctttgcttcggtgaactgtttcttcagaatgaggtggtatagagttatgttaataactcttaatgtctgggggacattctaaattaagtattatgcatgtagattttcctacaatctcatcactggggtgattattttaaatttcttttagttaaaaatttgcatttaaatttcttaactgggaaatatttttttcacaaaaatgtttaactatcaaatgaaggattttatactttctggttgttactgtattttcctggttgtattcataaatgtggttgatctctataattttaacgatcagtctttcttcataggatatttgtttctatggaatttcctattaagatctgtaaatgcaaacagtttttctttcctttttttttttttttttttttttttgagacagagtctctctctgttacccaggctggagtgcagtggcacgatattggttcactacaacctccacctcttcggttcaagtgattctcatgcctcagcctcccaagtagctgggattataggcatgtgccaccatgcccagctagtttttgtatttttagtggagatggggtatcgccatgttggcgcggctggtcttgaactcctgacctcaggtgatccgcctgcctcagcttcccaaagtgttgggattacaggcgtgagccaccacgcccggccacaaacagtttttcaaaaacagtacagtatagtgagtaaaagcactagcttatgcaacaggttggttttgtgtgctgcagctaacctcaaagttgtaaggattaaattagataataaagtgcttttagtaacatgcctggcacagttcattgattcaaacattgaaaaaaaatttttttaattatacatagtagtgtgtacctttggaaaaattagaacttaacagataaggctaagtttgagccttccagtcctttccttctctgcatactcttcagaggtaactgggatcatgttctgggagcatgtcattccaagtctgtttctttgcttttataaacacatctgtttccatagaaatgctgtagtgtttgcagagggggcggggcgtggtatcatcctggatttgttattctgcgcttttttgcttgacctaccttggatggctctctagtcgttacagcttttaccttttaactattactcagtattcttactaaggtaagactatgctgatgatgtttatatttctctagtaaaaggctgggcatggtggctcacgcctgtaatcccagtgctttgagaatgtaatcccagcgctttgggaagctgaggtggttggatcacctgaggtcaggagttcgagactagcctggccaacatggtgaaaccccgtctctaccaaaaatataaaaattagccgggcgtggtggcgggtgcctgtaatcctagctactcagagggctgaggcaggagaatggcttgaacctaggaggcggaggttgcagtgagccgagatcaccccattgcacttcagcctgggcaaaaagagcgaaactccttctcaaaaataaataaataaataaaaatatttctctagtaagccatttttgatattttaatattctgctttttatattcttgttgttacattcttataaaggatacatttttaggccgggcttggtggctcacgcctgtaatcctagcagtttgggaggctgaggcgggtggatcacctgaagtcaggagttcaagaccagcctagacaacatggtgaaactccatctctactaaaaatacaaaaaatttgctgggcgtggtggtgcatgcgtgtaatcccagctactcggaaggccgaggcaggagaatagcatgaactgggcaggcagaggttgcagtgagccgagatcgtgctgatgcactccagcctgggccacagagctagactccatctcaaaaaaaaaaatatatatatatatatatttatatatatatatatatttatatttatatatatatatttatattttatatatatttttatatatatatttttcttagattcaaagtaaatcttgtgtattatttcttccagcacatcttttgcttcataacttgctgcatcatgtttatgattattattttaaaaagctgttacttctttgaaggaggagcctaaaggctgacagtatctcttctttagcttaataactagtagttctaatttggtattttatactcttagcacaccacacaaatgagtgatgaggaagaggatgatgatggctgtgaccttttcgctgactctgagaaggaggaggaagatattgaggacattgaagaaaatactagacctgtaaggaaggctgtagttgctatcacttggcagagttttagaaccaatgacttgtttttctttttattgtgacttactttgtacatcactcattttggcatatttgtcatttcatttacactttggaaaataatggcaagcatctcaaattgcctcacaagtaccactttcttgtccagatgttatgattttatgagtcagatcattcagaatatgtctagttctagagtttgaagaccatagtgctcctgtctctccatccattcacctttttcttattttcgtatttagatttttaagtattaaagtcaagtattaaaaagaataaggaaataaagggcatctccctttgaaggaacattttatgagtcctattccttgggtgagctgtatagggtacatatgtttaaattcatttaattaaactctgttttctcctcagttcaatttctttgctcttgtatacataatgttgttaggtgtccaaagtgaagtgtactagtttgttacaaaaaagcgattcttttgatttctcctgctgtagaaaagaagcagacctacatcgtttgcagatgagctggctgcccgcatcaagggggatgccgtgggtcgagtggacgaggagccgacaagtgagccccagccgcgttgatggggagtagggggggagtagtgcagggccctctgctggcttcaccaaaggcggatttctctttttattagtaattactacatatatttattagtaattgctacatataatttaaattgtagcgcttattccttttttggttaatgagctcctttagataactgaacactgtggacccacaagaaaaacgtacatgtacacatgtagataaccctttacatataatttcaggggattaatagaaactccagagaaccatgggcaacagcttaagaattcctggctgaatatttactcctatattttgaacacgtaagaatgtgctatatagcatattctagttataacagggtagaaagataacacaataattctttcaacaaatacaatcctgttatgcacatgagcctggtacgaaagcagaaggcttctgccttacaaagagactcttgagtgcccactgtgggcaaggccagggggttcagtgctctggtgcagctgagatgaaaggcagatgtcttgctcttagctgtgagttataaggatgacagacgtggaaagaaccaggatgtgtatactgagggaggacttagtactattaaaactgtgaactgttcttcaagccttaccctcaggagaagcaaaacctcggaagacactcaaagagaagaaggaaaggagaactccttcagacggtgggccttttccctcaattctgttattttaggagcctgttgactaaggaatgttgcttacataattcatgaagtactgctttacatgctgttttccctctgacaaatgggtctgtctccatttacttttctaaagcctctgggctgggcgcggtggctcacacctgtaatcccagcgctttgggaggctgaggcgggcggatcatgaggtcaggagtttaagaccagcctggccaacatagtgaaaccccatttctactaaaaatacaaaaaattagcttggcatggtggtgggtgcctgttgtcccagctacttgggaggctgaggcaggagaatcacttgaacccgggaggcagagattgcagtgagccttgatcgcgccactgcattccagcccaggtgatggtgcgagactccatcccaaaaacaaacagaagccttggaaggcatgttttggggtgctgggaggatatgtgggtgtggagtaaaaattcctgtagagatttgatttattagattttacagcaatcatttcttgtcttcctagaattcttagaagtatagaaacttaggaatctctagcatttgttttcaataaaggatacaccaggcctttttctgcaaacagccatgtccattacattagacttgtccctgtgtcagtttgcagatccctttgtttattctgcccttccttcccccagattggttggggaatgggtcttgaatgtggcgtctgacccgaatgcttgcttcagagtaaatctagatccagggtgctggcctagagaatgaatgctgtctgccgcagacatggacagacttgagagtggaggcccagagagtcttttgagggtgtcagtggactgtgccaggggtttagtgtgaaattcatcagactgcctcacactttgttaaatagtgtcagataaactccatgccagtttggagacacagcagatgccaacccgggaatttgagttctggccccatctttaatactccctgcaaaacattgctttctgtttgctagatgaagaggataacttattcacaccccccaagctgaccgacgaggacttctcgccatttggctctggaggtggcctgttcagtgggggcaaggggctatttgatgatgaggacgaggaggtgagtccatggcacccagcaacactccctgcagctagctgtgtcaggggtccacagggaagatataggctttgcttgtttagtgggggaaaaacagtttctcagttggaagttgcttctattttcatattttgggacattttgaactaagaatcacagagtgagaaatgccgtatccttctatgctttgttaggtgaggagaagatgtgcacgtgttaatgtgaataatttactaggtgattgtttcttgccttatctgttgtcttccacgtttgtttttaattcctggacaggcctaaattattttagggtctgatttttccatagttatcactttgcaactgattttctggcagagtagtaaatatgtagctttaaatcttgtaggttatttttccttaggaatcctcacatgcagctatgctttctcctggttttttgaattctttgtcatataccttatttcaaccagagtgacctcttcacggaagccccccaggatcggcaagctggagcctctgttaaggagggtaagctggggttgggcagctgcgtctccgtgtgcagagttccaaaactgtctttctcactaggagatggaacaaggttgttcccaagccttgtttctgtgttaagcaggaagctgttgtttttactgtggtcctgttgaaagtaattcatcttcactaattcatgtcttggaaaaaacagtaccatctgtaaacccataccacagtcttgcctctttgttaggagagaactcatagaaagtcaaacaagaaaggaccctagagcaatgttgaggatggttttcattgaatgaagtttaatttaaagaaacatttttaacattctgtatataagttggagaccagtaattccccaacccagtgtgcattaaaatcatctgtgcaggtttttttgtttttttgttttttgtttttgtatttttagtagagacagggtttcaccatgttggacggttggacaggctggtcttaaactcctatcctcaagtgatcacccgcctagacctggcaaaatgctaggaatacaggcatgagccactgcacctgtccccttggtgcagttttaaaaaaacacaaatataaatatgttttttaacctacaaatgttactccataggtttgtggtagttcttgggacttgggaattagtgattctaagtgccgagtctcccgggcacaggcatcagagctgggccttggaggccgctccttgtgcctgctgtgcgggctgctagcctggctctcctctgctttctgctgtccatgttttggcatcagtgacttgcttggtttccccctttgctcttatgtctttatttttttactgatgactcacatgtttttgcggttctttttcacccgttcattctcatccaactggaatgggtagaggtggaactgtttgggggagccccggtcatgctgtccctgcctctgctgtgctcatctcctcccttggtgtccccaagctgacccactgctgtggcttgatgacggtcagcatgctcttccattggagtcacagctcagattgtgttaatcccaaaaaaaaagtcctgacatcggtagagaagaaaatactaaagaattttaaaatgacttgttcaggaaaaagtggtttcaaaaggtctgatactagctgtgttttacattgcacgtatttcaggaagaaaatagcaaggaaagttatttcccttgtaaaatggttaccccttgctttctcattctagagtcttcatcatccaaacctggaaagaaaatcccagcaggagctgtttctgtatttttaggtaacataacttaggtttgttttctaaaaactacacaaatactgttttttgcatttcaaaattatcatcttctaaagtccggctggagatgaggaagtacctgggagcttcaaagggctttgagcatcttatagaaagagctcatttactgatattagctcttattctcctagagctcagtggccttggacttttttgtgtttgagctgacctggtgattctccgttgtgagatgttctgtagcagtaatggatggaggctattgggccctgttatgcattttgtggattaactgaaatggaaagtttttggtgggtgataatttttttctgtaaattcaaccggcccacactggctcacagctgtggctgtcttgtctctccacccacaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggtatgtgttcctgcctccgtttctaggacttcagccagaaaaagaacgttgcctaaaaagaacataagctcacctagttctgtatctcttacagtgccagaatcccttctccagcattcctgtcattgagttgttgtgtctgtacttacataggtgtggtgcctgggaggtctgttttatgacccaatcttttctgctctgtaagctaattactatgattattttccttatagagagctgaaatccttttctgtataatttttgcttgcaatttccagttctgacctttggtattgtaaagttttaatcatcctttcttccagccgaccttagtcaattacatgagcagcaggttgtgtgccggccatttatttcccagcttctcatttctctgccaaaaagctcaggtggccttggtctttcctcagatgatgttttcatccccttggccactttggcattctcctctcttttcctcttaaatgtaagtcctatgtcctgaagtcattcccataaatcatttgtttttaaatgtgcagatgaatcttccaggggcttttgtcaaaatgaagattccgattcagtaggtccagggtggggcctgagaatttacatttccagcaagcttcatggtctgtagatcacacttcgaatagcaagacttagatccattgactgctcttccagaaaagaaaggtagatccctagatccctaaggtgcacatgattttcagcaactttaaaaaataaaaaaggatggcataggaatggatggaactagaatgcatttagaagccggctgtctggactcactctcttccagtgttaggtgtagaaagtaaggatggaagccgaagtgtgagggaaaacgatagcctagttaatctagaaagagtgcaaacggatgcagaatgcacacaggtctcagtgaagatgacaatgcacacaggtctcggtgaagatgacagtgaatgaaggtagtagtgctttttgtagctccacagggctcttacttagtggatatctttgagaactgatttagaatccctagtaaattgatgctgctttctttgacaactcctagtctcttcagacattcatgagtcagtgacctcatttcagcaacacatgccctattcggtacagcagtgcttatggtgatgaaaggttggaaaccacccaaatacttatcagtagagtaagctatggcccttctattcaatggactattctgtgacagttaaaaagaaaggggtctacgcttgttgacttgggaagattttgtaggtacattgagtggaaaacacaaatggtaagacattgttcaaattatcttcttatttatagccttatttataaataactagtgttaattcattagtacatcctttgggggaattagaagcatgtatgctgaactgttcccaatgttcatcttgtttgagtagactggtggaattatgaggggatttcattatttgcttttatctgcttttgtacagtttgattttttttaaaacaggagccaagccttcatttctcagattccttagatgattgacttggtggccctcttaaatgatctttcttcctctagatctctcttcaccttgtaagccagtccaagctactctaagtacaggaaatggctgcttggataagcatgtcagccacgtggataaactatctgttctgtctttcaactgaactgctactacgcactttgaaaaattccaagggaagagtatagttccacttactatttctttataactaatcaagaaacaacataactttttatgtttattctttgggagggaagaattttttaatctgtgaattttgtgataggatgtttgacgttagtgtcattttatgccttggtattttttacaggcaaagtccaatccactgccgatatctttggtgacgaagaaggagatctgttcaaagaaaaagccgtagcatcgccagaagccactgtgagtcagacagatgaaaataaagcaagagcagaaaaaaaggtgagcaggagggaagacttaacgcaggagcattgatctgccgcattttaataattcatcctgaacccagagggaagtgctgttccctttcacgttcatattgaagaacttcaaacagaaagtggaaagaacattgcagtgaacacccaaataactgccacccagattgatcagttcttagggttttggcaaacactttatggatgtaaaccttgttacatatctatttttttcctgaactatttgcatgtaagttgtttgaactgtttgctgcatggaactgtttccatgtagtcattgtgacattctacccctaaatatttcattaagcctctcttgaaaagacttccatataagcgcaatgccattatcaacagctgtgagactaacagtaattctatagtagaatctaatatctagtctgtattagaattgctccagttgccccagaatgtctttgtaaaatcaccccaacaaatagaatacagatttaaaattatctcgcatatagttcatactgcaatttcctctcttgtccccaaaatgccatttacagcagtgatccccaacctttttggcattagggacataaggagagtgcaacctgcaatctagatccctcgcatgcacagttcacaatagcgtttgccttcctatgagaatctgatgctgccactgatctgacaggaggaggagcttaggcagtaatgcttgctgctcacctcacctcctgctgtgcggcccggcttctaacaggccatggactggtctgcagcccagggttggggacccctgctttatagtatttttttatgttttgattttttttttgttctaagaaactcaggattcggacagtgtgtctgcattgcatttggttgtcatgtctctttggtctccttaatctagagcaacacctcccacatctttttttttttaatatccagccacttgtattgtagaatgtgtctcgtgaatttgcttgattattttcctatgaatagattcagggtgagaagttttggcaagaatacaagcaggcagggttgtgcacttccagttggatcacctcccaagacacatcaggtccactgtctgcctcattcagacacgtttgtcacttggttgttagggtgcccaccacactgcttcattggaaaggtaccctgttctcttttgccgttgctaagttgatctctaaagcgatagttgaacacagtgtgaatacctgttctctcccagccttttactcagtgttttgaaaatccactgatgatcttttcttgactcagttaatctgttagcgggcacaaaccactatttttttaattctatattttttattagttggcattcttctgaatgaagttctttctctccctctccttccccgatttttagtattgctttgggatcatgtattcattcttcagtgtagatgataatccattaccatcattcttcttctttttttttttttttgtgagacagggtcttgctctgttgcccagactggagtgtagtggtacaatcacagctcactgcagcctcaacctcctgggttcaagcgattctccagcctcagcctaccaagtagctgggactatatgcgtgcgccaccatgcccggctaattttttgtggagacgggttttgcccatgttggccaaaccatcattctttttgatgctcagattgacctgcatttggccagtgtgtgtgtccccagcagtctttaagcccttctgactgcttgacctttcactgctgtcctgtacagctggtccctcctctttctacagttttgtctctttgtgtcgtgtcctggctgtgaagccctgactttctcctgccgaccacctaaggcccagcattcagaacctgtcaggcccgtcaggcagcctgtctttccatgctgtctctcattgcatatgtcccatctgtgcacccattgacccagactgtgtgtcctgctccctgatacaccagatgtgtcctctgtttgtcttgctgttctcttaacagccccctcagcttgctgcctatcacagcagagactccgtgcgttttctcgattgattgagtaaaccctcttttctgggtatcttacgtgttaatgcttaatttttctttttctttttttcttccccaccaccccccccacccccgacaaaggttaccttatcttccagcaaaaatctcaagccctcatcagaaacaaagactcaaaaaggcttattttcagatgaggaggactctgaggtatggaattctattgcttagttgtgggtattagtctatggatatgacctagaaactatttttgaatcaggtttttctcaatagagttataagactttttgttaagtactccagttctttaaaaattatctctagaggccaggagtagtggttcatgcctgtaatcccagcactttggtaggccaaggcaggcggatacctgaggtcaggagttggagaccaggctggccaacatgatgaaacccagtctctattaaaaagacaaaaattagccgggtatggtggtgcgagcctgtaatcccagttactcagaaggctgagataggagattcacttgaacccgggaggcagaagttgcaatgaaccgagatcacaccattgcactccagtctgggcgacagagcgagacttcatctcaaaataaataaatgaataaaaaataatctcttgagagcacaggggctttagaaagcaatatgtttacaatacttttcactttgggttggactgtatttacatttcctgggatgaaaatcctctctctttaggatgctcagattttaaactgttcatgggctcatgatgtgatgaggagcttgcaccagagtggaggtcaccatgctacttcctttattcacattctcactaactagaccatgccttaacgctgtagcagatgggttctggcatagccatctgtcttgtcgagactgagaccactaacagcctctgggaccctggttcataggttgctttggtccctccaggcaccttagaaccacctctcagaatttcactgcttttcctgagtctctcaggcctaggtcgtcttagatccaattttaagttggccttttaggagatcatagaactgtatgagattgtaatgggaagtaataagccccttttacagaaaaatatgtggacatggcagaaacttacatgtatttcaagaaactgtgggctctagattaggctgtcatggttgggctttgcactcacagcaaggatgaacatggaaccctttggaagtagagtgattgcccttgatgtaaagaatacctttgaggctatcactgaaggcgagtgtacaaaacgtaggaattaaccaaagtccagttaagtcacaaccctgacccctgagaaacagcatgatggggcctccaccgtcttatgctcatggatcccatgtgtcacccacacctgcacctcagggtctttgcaccggcccctgccactctgaggaatgctgttcccagaatccagcttgcttcctcactcttcgatttctctgtgaggcctccctgatgaaatacacacagcaggaagcctgctagcacataccacgctgtgctcctggtcctctttcctatttcactgtttaccacagcacgtgttgccagggacagtgtatatttacttattcattgtctctacttcccactaaagtacgtgccatgagggcaggactttgtattccctatttgtatccctaacaccccgtccttaataccagtgcttggcatgttgtaagccatccagtaattgttgattagacaagaaaaccaaatgtgaacaatttcagtgacttacgagatgttctggttatttgttgctatgaaacaagtaactcaaaaacctagtggttcataacacccatagttttgttgtctcacagttcgagaggttgactgggcttagctaggccattgtcactgagggtctcttgtgtctgaaggtggctgggctgagggtcagctcactcatatgtctggtacctgggcactggggcccctgggacatctctcactagccctgtgtggctcccagcatgtagtcagggaagccggtcctcttacatgctggctcagggctgtaggggagagtcctcagagagagcccgatggaggccatgttgccttctttgttccagccttggaagtcaacggtgttccttttgcttcatttgttggccaagatggtcacaatggcccatccaggtttatggggagaggccataggctccccttcttgatggtgggagtgtaaatgtactctcagacttgtgtgaaaaccctaccaaaggctttgccccatgtgtgtcatcatagagcgaatgtttttattggatattgttcagattctaaggcaaggagaggtaaaactaaggcagtctaagtaagagttaaagctttggacccgaaggaatgcgtcctgactcctttctctatatctcaagtgtgaggctgaagcttgccctgtggtcattttgggggaacatatttgaggtaatggaagtgtcttttcttgcagtaccaagaaaggtatcagttaagggtccgaaactgtgatgtcgacatttgtttttgttctttgctttggtttactttcattttcttagaacagcagaaccctttctcttgccattgtgtaacatgcaggagggacacgggatgcctggaattccccttgtggcctcttctatctaaataaacccatgggactccggggagcacaggggaaaaacactgtgtggaggagatctcacttagtgaactcattaggtctatatttaggagtagacagcgaccccataattaaaaaaaaaaaaaactgtccaaagaggtcttagaaatatcttcttgtcctatttaattgttcggctcttgtgtattgaagtttatcttcccaagggaatagatgtcccattttatgtttctacttcatgtaggtcaacttgcaggtctttctttgcaggataagctgatgttttataacattttgaaaatttcttgatttttatattttttagctattttgagatgaaattatactctttttgcctaggctggagtgcaatggtgggatcttggctcactgcaacctctgccttccgggttcaagcaattctcctgccacagcctcctgagtagctgagataacaggcacccaccaccacacctggctaatctggtatttttacaaaattaatataggctggtcttgaactcctgacctcaggtgatctgcctgccccagcctcccaaaatgctgggattatagacatgagccacagcaccgagctgaaagtttctttagaatctatcaggtcttatcctggtttgcaatgtcatatacctatagttaagctaagtagactagcaaacatttaaaaataaagtttaatttgtatttatttaaaagaaataagtcggccgggtgtggtggctcaagcctgtaatcccagcacttgtggaagccgaggcgggcggatcacaaggtcaggagatcgagaccatcctggctaacatggtgaaaccccgtctctactaaaaatacaaaaaaattagccaggcgtggtggcaggcgcctgtagtctcagctactcaggaggcagaggcaggagaatggcgtgaatccgggaggcggagctttcagtgagccgagattgcaccactgcactgcagcctgggcaacagagcgagactccgcctcaaaaaaaagaaaaagaagtaagtcataatcttaggagagaagggtgttactaaataaaatagttgtagctccattaatttgggaatctagcccctgtttctttattgaccctgtctaatctttgattctttagacggtaatgggaagccatgcttatatatttatttttttagcatggtgtaggaaattgattcaaaaacttattcctgccttctgtcattcaggtgggaatacagaagcccctgggctctgcgaggccaccagatcctgtagctctcctcctccttagtgccactgcacacaccctgcacagaccctgaggcctatccctttaaggactctgtctgagccaccttccctctcaggaaagaagcctagacacatggcagctgtcatgtctgagtcacttgtgttttatactgacctgatattttaaaaactgatattcctgttaaccagcaactttaatttcaatccaacaggatttgttttcttctcaaagtgcgagtaagttaaaaggtgcatctctgctgcctggcaagctccccacgtcggtttccctgtttgatgatgaagatgaagaggtaaacattgttattgtaacactagataatttagattaggagaaaacggttgttgatgtaactttctacccagaggctcatatactagcaaaaggtggtagggaagcagtcaggccacctgaagtttatataacaaaaatatttctgtttttatttcagtgacttcttccttatattttcctagctgtgcaatggagaagacattagattcttgatgcagttctttttttttttttttttccgagttggagactttctctgtcacccaggctggagtgcagtgatgcgatcttggctcactgcaaccgggttcaggtgattctcctgcctcgacctcccaagtagctgggactacaggcgtgcaccaccactcccggctaatttttgtattgttagtagagacagggtttcaccatgttggccaggctagtttcgaactcctgatctcaggtgatccgcctgcctcggcctccctaagtgctaggattacaggtgtgagccaccatgcctggcttcttgacacagttcttatggagtgaaatctacaggttttatttttagaaatctgcctttgagaaatacaattgaccctttaacagtgtggaggttattttgacttccacattgcagtgaaaaatccatatataacttcttacttcccaaaaacttatctactgatagcttactgttaaccagaagcctcatggataacataaacaggtgattaacatataaatagtataatatctatttatatatttttgtattcctgacatatccagcttttccttattttttttatgatatttctaggccacatggtttgtctgcaagatttttcaaattgttgcaaatgtccaaaaaaattttcaacatattactgagaaaacatttgtgtagaagtggacctgtgcagctcaaacctgtgtcattcagggtcagctgtactttagtctagaggatggatcaacatatacccaatgacctacaagaatgttttggatcaagtggagatacaaaggagaaggcagccatgtcctgaccattgtctttctttcccatcctggctggagagagcacagtggggaagagaaataagagagaagacaacccaaaccttaactctcatgcagtactgggcggtggtgagctcaaaggctttgccatcagacccctgggttcatatcccagctccaccacttgcaaaccagggacctggggcaagtaacttaaccttccttaagctcatgtggcttaacagtgagtagggtcactgtggcagctgtaactactagtgtgaagctcttgcagagtgccggcacataataagtgcatagtgaatgtgagctctgtcattagcatccccaatggacaccagctcattattctcctggcctgtcctacattaccgcactctccttaaaggagacttcatccaggaagacactcccttcatccatcttcacattccagggctgttcacctgagtttgtccatcctaactcagattcaggccctctgatgcttttgttccccttatctgaataaaagcaccttaataaatataacttttggggagtgcttgaccacagaagaatttacaaatgccattaaacttagtacaccagcaattttatttagtaagctatttctccactttgtataatctctttgaaactaatgagaaacacaagtcatgccttccctccatcccaggtgtatgtctttctgacctgtaaaggagtggagacagacccccagttctctcctttcagccattgttctggtttctcattcgtggagacaacagtgtgagtttctggctgctgcgggggctcccgtgcccattgcaggctgtaaccccctgaaatgagcagagaggcacttgcccacagggtgactggatggggctcagtttctccttgtacttcatgatctcatttgcatgttgttctcctgcttatatgcagctgttctgccttcgagttctatggtaatctctttcccttctatgggtgcagtgagaaaaggctgtagtttgggatttactagcattttgcggtttttccccgccagagttgttatttgtatacctgactggagacttacttcctaacagtttgatataggaggacatcctatgttttctgattataaagttgtcttacctttctgccatttgcttttctaggataatctttttgggggtacagctgctaagaagcagacattgtgtctacaagctcagagagaagagaaagcaaaagcctccgagctctccaaaaagaaagcatctgccctgttgttcagcagtgatgaggaggtgagctgaggtttctgtaaagaagaggggattatttcatgggatttaagagttaaagccatcccaagtctttttctacctgttttatatctcgtgatgttcagtcaccaaaggcgatgttcacaagattgtcttttctgacggaagacatttaatgtaatatattaatttaaagatgaatctcttcaaaatggttaggaataagtatgactcccacacaatagtgtatgctccttcaaatgagttaggccggctaggggggaaatgatttctcagccatcgctagttcatggtcgagtcccttagaacaaatgacagattaaccagagaaaagtgtgcaagtttacgtaagataagttttaccagacacaggagccttcagaaagaaaaactcaagagaaacaggaaatcctgtgtcaattttatgcagtctgatgaagaagcggacagttttgagggagcacgattagatgaaaggggtgtgacctgatgggaataagctggggggagctcagcaaggcctgtgtggtcagatcattctctgcatctttaccaataaggaggctcctttcctctgggaatagggaggactggaatgaaggttttatgacctactccagagagggttagaggattcttctatgtcctgcttcagaggagaagggccagggaaaggtcagagagacctttctgcttctgttttctcaaatgccaaggtgtcatattttgaggtagcatgtcccgtataccccaatggccatatatactagtatcttgttaaatgactactgtgtttcattaatttagaactatagttaggaggagttacctattgaggttaaactcctttttgagggagtcttaacaatatttctgtttgtgatctggatagatactaccaaatcagttagtttagttgctaactcaatcagatttagtagcagggaatcagatttagctgtgcagaaaaagactttaaatatgatgatataaaaaatcctgagtattaaacatcttcctgtgttataataattcctctttttttttaacattgtaggcaagttaatagggggtgaagtggatatataagtcatagatatgttcatgttcttactgaaagcaatttaaaaattccgaagcagattgcaaaaaaaaatgtattaaaagcttatgaggccgggcgtggtggctcacgtctgtaatcccagcactttgagagtctgaggcaggcagatcacttgaggttgggagttcgagaccagcctaaccaacatggagaaaccttgtctctattaaaaatacaaaaaaattagcaggttgtggtggcgcatgcctgtaatcccaactactcaggaggctgaggcaggagaatcacttgaacccaggagatggaggttgtcgtgaaccgagatcacgccattgcactccagcctgggcaacgagcgaaactccgtctcaaaaaaaagcttatgcaacacacatgtgaacaagacacaatgaaaaactgctagtaatccttttactacaaaagtctgagtctggcctttagaaagcgtttaaggaattcccacccagctgtgctcatgccttcacatcaaggaactcccaagcatatataatttgtgttttctactcaaatgtatgaatttatgatagattatccagtttttttcttttaaacattgtcagtgattgttccccctgtagcaacagccagacatcagtgtagttgctcctactagagtattatagtggttcagggaaaataaaaacattacctaaagcttggagcaaaaagacatgcagaagaaagacagccaaggttctagaacaggggcgtccagtcttttggcttccctggcccacactggaagaagaagaattgtcttgggtcacacataaagtgcgctaatactaacaatagctgacgaactaaaaaaataaaaaggttcgtgcataaatcccataatgttttaagaaagtttacagatttgtggtgggccgcattcaaagccatactgggctgtgtgtggcccatgggccacaggttggacaagcttgtcctagaacaaaggctgtcaacttcggctgctcattgggatccatggggaacttaaaagagtgctgacaggccgggcacagtggctcacgcctgtaatcccagcactctgggaggcgaaggaggtgggcagatcacctgagattaggagtttgagaccagcctggccaacatggcgaaactctgtctctactaaaaaatacaaaaattatctgggtgttgtggtgcttgcctgtaatcccagctactcaggaggctgaggcaagagaatcacttgaacccgggaggcagaggttgcagtgagccgagaccgcgccactgcactccagcccgggccacagagcaagactctgtctcgaaaaaggaaaaaaaaaaaaaaaaaaaaaaaagaagacctgacgagtgctgacagtagatcccagctccagagattctgaattaatctggttggggtacagcctcgtcattggagttttgtgatactctctagtggatttcagcgtttagtcactgctaaacattgaggagcacttctcaaaccttcatgtttaggaaatcacccaggcaccctgtgaaatgcaggttctgattcagaaaataggcgcggggcctgaaattctgcataatctgctgctggcttgtggactccagtttgatttgcaagactctagactccagagatagagcacttatgcaagtgcttgggagttctttgatttgaaggggtgtgagcatagtcgagtagaatttccttaaatgctttctaaaggccacattcagacttgtggtaaaaggattactagcagtttttcattgtatcttgttcacatgtgtgctgcatgagtttttacacttttttttcaatctgctttaggatttttagaattaaaatattcttctctggagttggaagttcttgagttcttggtatttttacatttggcttccttcttatagcctctgtaattaatgttgattccctgaaatagacaagtcgcttgtcgtaatacagtgcagaaccacagtgggaagagacatcgtggcaggtgttggaggaggaaatcatgagaagctctgtgaggtcagagagcccagctgtctagatttgagttcaaagaaaagtcttaagcatgagctttcttcaagactgatgcactaagtttaatacttagtttaaatacaacttagtttaacaaatataagtttgattttactccccatgttttataatctaaattgccattggacttttttttctttttttgagacagagtctcgctctgtcccccaggctggagtgcagtggcacgatctccgttcactgcaagctctgcctcctgggttcactccattctcctgcctcagcctcccgagtagctgggactacaggctcccgccaccacgcccggctaattttcttgtatttttagtagagacggggtttcaccatgttagcaaggatggtcttgatctgctgatctcgtgattcacccgcctcagcctcccaaagtgctgggattataggtatgagccactgcgcctggcctggagttttaatatatattttatgttttaaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacaggtgagatagtcattggaaggagtccctcactccgttaccgtggtaacaagaaaaggaatctgatgcacaatctagttcatcgggtgattgctaatcatggatcacatagtgattgtgccagtgagaatgtctttgcttttcaatggcaccatcttttccctcagtacccggaaatgtttgtctttgtggatccttatctgatttcttccccaatcattattttttaaccatattctttttctttgtttgtcagggatttgagtatcttttgtttgtgatttttctctgggctactctaaagtatgtcaggtttggtcaggattacttaaaagttactttaggccaggcacgttggctcatgcctgtaatcccagcactttgggaggccgaggtgggcggatcacgatgtcaggagttcaagaccagcctggccaatatggtgaaaccctgtctctactaaaaaaatataaaaattagccgggtgtggtggcacgcgcctgtagtcccagctacttgggaggctgaggcagaagaatggcttgaacttgggaggtggaggttgcagtgagctgagatggcaccactgcactccagcctgggcaacggagcaagactccatctcaaaaaaaaaaaaaaaaaaaaaaaaagttatttgaatagaaatctgctcagcatttaacacatcctgttaggaggaagttccctgtagagctgtgcagtatcactccaggggctgataacccatagccaacctaggtgcctctccccattaatgctggaactgaagctgctaggatattcagagtgagcgtgggctgtggttggtataacatgctgccagattagcttatgggttcagaattacttccctgcaaatactttttttccttttgaaagcctgacatgattactttgaaattcacctgaatgttattagcagaaagaagtaactgattggacatgtaaatcctatgctttggtgtggttaagcgtcatttgatagattcagaagtacctcaggtttctgtctccaaatactcgaatcttgtcaagcatcaccatttctgcattaggcctctgtaacttgacactcggatgcatctttggtctctgatttagaatataggctctggaaacttgatattaaattctgattctgccagttcctgtctgaataaccttgggcaagttacctaacttccctgtgcctcaatttcctcatttgttaaacaaaaataaaaacagcatttctctcatcggtttgttgggatgatgaggtggaatctaaatgtgaaatgctgagcacaagagctggcacattctgagccctcaggtattgccagttagcatcgtgactgcagggaaatagtacattcctttatttttgttgctctctcctgggacattcttcttcctgtgttgcctggccaccttctttcaaaactaagtgtaagtcttgtttcataagaagccttcccggctgggcgcagtggctcacgcctgtaatcccagcacttggggaggccgaggcaggcagatcacgaggtcaggagttgaagaacagcctgaccaacatggtgaaaccccgtctctactaaaaatacaaaaatgagctgggcgtcatgtcacgcacctgtaatcccagctactcgggaggctgaggcaggagaattgcttgaacctgggaggcagaggttacagtgagccaagatctcaccactgcactccagcctgggcaacagagagagactccatctcaaaaaaaaaggcctttcctaactttaaacagacgagaaagagaagaagtagggagtcgagggcggacatggctccaccttcataccccaacaccctcagctgagcattttctgcactgtatccaggttagcttattcccatgagtgtccactacccccaccccacacaaggtcataaatctggcagtctgaaccccatcttgtttgtgggtcctggttccagccacacaccatacctggctttcaggaatgctttctctgctccagatacatcctacctcctattgttcccgaagttgtctgtcaagttttgtgtatggaaagtaattcataccttcatcagatctcaaaagaagctttacacacacaagaagaagttgaggtgaggatgtgtaggaattggaaccctcatacactgctggtgggaacgtaaaatggtgtagtcactttggaaagtagtttggcatttcctcaaaatgttaaacatagagtcaccatatgacataatagtttcattcctatgtatatacataagagaaatgaaattagttgttcatataaaaacttgtacatgagtgtttattgcagccttagtcataacagccgaaagtgtaaacaacccaaatgtccatcaactgatgactggataaacaaaatgtataaccatacgatggactgttcttcagcaataaaaaagaataaagtagcgatgcatcctagaacatgaatgaacctagaaaattttatgttacttgaaagaagctggtcacagaaaaccacatattgtattgttccatttatatgaaatgtatagataaaccacagagacagaaagtagattagtggttgccagggcctgtggggcagggggaatggagagtgatggctcataggcatggcggttctttttggggtcatgataatgttgtgcacttaggttgtagtgatattgcacaactcgatgagtatattaaagaaaacattgaagtatgcactttaaaagagtgaatctggattaagaaaaccattgaagtacgcactttaaaagagtgaatctggccaggtgcaacggctcatgcctgtaatcctaactgattgggaggccaagtggaaggatctcttgaggccaggtgtttgagaccagcctgagcaacatagagcgacctcacctctccaaaaaagtaaaaaaattagccaggcatggtgacgtgtgcctgtagttgtagctacttgagaggctacttgagttcaggaatttgaggctgcagtgggatatgattgtgccattgctctccagcctgggcagtagagtgagaccctgtcttaaaaagtaaaataaatattaaaaataaagtaaatacaaggtgaattttatggaatgtaaattatgtctcgataacgctactaaaaaaaagaaatagaagccaggcacagggtcatttcccagtgctgatcctggccctgtgatctctcttggcaaccgtcctcatgacaattctggaaataggcctgtccgctttgattctttttgtgctataggaagtgggagagaatgttctgcttgggaaggctcaggcatcgtgtgccttgcagcggtaacagctgatgaacctgcactggatagtaacaggaaaggggcaacctgaggcaggagggacagaggctggtgatttgttggagtcagatttcatctatttcaaaggtctttcctgtttgctttcaactgtgtaaggtcaactaatggcttgggtgtttgggtggtaggtggattcctgtaggtgcagtctagaagaaatattgttgttatggtttttgtttttttcatcacacttttccttaatttgaccttttgtttgtttgtgtagccaaaagaagacccagagagtgtcactcctctttgaagacgatgttgatagccgaggctctctgtttggctctcctcccacatctgttcctcctgcaacaaaggtattcttcatctcttagtcccaggaaatgtccttgagtttatgctgcatcagtagtggtacttccccgaatcagctcttcatacctaaccttggaggctgagtcttatggaagaccttatttgcctggtttcagaaagagatcttctgattaatagtattctacagaagaagcacacgtgcaaagccatcattcagtgtcaggtgtaggaacaaggaactgggtctcagaagaggcttgggccccattggcatggaattctgctaacattagactaggccagttaaggcaaaatcattccttttatgagtgtgtgtcgagtactaacactggtcctggtttatattagccagtcagtaaaaaggaaggaaattctcacatgtgctacaaaatgcatgaaccttgaggccgttatactccatcagtggagaaatggtcacacaggtcctagtacagttagactgtggaatactatacagtggtaaaaaaaacccagggtggagcttattgggatgaaaaacatactgcaggccaaaaaaaaaaaaaaagcgtaaacacgtaaacatggtgtaatttaaactttacaaaacaagaaatacacatgaatgcctggaaaccggcctgaaagcatcgatagcacattgttaccagtgattatgtccagggaaaggtatggaatggggaacttcatactctcaatgcctttttaaagcctttttaaggaaggcatttgtgcattactgtggaattagaaataaactccaaacaaaaaatatctaggagatacggaagaagacccttcctgttaaatggagttgctcagcttataccagaagctctcagccctgggccagcatgctgcccaccctgggccccaggctccctgctgctgcttctacggggctcctgagcctttccttgggtgctctgtacttacatctccccctttaaggacatccagtggttgtacaattaaaggagtcaggagatctgattggtttttctttgtaaattataaataaactactctggaggataactgagcaataaattaatgaattttggagcctctggagctgtaaaacttctttcaacctatggtaattatgattgttaaataaaacaaaaggtcaagacacacaacttaagtagctgaatagcctacacgtttttgattatttgtgaaatataatcatctttagacaatagtaaataaaagatatttcttgtttacagatatttcagtgtaagttaattgtgacttggttgtaagcctatgttgaccaaaaggttaaaccacaggcaggagaacttaaagaaatgtaatgtgagttttgttttgagccaagcttgagaactactagcccagtaaagagactccacacaaactgagaatgcgtcccagagtgggccacacgagacacagcatttatacatttctgttatatagaaaatgggaaaagggggcagtgaagcaacggtgactttcttaattcagattggtgctcagtgacattgaatataagataaagtaaatatgtggttaatgtattttcctcattagccttttaccctaatgagtacataggggtcgcagttgcagggtcaggagagggatggttgattttgtgctgcctttgtgcttcatccaataggcaggttgtaatcggtgcctgtcagtgtgatatttgacagactctggccttgcaggtgaggttcagctttcgttcataggcccggtttctattacccatatggccaagatgcagccattttagacaatttttttttcttcagactttccttattttctgacacctatcaagaaagtaaatttgaccaggcgtggtggctcacgcctgtaatcccaacactttgggaggctgaggtgggtggatcacctgaggtcaggagtttaggaccagcctggccaacatggtggaaccccatctctattaaaaatacaaaaattagccaggcatggtggtgcacgcctgtgatcccagctactagggaggctggggcaggagaatcacttgaacctgagagatggattttgcagtgagctgaggttgtgtcagtgcactccagcctgggcaacagagtgagactccatctcaaaaaaaaaaaaaaagaaagaaaaaaacaggaagtaaacttcatgacaaggatgagcttgtcttcaagaagattaaaactggtactttgggtagcattttctgtggtttaaggaccttagttatatatgaaggaagaatatgatttgccatacttaagtctctttttgtctcccctatcaactatttgcattgaatttttttttttttttttttttttgagacggagtcttgctctttcgtccaggctggagtgcagtggcgcatctcggctcactgcaagctccgcctcccgggttcacgccattctgcctcagcctccctagtagctgggactacaggcacccaccaccatgcccgactaattttttgtatttctttagtagagacggggtttcactttgttagccaggatggtctcgatctcctgatctcatgatccgcccaccttggcctcccaaagtgcttggattacaggtgtgagccaccgtgcccggcctgcactgaatttttatgtagttttcagtgagtccaggatgttccacaaaagccttttcctttgattacttcagtgttgccttatctcttctgaaattctttatgccttccagtgttcttttatgttaagttcaatggttttgcactttacttatctcttcctaactaaaaatccccttgctctcttctttcttcattcatcacattttaaaatcatgattagcaatgtccttccttagtttcccaaatctgccttcctaacttgatttaggcattgcctcaaagcacacttcctcgtgtcatatggtatgatttgtatctgtactatactataatagagctttagttttttctcaagcacctgttgataagtcacttgctgcaaaaatgccatgaattccaggaaagtcacaaacctcagtttcctagtccccaaatccctgcctccctgataaggaagagatgagaaatgggctgaagtgcttgcagacttgtattgaacactgagttggtataaaacactgggactgtccatgaaaatatagtgtatagtcctttcagatgaacagacaaacagatgtgtgctagctgttatataagttaggaagaaagtcaaggaagggtcaagtagagagataaatattatgcttattcaacaaagcaactgacacttaactgaagaggacagagaccgtgggtgacatctgcgtgggggccctgcttgaaggatggggaggatttgcacctacagacatcgagggcagtgtggcatggaagtttgaaagtttgcagtgaccttaaggaacagcagggaaaggaggagatgcttatgagtagagggatagaatggggtatctgctgagtgtcatttgcttcatgcaaggagtgctggtttgggttgggagaggacctgatccagcaggtgttttgttttagcaagacaacgctggataatgtcttctagttgaaatataagaggagtgaggcagagagagagactcataatcgtctggtggcagagataaggatctgagggagggaggcatgggggttgacagacacaagtagacagatacaggtgatatggtggcgtgaagtgtcctgtccacaagtcccgggtggtggtgtttgttgcttctcccttttggtgctaccttcactatcctgtcctctcttccttgatcacatttagctgaagccctaagaggatggtttgggcttgttctgtatatggccatgctggtcagacacacttttttattgttgtggatgtcatgtactcttcttttggtagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggtggacttttttctcttgtatacttgaatgcatttgtctctcgtatgttgtttcaaacacacccaaccccttaagttttttgaccacagaaaataaatggcccatttgtagacagatttgaaaacatagacaagcaggctgtgtccccacagtgcaggaagcctctgcagggcctttcctcccggcccttctccaagacatgtgcgcactgtggtgtgcctgctcctgtctctgtggttactgtcacgtcatggcatctttgctttctaacttgttctcttctgtgcagtgttcctgttacccttggtcctcctttggtccccaactgcacttgaatttaaatgtcagttttaaggagattttagtttagcatccttttacttttagatgatattggcaaggattacagagtagagtgaaatttctactctttctaaaacactagctttcaagtcctggacggtctgccgtctcttgcaggaggcctgtgggtagttctgctggccaaacctgggcatccagctttgtggttgccttcagtctctatatgcctcttttctttctctaacttttcttatacgctgtgtgtccagctgcttaggtctaagatctcccagggcctgtgtgaagagcgttgcatttgcatttgctgctgaggctccttggagctacagtgatacaagcatttcatttgtacctgtgttcctgtgtgaaattctcttcctagtggctgtgtgtggaccccagtcctatcccagtcctggtccacacttgactctgactggttgctgtactgccctctccctgagtgtaagccccttgcggactaggcccagtttgttttgctcaccatcatatctgtagtactggcatattaccttgcacacagtaggcactatgttataaactttgtatttctttaaaaaagcatttttttaatagtttgagtactctgaaatcgggatgtacctcataatcaatggtatcttacctgaaatgtgccatttgttgaatgaataaatactgcattttagaattatttcagagattcttcttcaattgcctatacagtgtaagccttttacaatttgagggtctgattttcctgattagatttcccccttggggcttatgtattagttaaatgctacgaattcatggtccactcccaatgattggcacttgtattggttatctttgacacttagaagttcttcctagttcatgagcaaccagtgtgcatcaggattatagccgtcctatcacttgataggagagagggacccatggtcttaatgcttggaaaagttatctttggctacggatgattgtacaagactgtctcttggagcagccaatcaagaattgacctcagtgttttgttacttgggcacagatgtgattcactgtgccctgagtcatgcaaatgtggcagttactgaattaacgagaagcttggcaggctccatgataggatttgtatttccaggtgttacttattttttccccctattattttcattttcaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaaggtaagcaaaaagcaatagtggttcaagtctctggatgagataaaagactctcatctcatggttgtcattctgtcatgtgagtttctgaaggaatcttaaccttcaatgtagtgtgttaatgattctgggcagtcatttagatatttgggaatcttaatcaggaactcttacctcaagtagcagtgttaggataggggattagaatttcaccccccctcttctgggatttacagaccttgttgttccttctagcaaaactttgccccttggccagttgtgggatgtaaacagcaggaaagggaagttaggctggagttgtacagttaagtatttctaacattcagtttaagaaaaagtgttgtagatgaacctttcatactgatcaggtgtcagcaaactatttctataaaggaccatataatgactattctagcttttgcagcctatttgggctctgtcataactgcctagctctgccattggcagcatgaaaacagccctaggaaacatgaagatggatgggcatgactgtgttccagtaagttttattaataaaaataggtgatggtcagctgggcatggtggctcacacctgtaatcccagcactttaggaggccaaggtgggtggatcacaaggtcaagagatcgagaccatcctggccaacataatgaaaccctgtttctactaaaaatacaaaaaatagcttggcgtgatgacgcttgcctgtaatcccagctacttgggaggctgaggcaggagaattgcttgaaccaggaagtcagaggttgtagtgagccgagatcgcaccactgcactccagtgtggcaacagaacgagactccatctcaaaaaaaaaaaaaaaaaaaaatagatgatggtcattctgtgaggttagtatgaccctgatattaaaactagacagtgacatcaccagaaagctagatatcctttatgaatgtagaggccaaaatcctcaacaaaaatactactaaacccaattcagcaaaatataaaaaggattgcacattatgagaagtgagatttacccctggaatgcaaggttggttcaacatctaaaattagttgatataatgcactgtatcaataaaatacagaattaaaaggcgcatgatcatctcaacagatgcagaaaaagcttttaataaaatccaaaccttttcatggtaaagcactcaattaggcataggaggaagcttaatgaacttgataaaggacatctatgaaatccctcagctgacatcatacttaatggtgaaagactgcatgcttttcaaccctaacatcatgaacaacacaacaatgtccactcttggtaattctaatcaaccttgtactggggattctaagcaggccatgtaggtgagaaaatgaaataaaaggcattcagattggaaaggaaaaagtgaaatgaagcaatctgtatttgcagatggcatgatcttttatatagaaagtcttaaggaatctgcaaaaaacatccattggaaataattaaagtcattaagattgaaggatgtaagatcaatatgtgaaaaccaattgtagttctgtaagctagtaatgaacatttactaacttacaaaagttactactagtaactttctttttttttttttttgcaatggagtttcactcttgtcccccaggctggattgaaatgacacaatcttggctcactgcaacctttgcctcctgggttcaagcgattctcctgcctcagcctcctgagtagctgggattataggcacccaccaccatgcccagctaatttttgtatttttagtagagacagggtttcaccgtgttggccacgctgaccttgaactcttgacctcaggtgatccacctgccttagcctcccgaagtgctgggattacaggcatgagccactgcacccaacctactagtagtaactttcataagcaattaccagcttatgaatgaaattaagaaatcagtttcttttatagtaataccaagaagggtaaaatacttaggagtaaatttagcaaaagaagtacaagacttgtaaactaaaatctacaaaacattgaaagaaattaaagacctaaaattgatggaaagacatctcgtgtttatggaccagaaaccttaatattggtaaggtggcaatacttccttcccaaattgatttattgtaatctctatcaaaattccagcttgctttttgcagaaatggacaagctgatcctaaaatttttatggaactgtaagagaccaagaatagccaacagtcttgaaaaggaagaacaaagttagaagactcacacttcctgatttcaaaacttactttaagacaggatggtattggcataaggttaaaatatatagatcagtgaagtagaattgagagtctagaaataaaccctcacatttacagtcagttgcttaaggtgccaagatatttcagtggggacagaatagtcttcagcagatgtgccaggatgctgattatctacatgcaaagggatgaagttggacccattaataaataaactcagatccaatgtaagatccaaatgtaagaactaaaactgtacaactcctagaatctagagagtatgtgagtaaattatcatgaccttggattaggcaaagccttcttagataagacaccaaaagcacaagtgacaaaaatagctaaattggactttatttaaatgaaaaacattgtgcttcaaagggcaccatctggaaagtcaaacgaccacccacaaaatgggagaaaagatttacagatcatgtatttgataaaggactcagatccagaatatgtaaaagacttataagtcaataataaaaagacaaatagcccagttgaaagaagggataggccaggcgtcgtggctcatgcctgtaatcccagcactttgggagaccaggacgggaggattgctttaggctgggagttcaagaccagcctgggcaacatagcaagatcctgtctctacaaaaaattttaaaaattagccaggcctggttgcgtgctcctatagttctatctccttgggaagttgaggcagaagagtcctttgagcccaggagttcaaggctgtagtgggctgtgatcacaccattgcactcaggctgagtgacagaacgagaccctgtctgaaaaaaaataggtaagacagacatctgaatagagattttactgaagaagatagacaaatggccaaaaaggatatagaaagatgctcagcatcagggaagccaaaaccacagtgacataccacttcatacccgggaagaggaccataataaaaaaaaaaaaaaagggaagtaacgagtgttggtaaggatgtggataaatggaaattctcattccttgctgctgcaagtgtggaacagtacaaccactttggagaacagtttgctgttcttcaaattcttataacataaagctatcacacaatccggaattttattcctgggtacatatccaagagaaataaaaacatgttcacacaaaacttgaatatgattgctcccagcagcattattcataatagccaaaagatggaaacaatggctaaacataatatagtatatccatacaatggaatattatttggtaataaaaaaggcaaagtactgatacatgctgccacatggatgaaccttgaaaacattctaaataaaataagccagtcatgaaagaccacatattatgtgattccatttatatgaaatgtccagaataggcatatcaatggagacagaaagtagattagtagttactgggggctgggagtagccgtgagcaggaatggataattactgctaatggtttggggtttcttttgggagtgatgagaatattctaaacttagattgtggtagtggatacacagatctgaatataccaaaaaatcattacattttatacgtaaatgggtagattttatggtatatgaatttgatctcaatggtgatgttatgcaaaccaggttggcaggtcatagattgccaatcctttttatagatctaaccaaagaaatagtctatgtttatttctacaaaaaatgttatatgaatttttttgttataccaatactataagcttatttataaatgagagctgcacacagtgaatatgattaatttgatatattttctcccagtctcttactgtgtatggttttgtaatatttttccttagttgtgaaatatttaacattacttgctgtgttaaactcatttttatatataacaataataattattgttaatgtgatttattttgttagaagtaagtttttcattagtttttttggtttttttgttttgttttgttttgttttgttttgagatggagtcctactgtgttgcccaggctggagtgcagtggcgtgatcttggcccactgcagcctctgcctcccaggttcaaggattctcccacctcagcctcccaagtagctggaaccacaggcacacgccaccacacccggctaatctttgtatttttagtagagatggggtttcaccacattggccaggctggtctcgaactcctggcctctggtaatccacccgccttggcctcccaaagtgctgggattacaggcatgagccaccacgcctggcctttttgttaagttttaatctgtggctgtgataaggaaatagggatgaattttagaatgtcaggtctggagcattatattatcaaaccaataatgttgatggtaacttttaaacgttagatatctagtaaacaaaaagggactcactcggagtctgaaagtagggcagaagtgatggacagccataggaaggcttgtggtcgcacctgtgccaggtctttggcctgcagtgcttacaggtgagggacacatacttgaccactctgtgtagtttgtacttgattcagctgctgtctcttcttccctttggaaatgagatgaagagaattcattcagttgtatgttttttaccttcaaaatgtttctcattatggaactaatggattgcttttctaataaaaaatttagatactatacaaagtttatataatatatataacctggaaagattatctctaaagcttgtgcatatatatatatatatgtaaactttgtatttataaatatattttctggtatttttggaagcgccatagcattccattttgtcaatgtttcattcccctactgagtggcttttaggctgtggccagccttttgctaatataatacagctgcaggggacatctttgttgtgtccatctttacatatgtaacttccttgagataagttcttacagctctaatcacacatgaccttccctcctgttcccagggccgcgatcctgatgcccaccccaagagcacaggtgtcttccaggatgaagagctgcttttcagccacaagctccaaaaggacaatgacccagatgttgacctttttgctggcaccaaaaaaaccaaggtcagttccaaatggttccccacagtatgacttgttattgtattgggtgctgtctcaacagctcacctagttctctttgtaaattgttttgcttttggatattgaacttgggtcttgtttattctagctgttagagccaagtgttgggagcctgtttggggatgatgaagatgatgatcttttcagctctgccaagtcccagcctttggtaccagccttttgttctcaatactgggttgtgtgggaaagattctgggaaaggaaactaacgtccagttagatcattaaggaaaatcctaggagagtcgtgctgcttcctactaaatgaatggcaaataacatgctgaggggagcgtgtgtggaggatgcaatgcttagtttctgttgttcctcattttatgttccctatactaacattaaaacattaataatccaggctctctgactgtactgcacatctgtgtgatgtttaaatggttgattgaaagaccattgcatacactggggtgactaaatattcgtgcctttcaggtgcaaagttttgagtctgagttttagcctttctatgtcattttctcccccagccccagtaggtttttgtaagtactctgttttctttttatcgtagagaggactcctgtgacagccacagtcttcagaatgctatttctgaaatgctacctttgagttggttcagccctcatttgagaaagtatttttaagactcagaagccaggattgttttttgcattatgatttttccttaaaatttctaagatatttgatggctttttggtattttttttcttttgaaggtacaagagaaaaagagagtagtgaaaaaagaccactctgttgactctttcaaaaaccagaaacatcctgaatccattcaaggtagtaaagaaaaaggcatatggaagccagaaacacctcaggttagaaattctctttaaggattttcagctcttgtttgcatcccagtacagagaaattccattatgcagacccacagttattcagacttgtctgcattaaggaggaaagagcaaccagggctaccgctttgtcttcactgcactccccccaagtcatctcccctctcctcgctccacacgccagagtttcatgaatctatactttaatagttagtgttttttgatgccatgccagatttgactctgaagtggagttaaggtaggatgaagaatcttcttcccactaaagaatttatttctccctctggatttccttggaatagaattaaaatagaaataaatataaattacatctgatttcctgcctgctctcagtgttgcctctcccaaggtcattgctgttgggccgtactctgcagcagtcttcccagaacgctgtggagctcctcctgggaacagcccaggactggagagcgagtgccagttccacgtgcaggtgtcccagggtgtctcactgaagccttagtgtcctgagccgtaaacctgaggcacttggacgaacacatcaccactgacccttcctggggctcagatcttttgcttttagagccagtgcattaggctatggttgaatttttgtgtgctccttgaaatttctatttgataaccaacatggtaattttgcctgctggtcagttttaggtgctctgataaactgtgactcttgggaatcttactcatcttgtattccttgactccatatctgatctggcagctttccacttacgtgacagaggaggaggcatacgtgaagtagtgctagtgaaacatcaggccccaggagagatttgaatgcctttcccattaaagagctacagaaagtgacagttttgctccatcacagatttatttacaggcataagaaacacttgtctttctgtttcccaaatggatttttaactggatgtaattttacacaggactcatcaggtctcgctccatttaaaaccaaagaaccatccactcggatcgggaagatacaagtaattaaaacactggaatcttcattgcctgccctgtggcatctataaacttttttgggtttcctacttttgtcagctgctgccaagcatcttctcatctcttcccccgcctcccctcccctgcacctagttgttgtctcctgtgtgctgcgtctttaacatctattttttgagcccagtggtgggcataggtgtaagacgctctgttttaattctgagactagatcgggcgattttcctacgtttctctactcctctcgtattatacattatgtgcaccgaatcttgtcatgtgtcacaataaagataatagactgctgtgttgaagaacaaatacagagtttcatttttcttctttaggcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaaggtgatgaaaccatctttgcttccttgctctcttcttttaaccagaacgtgcatatgcttctttctagtttatcaattgcatacacagcagtctttgactctccttttgaaggaggtgcctcatccttccttcagccactccccactccattctccccacccccctcatcctgcacctgcttttccgtggcctgcatttggtacatttgcattctgctcagtagccacagtaacgtctcaccactttggctggtgtctgacacctgcaggtttccagcactgccacctgggggtcttctaaccacagagcagatcatgcccctcctgctggcgcttcctcactactccaaggagagcattcgggctcctgggtttggtatgaaacccctttgcaatcggtgccagcccatgtgtgcagcttcctcactagtcacttcacactttccagcctgactccaggcacaccaggtgccactccctgaacacacatggtctgttctgttgctgcccaaggctcctgctgcctcctcaccaggaatgctcctctctgtccacagctgtgcttccacatccccacttctgtgactgtgccctgcactccccgcaccaagttcccacagcagcgacactgtttcatgggatctcctcaatggactgtgaaccctttgaagttttcctttcattgtagttgggtttcttgtttctatccagtctcccttctctagaaagctttagctgatttccaagtaagcgacaggacacagaatgacctaccccggcaaatagattcatttcaaatgtttccaaacctgtttccttgtgcaaaacaaaacagccttccttttaacgagaattttcattggcttttttttaattaagtttaaattggcaactaaaattgtgacattcccctgaagttgacaacacaatcatactttgcccaaagtagattgtagcttctcaaaattctacttgattgtatattttggaaactatcataaacactgcatcattgctactaagtgattcatgttttgagattatatgaaaagttctgatttctaagccatatttcttatgtggaatatttaacatttgaattcaatgtttattgacttgaagaaaacagcaccctagattacctctctttattgtgtcatgtttctccccgctcctggagcctgaatttagactagccccctaacaaaggttagtaccagaattccccgattctttcttgttttgaaagatacccacgtttctattgagggtagagtaggggccaagggaggggttgtgagacagagagccaacatgcctactttccaggtttccagcaacagataaaactttttgtgtgaaactgaactgaaactgccctgagaagattaaaaaatggagaactctaaaggattaagaatgacttagtcttggagtactaggagctattaaactccttccttggaaatcattaagaaataacctcttctatgttcttagataatatcttcattgaagtagaccagataaccttataatattttgagtcactgattctttgccatggtagctttgaacactttattttgtcgtcagatcaatgtgtgtttttttgccattgcagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagatagcagagaatcctgccaacccaccagtgggtggtaaagcaaagagccccatgtttcctgctctaggtgaggccagcagtgatgatgatctctttcagtctgctaaaccaaaaccagcaaagaaaacaaatacctttcctctcctggaagatgaggatgacctctttacagatcagaaagtcaagaagaatgagacaaaatccaatagtcagcaggatgtcatattaacaacacaagatatttttgaggtaataggacttaacacgtttttgtgtctgttctaagttaaggaaggtatctgattggcttatttgagccatagattatgtctagcttgttgcgtgcataccccatagccacttgcttagtaattataattaggctcttttattaataagtctaacattgattcagaagtggttttttgttttgttgcatgtagattgcatttcttggctggccatgatcattgatactggtcttggtttctctagtttttacagtttttttatttttatagaatattgttgtaatcagcttcctgggcatgccactcagtgacatggcatacagctccactggtccagcttgggagtttaacctctggttctggggacattggccctggctggagctgacaatgtagtgcatgcaggcaataagactttcagtggcatttgctcagcagatgtttattgagcacctggggactgcaggcacgaggtgaactcagagaagtgctaggctcctcagagctctctgggaagataatcaaatacaaacagggcaatggataattaagatgttttcaaatagtactaagtgtcatgaagaaaataacctggggcagagtggtgggtagggctgggaggtgctcctttaggcaggactggtagagaaggtgtcactgcagtgccggcatttgagccggggtgagatgggcgggccaagctgtgcagagatctggggtagtgcatcccaggcagagtgggcagtcttgaggctgttccacacaccctggccaattgcatttccatagctcgttgttgtgtttgagcttaaaaagaaaaattgatttaacattgttttgtatgtatttttggcttaacaaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatgggtaagtttggttttctacatctgacctagagaattcttacctttctgtcacttggtatttttcttgctaccttttcttggcccttttctggaaaatgcaccccagcgggttcacttcagtgtaatcctgagttaggctgaagataggtaagagatggactaattattttagtgaagtaactctttcctatgatagtcatcaaagaatttgaaggcacccagagtttgacgtttaagtataatttaactttgatctcagtgcacctcaccaatcatctgtgacacaccccggtgttatgaaaggaggtttgatcagaaatgacctcacgtgctaaagtaggctgaggggactgccttgggtgtgatgtggttggttgagtcagagctccagatagacagggagtgtccatggttctgtgcgagaagagagcaagtctagacctgggtgtaggctctacctcaggcgttgcatttcactgaggtctttggtgtttgggaacaagcttgtcttccttatatggcacaacttctgctttattagtagacaaggcaaatgcccgagaaccctaaatattggacttttgataaatcctgtgggctgaggccacatacacatttcctactctccccatcaatctagaccttgagactaactgggagacagctggtgctgcagagtcacacactggctctgtgcctccagcaagccgtgtgctctgtctcccctgcttcccgccacatggagtgcagaagggaactcattcattattttaaatacaaaaaaagtaatacatgcttattgtaatagattcatgcaattcagaaaatgtaagaagtgaataacccctagaggtaatagtaacagtttggtgtgtatcctttcagacacagtgatattaatatatgtttgtgtacacatcaatatatacccacctttttaaaaagtaagaatatatttacctattctgctctgtcttttagttacttaatgtcttttcatgtcagtacatagagatctccttccttgttttcagtggtgtgcacgatttctttgtatttagccattagcctgttgatggcaatctcagttgtttctgttttctttattacaaataatgctgtggtctttaccatttgtgtacacctaactttatgtatacatgttaaatcatggttggataaaaccctagcagtaacattactgggtaagtaccataattagataagacaagcttttgagtcagtgaaacactaaaagaatgcagtgacggaggcttacagtcttacatcgagatgcctcaaatcagtgcatttattctgaaagaaaacaggtgggtcctatgttggatttccctttgcgtatttttattgctcttttaaaacccagtatgaaaagaatatctaaataagtccattgtccctgatggtaggggcgtgggctggtttggagatcaagttacgcttcccttttttctgtcctacacacgcacatacatacacttttgtagctgaagaaattgtgctccaagagaaacctgtgtgtgatcataaaatttaatgagtaacaaacacagaaccagaatctaagaggcttgagttctaggttagtgttttagggtactccatgctgttaccagagctgggtctttggtggtttgcttgcatgtgtcttaaaagtacctttctccacccctcttcagcaaccgtttttcttttttctttctaaagatgacatcttctcctctggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacaggttaccctgcagctacattgttgagttagtgatgatgttgtatatgctgatggtcttaactggattacaaaaagcaaatactagaacagctagctcatcgttcacccaatgtacttggtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatcccagagatagcaaatgccacctgaccagaagtctttgttatatggatgggaaccctaacttagggcctgggcaggggaaagagaaagaaggtgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaacc

SEQ ID NO: 38058 - DNA, 65585 bp, Homo sapiens
ttggctggggctaggcttccggggctctgcagtcctcggcgtgtgctggcagcttcggagcccaccgagccgggcggctaggatggtgagggcgccgggcaggagagaggccggcctgggctggggccgccgtccctgccgccctcaggctcagcttctcttctcgtttttttcgctgcagatgaaccggacgacccccgaccaggagctggcgccagcgtcggagcccgtgtgggagcggccgtggtcggtggaggagatccgcaggagcagccagagctggtcgctggcggccgacgcgggcgtgagaggcgggccccggggacgcgagagcggcaggggtgacgcttggcttgcgcgcaggagggccggaccgcgactgcccctgcacctggcccgtcccgttgcctgccctcttaggaacacacgccccgtttagcccccgagaatgccaccctggcagtccccggccaccagggagaggggcagacactgaccgtggcccagacgcgacgttcccttcatggggtttctggctcagctccatccggaggggagatccgtttccgccacactgagggattgctcgggcactagggaggcgattcctgttgggacctggactaaatggggtgggaaacaagccagtatgtggatatcctttaatgggatttttcaaatcgggggcccaaaaagctcagaactgttggagtcccaaatgaataggatttttgaataagagtggtggttgattagctaacccttggtctgtgatctctgtagattgacaaccaaagaggacttttaaaaggagacagggttttgccctgtcgcccaggctggagtgcaagtggcttgatcttggctcactgaatcctctggggttcaggtgatcctctcacctcagcgtcctgagaagctgggactataggcgtccaccacacctgtctgatttgtttatttatttaattttagtagagatgggggtcttgctatgttgcccagactggtctgcaactcctggactctagcgataaccctgcctcagcctcccaaagtattggattacaagcgtgagccaccatacccagtgccaaaaagggattttaaatttttccagaaacgagataggtgtccattagctcactgccactcttttgatgagctttcttagtgttttccaatgtcacttggttttagtacttgtcaaaccagcattccagccgggcacagtggctcacacctgtaatcctagcactttgggaggccgaggtgggcgaatcacgaggtcaggagttcgagaccagcctggccaacatggtgaaaccccgtctctactaaaaatacacaaaattagttgggcgttgtggcgggcacctgtaattccagctactcgggaggctgaggcaggagaatcgcttgaacgcgggaggtgcagtgagccgagatggcgccattgtactccagcccaggcaacagagtgaaactctctcaaaaaaaaaaaaagcatttctttcacattctaacactcaaaggtgaaaggaaatgggttcttttttgatgtgacatgcagaatagttacatgtaacattgatactactgtatgtttattttttaaaatagctactacagtttctacaggaattctcacagcaaactatctctaggacccatgaaatcaagaaacaagtggacggactaattcgggaaaccaaagccacagattgtcgcctgcataatgtcttcaatgacttccttatgctctctaatacccagttcattgagaatgtgagttatttagttatattatcattccttttttgggagtaggagatattgtaattttaaataacttactgttaggttccctcctaaattttggtggaagtgtggttcttggtaattgtagcttttttctctgggattaatacctcttttttatttgtaaagttttaagtccttttttccaagcctctaaaaaagtctaatgataacattttcttatacttcggtgcttccatcttttgtcgttttgagagtagtcagcaattgtgctgaattttgtggcactcacactgcctttgttgtggcgtgatctgtaaggacagctgtttacctggttagaccctctggacaccagcatatggtttcacttgttgattggggtcattctgttctgataaattatattcaggggatatatatgtctgcttgcaatactctcaactaaagtttatgatggctgaacttacaatatggaatcaactgtaaacagattactgagcttaaatctatgtgtgatttttgtctatttactgtttcttctaggtggtaggaatacataggtaaattagatagagcctctcccttggcaaatagtataattccagcatacaaaggaagtaagtatggctggagcagagtggagacttaagagatgaggatggagaggaagcttaggtaacagacctgtgtttctcatagggtgtcccaactttctgaatatcagcattcatttgtggaaaaaggattattaaagtaagcgatctcctgagattgttagatataaagtaataaaattttcagaatcacaaaattatttaaaaagcccaagatttagaatagttaagagaatgccatgtagtcaacttgtgcagcatgtttgtgcattttttaatagctggagttaaatgccacttcctgtctttttttggagagctatatataaaataaagacattaataaaggtgttagagatctctttgccagttatttcctttaacagcaaaggagtacttatgagtttgaaaaataacaagtattcggccaggcgtggtggctcatgcctgtaatcccagcactttgggaggccaagacgggtggatcacctgaggttgggagttcgagaccagcctgaccaacatggagaaaccccgtctctactaaaaaaatacaaaattagccgggcatggtggcgcatgcctgtaatcccagctacttgggaaggctgaggcaggagaatcgcttgaacctgggaggcggaggttgcggtgagccgagatcctgccattgtactccagcctgggcaataagagcgaaactccgtctcaaaaaaaaaaaaaaagtattcaagtaaaatcagtagttttctgattgtttacacagaatgtccatgcttggtcctgactatctcactggaaaagtcagggactctagactcaacttctctggtgtgcacagccccataatgttttcatcaagattaatttggtgtccttttaagcactcctgttcttttcattctgtacttttcttgctggatcaggtagtcagcacttctctgcagtcagtgctgcagcaccagagtcccaaaggatttgggaagtttctttttttttttgagatggagtctcactctgtcacccaggctggagtgcagtggtgcgatctccgctcactgcaagctccgcctcccgggttcacgccattctcctgcctcagccttccaagtagctgggactacaggcgcgtgccaccacgcctggctaattttttgtatttttagaagagacggggtttcaccgagttagccaggatgatctcgatctcctgacctcgtgatccgcccacctcggcctcccaaagtgctgggattacaggcctgagccacggcgcccggcaagggaagtttactttgtacccagtgtgcttgtaccagattggtactagattggtaccagatcaatacttcagtgggaagaaatggggaacatcatacaatttttctcaatcacagtcttaggtcttatcttttctccagctcttttctagccaagttttcgtagattctgagttttccatgttgtagtttttgtggagtttttttggttttgttttattgtgttttggtaattgttctttatttctgtccaatactggggatttcctgttttccatccatctctccatccctttagccttagcttttttttttttttcttccgagacagagtcttgctctgtcatccaggctggagtgcagtgacaccatctcggctcactgcaacatccgcctcccgtgttcaagcaattctcctgcccacacctcccatgtagttgggattacaggctcccgccaccaggcctggctaattttttttctatttttagtagagatggggtttcaccatgttggtgagtctgcttttgaacttctgacctcaagcgatctgcccattgcaacctccgcctcccgggttcaagcagttatcctacttcagcctcccaaagtgctaggattacaggcgcgagccactgcgctcggcccttagtgttaagtcttgatgccccttcgccttccagtctgcagccagaactcttctccggatgtgctggttgccgctgccaaatcttaattacttcccagaccttctataaggccacatgctataggtttttttaatttgtggcaaagcatgataatactgagaaaacagctaatgcttaataaaactctgaaaaaatatagttgctgatatatatttgtaagtgatctggctttttttttttttttttttttttgagacggagtctcactctgtcgcccagactggagtgcagtggtgcaatctcagcccactgcaagctctacctcccgggttcacgccattctcctgactcagcctcctgagtagctgggatgacaggcacccgccaccacacctggctaattttttttgcatttttagtagagatggggtttcaccgtgttagccaggatggtctcgatctcctgacctcatgatccacccgccttggcctcccaagtgctgggattacaggtgtgagccaccatacccggcaatctggctttttaatgttttattttcaatccctgacatcagtacttaggtgttacaattccagcttgaattatggtgccatttggtttcatggtaatttatcagaaacattcaaagtcagataggtttctgggtcttattaattagcctcaggggcagccacaaagttgcaaactatattataaagttagtgaaacaatccagactttctagggcgagaacagtcaggactttttagggcaagagaaattaataccattagtaaaggctcaagaggggacttggagggagaagaaatactaattaacattggccagtgttctagtgtctaattagaaggcaacacaattctaaagccttaattatctgttaatttaggaattggatcctgaaatagcaagtgccatagttaatgactttagtttgttaaatgaactggtgagggaggattttttctttttaaagtcaattgtttccaaatcttagctttgtaaaattaaaaaaaaaattccagaatgaaacaaattaacctgtttatgcccaaggttagaattttttttgtgaaaagccagatcttggcaatgaccttgagcagtaggatatacataactctgacaagcttagtgttccaataatgggacactaggcataaattggttaattttccagatcatcttcctgttgatttataaaagctgaattttggtcatttttccctccttttctacttttctattgaagaaacagatggagttgctgaaactgtcaagtactcagcaattagagagaaggaggtaaagcccaaaagcgttattaacatataatttcctgcacaggtttttccctctccccctagacctgctttattttacataatgccccttgcttttgacactccagccttctcattccttggagatgccatatgccctgctgctacggggcctttgcttacattgcttcctatgcctctaccctttgattgacatctgtctgtcttctaggtctctgctcaattatattacttcctcctggaccctctgcactaggcacaccccctggataaaagcagctgaagcatcacattctttagtagacttcttacaattgtaattttacaattattgatgggatttgatgagttggaccctcccgctaaatcaagccccatatttttaacaacaactatatttgaggggtccagcacaagcctgatatttagggatccagtgaatatttgaatgaatgagagtacgcataaatgaaaggggaccagggctgtgtatagtctgttactctccagccctggtccctttttccccagttcccctctttccccttttaccctgtctccccagatgaggagcaataccaaagatatttaacagtcctgggtatagctatctgactgtaaattgatcacaaaacacatgaagctgtgagtttagcaggtgaggatgaaagaagttagcattggttatctgctggatatgaagtagttgaggatgcatagtcctgctcaccctgaaaagatcccatgggctttaggtcccatgggtttaggtttcttagatgtcatgtttggctttccagctgcaggctgctgataggtaaccatggtagctgccaggtcttaaagtctcacttttgagatttacttaactttttggagtcctgactttgaaaattaccaaagtaatccctgatctttatagagcaattaggaaaagtaagaaaaagaaaaatcatgtgaaatttcctcagcttgaggggagcctctcaaggtttagcacatatattctaagtccatttcccatgcagacatcaggcttaaaagaattgaacctacagtaggccgggtgcggtggctcacgcctgtagcactttgggaggccgaggtgggcggatcacgaggtcaggagattgagaccatcctgactaacacggtgaagctccgtctttactaaaaaatacaaaaaaattagccaggcgtggtggcaggcgcctgtagtcccagctactcgggagcttgaggcaggagaagggcgtgaacccgggaggcagagcttgcagtgagccgagatcctgccactgcacttcagccagggtgacagagcaagactccgtctcaaaaaaataataataaataaataaataaataattgaacctacaaaaaatcagctaccccaaattaaccaaccattgaacttttcagtgtatttttttctgttcttgttttttaactttaaccttttctagatgacggtatgtgtgtgtgtgtgtgtatttacatttgcagcctactttttttcttaatgtgaacttatttaacccatctttgagacttttgtgaatataatttttttgttcttaaaccgtatcataatttatttaataatcttctaatattaaatgttatttatgaaatgtttcataaatttcataaatgtttcataaataaatagaaaagttcagagagaaaccacaagtgctaagaaaatgtagcacctagcatcagtggttttgtatcttgccacatttgcttcaaaggtgcctacccaccatattcgtccttaactctaatcattttgggtggggattccttggtatctctgcctttttattctttttttgtttttgagacaggatctccctctgttgcccaggctggagttcagtggtggagacagctcactgcagcctcaaactcctgggctcaagccatcctcccatctcagcctcctgaatagctggctaggaccacaggtgttcgccaccatgcctggccaactttttattctttttacctagagagggatttcatttttatcccttatagataacctttattgtgtagttgttcttttcttcattgactattatgtatgaacgtttgtgtgtgtttatgtgaaaataaaatcaggcctccatggaattgtgggtctgtttctgccctctgctgtttgttttgtttctctgctgtttgccagtatcataatcttaaatactgcagatttctaatgtcttattagggcaagtccccataatctctttttattcagaattgtcatggttatcaatctttggctttttacttttctgtgtgaatttgaggattatcttttacttatttatttatttttttgaaatagagtttcagtcttgttgctcagactggagtgcaattgtgcaatctcggctcactgcaacctctgcctcccaagtttaagcgattctcctgcctcagcctcctgagtagctgggattacaggcaccggccaccacatcaagctaatttttatatttttagtaaagatggggttttgccatggtttcaccatgttggccaggctggtctcaaactcctgaccgcaggtgatcccaaagtgctgggattacaggcatgagcctcccaaagtgctgggattacaggcgtgagcctcctaaagtgctgggattacagtcgtgagccactgcccccagcacgattatcttactatattgtgccacagaatattttattagcgtttgattggaattgcatagaattataaatttggtatttgtgactttctgctggaaatcatgataccatgaacattctgatgtttgcatttatgataattttcatgggagctaaatttcaagaagtagaattttgggtcagaggatatgatcgtttaaaaacaacattgtttgatcagattggcagatacttaaagatgggtggacaggagccattgctggcaaaggtttgggtaaggggcacttgagtatgctgctagtgacagggaattctacacatttgtgcatagaatctgggaatgactattaagatttatttattccctctctaggtaaaatccctctctaggtatataaataaataataaataaataatcagtttcagccgggcacaatggctcacacctgtaatcccagcactttgggaggccaaggccgatggatcacttgaggtcaaggagtttgagaccagcctggccaacatggtgaaaccccatctctactaaaaaaaaaaaaaaatgcaggccgggcatggtggctcacacctgtaatcccagcactttgggaggctgaggtgggcgaatcacgaggtcagattgagaccatcctggttaacatggtgaaaccccatctctactaaaaatacaaaaaaaattagctgggcatgggtggcaggcacctgtagtcccagctactcgggaggctgaggcaggagaatggcgtgaacccaggaggcagagcttgcagtgagccgagatcgcaccactgcactccagccttggcaacagagtgagactccatctcaaaaaaaaaaaaaaagggcaaaaacaaattagccgggtgtggtggtgcccgcctgtaatcccaactactcgggaggctgagacaagagaatcatttgagcctgggaggtggaggttgcagtgagccaagatcctgccactgcactccagcctgggtgacagagctagactctgtctctaaataaataaataaataagcaggaagggtaggagagctctaaatatatgcacttgttagcttatatttatgttcagagcctcaggaaatgagcatacacaccaggcttaaattgggtattccaaggatcaggttggggatagggagggaactattttaaaatacatctcttttacatgtgcctttatattgacttaaaattttaaaaattgagatagaattcacataccataaaattcagtcctttaaaaagtatacaatttggtggtttttactgtactcaaagttttataatcacggccactgtctaatgccagaagattttcatcagttcatttatattgacttcttatttctttctttttaaaaaattttaatttcatttcattttatttttgagatagggtctcactttttcacccaagctgcagtgcagtggtgcaatcagggctcactgcagcctttacctcccaagctcaagagttcctcctgactaagccccacaagtagctggaattacaggtgcacaccaccatacctggctaatttttgtattttttgtagagatgaggtctcactatgttgcccaggctgatcttgaactcctgagctcaagtgatccccttgcctcggtctcagagagtgctggccttacaggcgtgagccaccgcacctggcctatattgactttttataacaagcatgttgtacttcggtagtttttaaaacataaaaatgattttaaaaaccaagaatcacagtgatttggcagagcagtgggtcttttctggaaaagagagtcttgcctacccatgctgtcagggttagtcaaatgcccaggctttctggcaagtcagtggtagatttttctctctgctttcatacaaatgggataataaaaatttatcagccattttaagcaactgaatgaaaataagttttgcctttaccattttccttgttcaaaatcctgaagttctagtttcctagttgataaattacatcagttgacattctccataacctggggtcagaatactgtatcattgcccatcaacattattaggttaaatgaaaaggtgtgaaaactgatatcttactgtttttgcaactcttggtttacaacgaggttaaagtttcatcatgtttcctagtcatttgtatttaaaaattttctttttttttttggtgaatggactattctttgctgtttgtccatgacccactgttacggacacccacctggtagtggtctcagccctttgctgaataaccatttccttccccatctttgtccttagttactgtgtgaattcttatattgtgatttatttccaatgacgtgttgaccttttaacattgagtttgcttccatatttagcgtgtatatgatgaagaagtggaggagccagtactcaaggctgaggcagaaaaaacagagcaggtacttgtataaaatcactcttagctgagtttctgactttgaaaaatgtggtggagatcgatgtgttatgtgggaactgggggatggtgggcggggttgggaaagggagggactgctcctgacagcagcccaagaggggattctttcctttgtttctgaaatgtagtgtattaactaatacagagatcaaatccttgaattctgatataagaatagagtagaagtcagcaaacttcttttgtaaagggccagatagtacatattacagatttggagggtcacagaggtcatttttttcctgtggcttcctgagttacagatggaccagccttcttcctgagatcttctcacaccagagcccaaaacatagctaagaggttctgggtcacactgacttcttagcactccagcagagatttctttttcttccactcaggaaggcacatggactgtgaataagtttattattggagtagctttgattttgttctcatttattcagaaaatatggatcacctgtaaaggttggccctttgtcagcaattattacttgtaacagatgaagctgttagactaggaaaagggtattcgaaaccagctatagttctgcctgttgccagcattttttaaaaaaagttattttattttattttttatttaaaaaaattttttattttgagatggagtctcactctgttgcccaggctggagtgcagtggcacgatatcagctcactgcaacctctgcttcctgggtgcaagtgattctcctggctcagcttcccgagtagctgggactacaggcgtgtgccaccacgcctggctaatttttttgtatttattgtagagacggggttttgccatgttggccaggctcgtctcaaactcctgacctcaaatgatccgccagccttggcctaccaaagtgctaggattacaggcgtgagctactgtgcccagcaggttattttatttttaatagaactcaaggatttgctagccatttaagtgcagtagtatctggttataccaattcagggtttaatttgaaggtgataggtatttagtgtactatttttaaaaactgctatatatttcatacacattttcacaaactcagtacaatattagctatttaactcagaatcaagcatatccaaatagaaaaatacacaaccaagacaaaaaagttcagttagaaagacttcagtacttgagataaaagactaaaatgctcgtagggttttttttttgcctttggccctcagaacaacactgtgtggtttggttccttctagaatatttgtagagggggaaatgacactaaatatttttcggtatttctcacaatggcacacttgtgtctgcggggactgccattgagaactgctgttgcaggaagaagacacctgagggagattctcagcctgttggtgatatgaacaaaccttttttcttgagtggggcattgttgtagggtatacacagaatagaccggagatgaaaatgacccccttttgatgtagaacagatttataaaataattgtaattgtccagtattttttttttgtctctttaaactgtaattgaaaaatgagacctctgtgaccttccttctaagtcttaacacctaaaattacccaagggataaccagggctcgtgggatagtcatggtgagtctgagagtctaggccctccagcagtggggaaacagcatgtattcattgttgggatacttctccacacactagttgtacctctgcttttgtagacgatgacccttgagctctggaaccttaggtagtttgatgcatgtccagaaaggggcaaacttgggatttaaaacttgcagtcttactccaaagtctgtgtcaaggcattcagcagaatttgacttttttaacatttttaataagtttttttggagcttgaggctaggctttagagaacattcacagtattcttttggggcagtatcagtatattggagacccatactgcatggtatttattttgtaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggtgaagacattcaacttaaatatttattgcacaactattatgtttgggctactttaattgggcacacgattagtaagtcatggacttaacctctgggaagtgagtatgtcacttagtagtctcacattgactccaccagaaagactcgctttacctgagcactgatggagtacttgtgaggcgcaaggcaacatgtcaagttggggtgcaaagatgcagagcatggcctctactctcgaggtgtgtgttgcagtctggtgggagagaggagacatacatacgaataaccgttgtaaatgccctgagagagaattgacttccagctggaattttggggcaaagatgatatttgaattggggtttgaagggtggggaggctcaaaagagacagagagtgttgggaacctgaaattatgtagcttgggctaaggaagactgcagaagaactgaaaggcatttgggttgtttccggtttgggcaattattaaatacaaatgaagctgctgtgagcattcacgtccaggctccctcatagcctagtgagtgttggttgcttgacacactttctcccacattgttcaaagagacaattggggtgacacagagtctctcggtagtgaacacagaaagttaccacagtgatttatagaaagaggccttgtgacacacaaggccttccgaattaaaacatgccacagaaccaaacccttttttttttttgagacggagtttcactctgtcctccaggctggagtgcatggcacgatgttggctcactgcaacctctgcctcctgggttcaagcgattctcctgccccagcctcccgagtagctgggattacaggcgcccaccaccacacccagctaatttttgtatttttagtatagacagggtttcaccatgttggccaggctggtctcgaactcccgacctcaggtgatccgcctgccttggcctcccaaagtgctgggattacagacatgagccaccgcacccagcctgaaccactcttctagtcattctgtagctgcacatttctcttccagtttgagctttgctgagtcacaccaaattgaggcagatcatttggcactgaccggtacacttgctgcttggattttcactgtatgcctttaaaagtcagcagtggactctgggaaatggattgcctggaccacacttgatacttccaagacacacagcactttctctcttttttttttccccttgcagagaaagttgtggaggtacacttttcttttgtaggaggatttggggttgtcttctgagtcagtgagaattagtccaaattaacgctgtctttgccttatgctccattggttgctgtgacgtcgttgaacctttactttaaccttcccaatctttctgttgttgtgtgaaatgtcagaattattctcccctgccccagagtcctttgacaaggaagagatatcattgccaaagggcaatgcctcacaggggacagggcagcatttccttcagcagtggaggtaggaggctgtgcaagggtggagcactttcttgaccctattttttttttttttttgagacagagtttcactcttgttgcccaagctggagtggcgcaatctcggctcactgcagcttctgtctcctgggttcaagtgattctcctgcctcagccttccaagtagctgggattacaggcatgtaacatgacacctggctaatttttgtattttttagtagagacggggtttcaccatggtgaccaggctggtcttgaactcctgacctcaagtgatccgcccgcctcggcctcccaaaagtgctgggattacaggtgggagctactgcaaccgaccaaccctaaatttttaatgtgtgtgtggtgtgggactgacaggagtagacggctgacatgggcagatctccagcatgtgctgttggggccacagtctcctgccctcactctgttttctcatctggtcttattttaccaacttcaattttctaaattcaacagtgtggaaccactagggggtattgttcttctgtttattgagttataatcttttttatttatttatttatttattttgagtcagagtttcgctcttgttgcccaggctggagtggagtgatgtgatgttggctcactgcaacctccacctcctgggttcaagagattctcctgtcttagtctcctgagtaaatgggattataggtgtgcgccaccacacccagctaatttttagtattttcggtagatattgggtttcaccacgttggccaggctggtctcaaactcctgacctcaagtgatccatctgcctcagcctccgaaagtgctgggattacaggcatgagccactgtgcccggcctaatctatttttatattaaaatatatagttacattatgtctcattagtactgctttttaggggacagctcaccagaatgttcagtttctttccttggtcctcctcttcttggaccttatactaggaggttgtacccttttccctgtttgcttgctgctgatagacttttggtaggcttttgccatttttgttaaattttgttaattaggcccttggggagggagattctgtgtgatacagctttactttggtatcttttttttttttttttttttgagatggagttttgctcttattgcccaggctggagtgcagtagtgcaatctcagctcactgcaacactgtttcctgggttcaagtgattctcctgcctcagccgcccgagtagctaggatgacagttacccgccaccatgtcccgctaatttttttggatttttagtagagacggggtttcaccacgttggtcaggctggtctcaaactcctgacctcaagtgatccacccgccttggcttcccaaagtgctaggattacaggcgtgagccatggtgcccggccttaccttgacatctttacctaggatttgacttttaaaaaaatcagtgaaaaaaagaattttttttttaacttttagtcctgctgtgtttcttattctccactttcgttatgtagcttgtttgggatagtcagatggaacagggtatcaggtggcacatgtaagtttgttttcaactgaaatgtttgacagcctattcctttcatgatgtacaggatctatacattgatcgtcctttaccatatctcattgggtcaaagctgttcatggaacaagaagatgtaggtcttggagagctgtccagtgaaggtacttttcttcaccaaataattttgttccttaacatttcttttttattttaaaataatttcaaattttacattaaagtttcaagaatagttcaaagaactctcatatacccttcacctgggtttaccagttaacatttcaccacatttgttagattgttctctacatatacgtaatattttgtcttgagcctatttgggagacatcatgctcatgccctgttacttctaaatgtttctctgtgtgttttctttttttcttttctttgtctttttctttttttgagacagagtctcgctctgtggcccaggctggagtgcagtggtgcgatctcagctcactgcaacctccgcctcccggatttaagcgatttttctgcctcagcctcctgagtagctgggaccacaggcgtgcaccaccacacctggccaatttttgtatttttagtagagacggggtttcaccatattgtccaggctggtctcgaattcctgacctcatgatctgcccgcctcggcctcccaaagtgctgggattacaagcatgagccaccgtgcccggctgtttttctttctttctttctttttgagccggagtttctctctggtcacccaggctggaatgcaatggcgcgatcttggctcactgcaacctccacctcctgggttcaagcaattctcctacctcagcctcctgagtagctgggattacaggtgcccaccaccacacctggctaatttttgtatttttagtagagatggggttttaccatgttgggcaggttggtctcgaacgcctgacctcaggtgatcctctgtgtgtgttttctaagaacaaggacatctcttgtataatcacagtagaattacaaagccaggatattttcctggacataagggtattatccaatctgctgctatgttcacattttgccgtttgtcccagtgacaccctttacagtctctctcttttgttctgtggtccgggactcaatccaggaccagccaccacatttggttgtcaaatcttcagttatcttttaatctgatgccatttctcagcctttctttgctttttatgaccctgacatctttaaagagtacaagcaattttttttttatttgtaatgaataatttttggggggagagatacttcaagactacataaatatgtaattcctcaccataatgacactttcaattccagtaagtgggtatagatggttttatcaagatctctgtgatgctgttgtatggtggtttgtgattttgagctaaggacattttcttgtgaatattggtgtggtgacccttatctctcttctcaacagaaggctctgtaggcagtgatcgtggcagtattgtggacactgaggaagagaaagaagaggaggtaagggctgtttggtatgaccaggtcacggtgggcagcaagcttaatttaagatgggcctagcaggctaagtaaatagcataactgtgaattcgtaatctgcttccataaagcttttaacagtgatagaagccacattctgagttttttttcccaagggttagatttcctttttgccttatgtacaataatagggaaagctgctttcatctcttccactattatcctctctcccaccttgccaccaaatatctctttcacccaatatatttttgagaagggcagcttagatgttttggtggaatctctgcctgggatatagtctttgagtatattctgtctttgaataattctaagggaaaaaatctacatttagaacttttgtaaactataaaacctagagcaggatataccgaaagccaccacttacattctattttgctgctgccgctagcgctttcatatccacagagcataatttcatttccttgtctagagtttgagtttgtgggccttgactacagttgaatctgtagttgttctttagatgggatattcgttattgcaaaggacacagccatgttgcaggagagtcctcgagtatgggatttccgaaaggagacagtgttgtgtatgtgcttttctcttctggttggtccccctttctgcactctccctgcccgcctttcttccagtcctccaaagaaaaacctgacagcaggaaatgagcttttcttaagtaactttcgtataacaaaagcagtgctcattaggggaatcccttgcttttagccaccgatgtggcacttctatgtggcacttcatcaatagttgctcgtagcaactattgatgtccccttcttgggcctaatgaagtagttatttttattattttttttattatactttaagttttagggtacatgtgcacattgtgcaggttagttacatatgtatacatgtgccatgctggtgcgctgcacccattagctcgtcatctagcattaggtatatctcccaatgctatccctcccccctccccccaccccaccacagtccccagagcgtgatattccccttcctgtgtccatgtgatctcattgttcaattcccacctatgagtgagaatatgcggtgtttggttttttgttcttgcgatagtttactgagaatgatggtttccagtttcatccatgtccctacaaaggacatgaactcatcattttttatggctgcatagtattccatggtgtatatgtgccacattttcttaatccagtctattattgttggacatttgggttggttccaagtctttgctattgtgaataatgcaaggaaatagagacagtatagtccaaaatgtaaaataacacaaactgactttcagtaatttagttagttaaatgtgcaactctttaaatccaaaggcaagagttgaaagtgcaggtgatgtgaacaaattgttagaggcatttaagtgaaccacaaaaattacatgttaactggaacaacccttcacaatattgccagctatccagcttatctgcaccttgatacttaaggtgaccagtagtcagtacaaagagactgagtgtcagagctttttctccacttgacatagaatcagcctgccccagagacttagacctgcaatcatttctgtgcttctaagtaaagcccatttaacaacaaagccttttcttccccacaaaggagtcagatgaagattttgcccatcatagtgacaatgaacaaaaccgggtaaggctcatatattgaaatgactttgtttttacattttaattgaagcatagtatatatactaatattactttggaatgatttatgaccaagtgaggattttttcttgtatacaatttattttcctttaagcatttcatgtatttaggctaactacctcctttgtatatattttttccaattttgctttatagtttatttttcttagaaaagaagtttcaaagaagtgaaaaacacaattggaaaacagagcctctaaaagaagactcagttacccaaactgaactactttgcatgagtccctcttctgttttaaaattggagacaatctagcagtaacattattgagtattcacaagatgaaaacttcttaccctactgtcttagcacggttatcttaatttttgaatagctaaaggcgtattcttttcatagtgtgcatctttcattttctgccattttatgttaacattttataaatgtatccttatttattattattatttttttgagatggagttttgctcttgttgtccaggctggagtgccgtggcatgatctcagctcactgcaacctccgcctcctgggttcaaataattcttctgcctcagcctcccgagtagctggcattacaggtgcccaccaccatgctcagccaactttttttgtatttttagtagagatggggtttcaccatgttggccaggctggtctcgagctcctgacctcaggtaatccacccaccttggcctcccaaaatgctgggattacaggcgtgagccaccatgcctggcctccttattttgaatagcctttgcagtttgcgttgtaaacttctatacttttaaacatactgagtatgatactgtcatagtctctaaatgtataagggaaagggtttatttctagagttgtatttttgatgtaataatgtattcaatattttcttttcttttttttgagacagagtctcgctctgttgcctaggctggagtgcagtggtgtgatctcagctcaatgtaatctccgcctacagggttcaagcgattctcatgcctcagcctccctgagtagctgggactatgggtgtgtggcaccatgcccggctaattttttgtatttttagtggagtcagggtcttcccatgtttcccaggctggtcttgagctcaggcaaaccgcccacttcgccctcccagagtactgggattacaggtatgagccaccacgcccagccaatattttcatatatagaaatcctttgcttcggtgaactgtttcttcagaatgaggtggtatagagttatgttaataactcttaatgtctggtggacattctaaattaagtattatgcatgtagattttcctacaatctcatcactggggtgattattttaaatttcttttagttaaaaatttgcatttaaatttcttaactgggaaatatttttttcacaaaaatgtttaactatcaaatgaaggattttatactttctggttgttactgtattttcctggttgtattcataaatgtggttgatctctataattttaacgatcagtctttcttcataggatatttgtttctatggaatttcctattaagatctgtaaatgcaaacagtttttctttccttttttttttttttttttttttttgagacagagtctctctctgttacccaggctggagtgcagtggcacgatattggttcactacaacctccacctcttcggttcaagtgattctcatgcctcagcctcccaagtagctgggattataggcatgtgccaccatgcccagctagtttttgtatttttagtggagatggggtatcgccatgttggcgcggctggtcttgaactcctgacctcaggtgatctgcctgcctcagcttcccaaagtgttgggattacaggcgtgagccaccacgcccggccacaaacagtttttcaaaaacagtacagtatagtgagtaaaagcactagcttatgcaacaggttggttttgtgtgctgcagctaacctcaaagttgtaaggattaaattagataataaagtgcttttagtaacatgcctggcacagttcattgattcaaacattgaaaaaaaatttttttaattatacatagtagtgtgtacctttggaaaaattagaacttaacagataaggctaagtttgagccttccagtcctttccttctctgcatactcttcagaggtaactgggatcatgttctgggagcatgtcattccaagtctgtttctttgcttttataaacacatctgtttccatagaaatgctgtagtgtttgcagagggggcggggcgtggtatcatcctggatttgttattctgcgcttttttgcttgacctaccttggatggctctctagtcgttacagcttttaccttttaactattactcagtattcttactaaggtaagactatgctgatgatgtttatatttctctagtaaaaggctgggcatggtggctcacgcctgtaatcccagtgctttgagaatgtaatcccagcgctttgggaagctgaggtggttggatcacctgaggtcaggagttcgagaccagcctggccaacatggtgaaaccccgtctctaccaaaaatataaaaattagccgggcgtggtggcgggtgcctgtaatcctagctactcagagggctgaggcaggagaatggcttgaacctaggaggcggaggttgcagtgagccgagatcaccccattgcacttcagcctgggcaaaaagagcgaaactccttctcaaaaataaataaataaataaaaatatttctctagtaagccatttttgatattttaatattctgctttttatattcttgttgttacattcttataaaggatacatttttaggccgggcttggtggctcacgcctgtaatcctagcagtttgggaggctgaggcgggtggatcacctgaagtcaggagttcaagaccagcctagacaatatggtgaaactccatctctactaaaaatacaaaaaatttgctgggcgtggtggtgcatgcgtgtaatcccagctactcggaaggccgaggcaggagaatagcatgaactgggcaggcagaggttgcagtgagccgagatcgtgctgatgcactccagcctgggccacagagctagactccatctcaaaaaaaaaaaaaatatatatatatatatttatatttatatatatatatttatattttatatatatttttatatatatatttttcttagattcaaagtaaatcttgtgtattatttcttccagcacatcttttgcttcataacttgctgcatcatgtttatgattattattttaaaaagctgttacttctttgaaggaggagcctaaaggctgacagtatctcttctttagcttaataactagtagttctaatttggtattttatactcttagcacaccacacaaatgagtgatgaggaagaggatgatgatggctgtgaccttttcgctgactctgagaaggaggaggaagatattgaggacattgaagaaaatactagacctgtaaggaaggctgtagttgctatcacttggcagagttttagaaccaatgacttgtttttctttttattgtgacttactttgtacatcactcattttggcatatttgtcatttcatttacactttggaaaataatggcaagcatctcaaattgcctcacaagtaccactttcttgtccagatgttatgattttatgagtcagatcattcagaatatgtctagttccagagtttgaagaccatagtgctcctgtctctccatccattcacctttttcttattttcgtatttagatttttaagtattaaagtcaagtattaaaaagaataaggaaataaagggcatctccctttgaaggaacattttatgagtcctattccttgggtgagctgtatagggtacatatgtttaaattcatttaattaaactctgttttctcctcagttcaatttctttgctcttgtatacataatgttgttaggtgtccaaagtgaagtgtactagtttgttacaaaaaagcgattcttttgatttctcctgctgtagaaaagaagcagacctacatcgtttgcagatgagctggctgcccgcatcaagggggatgccgtgggtcgagtggacgaggagccgacaagtgagccccagccgcgttgatggggagtagggggggagtagtgcagggccctctgctggcttcaccaaaggcggatttctctttttattagtaattactacatatatttattagtaattgctacatataatttaaattgtagcgcttattccttttttggttaatgagctcctttagataactgaacactgtggacccacaagaaaaacgtacatgtacacatgtagataaccctttacatataatttcaggggattaatagaaactccagagaaccatgggcaacagcttaagaattcctggctgaatatttactcctatattttgaacacgtaagaatgtgctatatagcatattctagttataacagggtagaaagataacacaataattctttcaacaaatacaatcctgttatgcacatgagcctggtacgaaagcagaaggcttctgccttacaaagagactcttgagtgcccactgtgggcagggccagggggttcagtgctctggtgcagctgagatgaaaggcagatgtcttgctcttagctgtgagttatgaggatgacagacgtggaaagaaccaggatgtgtatactgagggaggacttagtactattaaaactgtgaactgttcttcaagccttaccctcaggagaagcaaaacctcggaagacactcaaagagaagaaggaaaggagaactccttcagacggtgggccttttccctcaattctgttattttaggagcctgttgactaaggaatgttgcttacataattcatgaagtactgctttacatgctgttttccctctgacaaatgggtctgtctccatttacttttctaaagcctctgggctgggcgcggtggctcacacctgtaatcccagcgctttgggaggccgaggcgggcggatcatgaggtcaggagtttaagaccagcctggccaacatagtgaaaccccatttctactaaaaatacaaaaaattagcttggcatggtggtgggtgcctgttgtcccagctacttgggaggctgaggcaggagaatcacttgaacccgggaggcagagattgcagtgagccttgatcgcgccactgcattccagcccaggtgatggtgtgagactccatcccaaaaacaaacagaagccttggaaggcatgttttggggtgctgggaggatatgtgggtgtggagtaaaaattcctgtagagatttgatttattagattttacagcaatcatttcttgtcttcctagaattcttagaagtatagaaacttaggaatctctagcatttgttttcaataaaggatacaccaggcctttttctgcaaacagccatgtccattacattagacttgtccctgtgtcagtttgcagatccctttgtttattctgcccttccttcccccagattggttggggaatgggtcttgaatgtggcgtctgacccgaatgcttgcttcagagtaaagctagatccagggtgctggcctagagaatgaatactgtgtgccacagacgtggacagacttgagagtggaggcccagagagtcttttgagggtgtcagtggactgtgccaggggtttagtgtgaaattcatcagactgcctcacactttgttaaatagtgtcagataaactccatgccagtttggagacacagcagatgccaacccgggaatttgagttctggacccatctttaatactccctgcaaaacattgctttctgtttgctagatgaagaggataacttattcgcaccccccaagctgaccgacgaggacttctcgccatttggctctggaggtggcctgttcagtgggggcaaggggctctttgatgatgaggacgaggaggtgagtccatggcacccagcaacactccctgcagctagctgtgtcaggggtccacagggaagatataggctttgcttgtttagtgggggaaaaacagtttctcagttggaagttgcttctattttcatattttgggacattttgaactaagaatcacagagtgagaaatgccgtatccttctatgctttgttaggtgaggagaagatgtgcacgtgttaatgtgaataatttactaggtgattgtttcttgccttatctgttgtcttccacgtttgtttttaattcctggacaggcctaaattattttagggtctgattttgccatagttatcactttgcaactgattttctggcagagtagtaaatatgtagctttaaatcttgtaggttatttttccttaggaatcctcacatgcagctatgctttctcctggttttttgaattctttgtcatataccttatttcaaccagagtgacctcttcacggaagccccccaggatcggcaagctggagcctctgttaaggagggtaagctggggctgggcagctgcgtctccgtgtgcagagttccaaaactgtctttctcactaggagatggaacaaggttgttcccaagccttgtttctgtgttaagcaggaagctgttgtttttactgtggtccagttgaaagtaattcatcttcactaattcatgtcttggaaaaaacagtaccatctgtaaacccataccacagtcttgcctctttgttaggagagaactcatagaaagtcaaacaagaaaagtaccctagagcaatgttgaggatggttttcattgaatgaagtttaatttaaagaaacatttttaacattctgtatataagttggagaccagtaattccccaacccagtgtgcattaaaatcatctgtgcaggtttttttgtttttttgttttttgtttttgtatttttagtagagacagggtttcaccatgttggacggttggacaggctggtcttaaactcctatcctcaagtgatcacccgcctagacctggcaaaatgctaggaatacaggcatgagccactgcacctgtccccttggtgcagtttttaaaaaacacaaatataaatatgttttttaacctacaaatgttactccataggtttgtggtagttcttgggacttgggaattagtgattctaagtgccgagtctcccgggcacaggcatcagagctgggccttggaggccgctccttgtgcctgctgtgcgggctgctagcctggctctcctctgctttctgctgtccatgttttggcatcagtgacttgcttggtttccccctttgctcttatgtctttatttttttactgatgactcacatgtttttgcggttctttttcacccgttcattctcatccaactggaatgggtagaggtggaactgtttgggggagccctggtcatgctgtccctgcctctgctgtgctcacctcctcccttggtgtcccccagctgacccactgctgtggcttgatgacggtcagcatgctcttccattggagtcacagctcagattgtgttaatccccaaaaaaaagtcctgacatcggtagagaagaaaatactaaagaattttaaaatgacttgttcaggaaaaagtggtttcaaaaggtctgatactagctgtgttttacatcgcacgtatttcaggaagaaaatagcaaggaaagttatttcccttgtaaaatggttaccccttgctttctcattctagagtcttcatcatccaaacctggaaagaaaatcccagcaggagctgtttctgtatttttaggtaacataacttaggtttgttttctaaaaactacacaaatactgttttttgcatttcaaaattatcatcttctaaagtctggctggagatgaggaagtacctgggagcttcaaagggctttgagcatcttatagaaagagctcatttactgatattagctcttattctcctagagctcagtggccttggacttttttgtgtttgagctgacctggtgattctccgttgtgagatgttctgtagcagtaatggatggaggctattgggccctgttatgcattttgtggattaactgaaatggaaagtttttggtgggtgataatttttttctgtaaattcaaccggcccacactggctcacagctgtggctgtcttgtctttccacccacaggagacacggatgtgtttggtgctgcctccgttccatcaatgaaggagccacagaagcctgagcagcccactccaaggaaaagcccctatggtccccctcccactggcctctttgatgatgatgatggtgatgatgatgacgactttttctcggcaccccacagcaaaccttctaaaacaggtatgtgttcctgcctccgtttctaggacttcagccagaaaaagaacgttgcctaaaaagaacataagctcacctagttctgtatctcttacagtgccagaatcccttctccagcattcctgtcattgagttgttgtgtctgtacttacataggtgtggtgcctgggaggtctgttttatgatccaatcttttctgctctgtaagctaattactatgattattttccttatagagagctgaaatccttttctgtataatttttgcttgcaatttccagttctgacctttggtattgtaaagttttaatcatcctttcttccagccgaccttagtcaattacatgagcagcaggttgtgtgccggccatttatttcccagcttctcatttctctgccaaaaagctcaggtggccttggtctttcctcagatgatgttttcatccccttggccacttcggcattctcctctcttttcctcttaaatgtaagtcctatgtcctgaagtcattcccataaatcatttgtttttaaatgtgcagatgaatcttccaggggcttttgtcaaaatgaagattccgattcagtaggtccagggtggggcctgagaatttacatttccagcaagcttcatggtctgtagatcacacttcgaatagcaagacttagatccattgactgctcttccagaaaagaaaggtagatccctagatccctaaggtgcacatgattttcagcaactttaaaaaataaaaaaggatggcataggaatggatggaactagaatgcatttagaagccggctgtttggactcactctcttccagtgttaggtgtagaaagtaaggatggaagccgaagtgtgagggaaaacgatagcctagttaatctagaaagagtgcaaacggatgcagaatgcacacaggtctcagtgaagatgacaatgcacacaggtctcggtgaagatgacagtgaatgaaggtagtagtgctttttgtagctccacagggctcttacttagtggatatctttgagaactgatttagaatccctagtaaattgatgctgctttctttgacaactcctagtctcttcagacattcatgagtcagtgacctcatttcagcaacacatgccctattcggtacagcagtgcttatggtgatgaaaggttggaaaccacccaaatacttatcagtagagtaagctatggcccttctattcagtggactattctgtgacagttaaaaagaaaggggtctacgcttgttgacttgggaagattttgtaggtacattaagtggaaaacacaaatggtaagacattgttcaaattatcttcttatttatagccttatttataaataactagtgttaattcattagtacatcctttgggggaattagaagcatgtatgctgaactgttcccaatgttcatcttgtttgagtagactggtggaattatgaggggatttcattatttgcttttatctgcttttgtacagtttgattttttttaaaacaggagccaagccttcatttctcagattccttagatgattgacttggtggccctcttaaatgatctttcttcctctagatctctcttcaccttgtaagccagtccaagctactctaagtacaggaaatggctgcttggataagcatgtcagccacgtggataaactgtctgttctgtctttcaactgaactgctactatgcactttgaaaaattccaagggaagagtatagttccacttactatttctttataactaatcaagaaacaacataactttttatgtttattctttgggagggaagaattttttaatctgtgaattttgtgataggatgtttgacgttagtgtcattttatgccttggtattttttacaggcaaagtccaatccactgccgatatctttggtgacgaagaaggagatctgttcaaagaaaaagccgtagcatcgccagaagccactgtgagtcagacagatgaaaataaagcaagagcagaaaaaaaggtgagcaggagggaagacttaacgcaggagcattgatctgccgcattttaataattcatcctgaacccagagggaagtgctgttccctttcacgttcatattgaagaacttcaaacagaaagtggaaagaacattgcagtgaacacccaaataactgccacccagattgatcagttcttagggttttggcaaacactttatggatgtaaaccttgttacatatctatttttttcctgaactatttgcatgtaagttgtttgaactgtttgctgcatggaactgtttccatgtagtcattgtgacattctacccctaaatatttcattaagcctctcttgaaaagacttccatataagcgcaatgccattatcaacagctgtgagactaacagtaattctatagtagaatctaatatctagtctgtattagaattgctccagttgccccagaatgtctttgtaaaatcaccccaacaaatagaatacagatttaaaattatctcgcatatagttcatactgcaatttcctctcttgtccccaaaatgccatttacagcagtgatccccaacctttttggcattagggacataaggagagtgcaacctgcaatctagatccctcacatgcacagttcacaatagcgtttgccttcctgtgagaatctgatgctgccactgatctgacaggaggaggagcttaggcagtaatgcttgctgctcacctcacctcctgctgtgtggcccggcttctaacaggccatggactggtctgcagcccagggttggggacccctgctttatagtatttttttatgttttgattttttttttgttctaagaaactcaggatttggacagtgtgtctgcattgcatttggttgtcatgtctctttggtctccttaatctagagcaacacctcccacatctttttttttttaatatccagccacttgtattgtagaatgtgtctcgtgaatttgcttgattattttcctatgaatagattcagggtgagaagttttggcaagaatacaagcaggcagggttgtgcacttccagttggatcacctcccaagacacatcaggtccactgtctgcctcattcagacacgtttgtcacttggttgttagggtgcccaccacactgcttcattggaaaggtaccctgtcctcttttgccattgctaagttgatctctaaagcgatagttgaacacagtgtgaatacctgttctctcccagccttttactcagtgttttgaaaatccactgatgatcttttcttgactcagttaatctgttagcgggcacaaaccactatttttttaattctatatttcttattagttggcattcttctgaatgaagttctttctctccctctccttccccgatttttagtattgctttgggatcatgtattcattcttcagtgtagatgataatccattaccatcattcttcttcttttttttttttttttatgagacagggtcttgctctgttgcccagactggagtgtagtggtacaatcacagctcactgcagcctcaacctcctgggttcaagcgattctccagcctcagcctaccaagtagctgggactatatgcgtgcgccaccatgcccggctaattttttgtggagacgggttttgcccatgttggccaaaccatcattctttttgatgctcagattgacctgcatttggccagtgtgtgtgtccccagcagtctttaagcccttctgactgcttgacctttcactgctgtcctgtacagctggtccctcctctttctacagttttgtctctttgtgtcgtgtcctggctgtgaagccctgactttctcctgccgaccacctaaggcccagcattcagaacctgtcaggcccgtcaggcagcctgtctttccatgctgtctctcattgcatatgtcccatctgtgcacccattgacccagactgtgtgtcctgctccctgatacaccagatgtgtcctctgtttgtcttgctgttctcttaacagccccctcagcttgctgcctatcacagcagagactccgtgcgttttctcgattgattgagtaaaccctcttttctgggtatcttacgtgttaatgcttaatttttctttttctttttttcttccccacccccccccccacccccgacaaaggttaccttatcttccagcaaaaatctcaagccctcatcagaaacaaagactcaaaaaggcttattttcagatgaggaggactctgaggtatggaattcttttgcttagttgtgggtattagtctatggatatgacatagaaactatttttgaatcaggtttttctcaatagagttataagactttttgttaagtactccagttctttaaaaattatctctagaggccaggagtagtggttcatgcctgtaatcccagcactttggtaggccaaggcaggcggatacctgaggtcaggagttggagaccaggctggccaacatgatgaaacccagtctctattaaaaagacaaaaattagctgggtatggtggtgcgagcctgtaatcccagttactcagaaggctgagataggagattcacttgaacccgggaggcagaagttgcaatgaaccgagatcacaccattgcactccagtctgggcgacagagcgagacttcatctcaaaataaataaatgaataaaaaataatctcttgagagcacaggggctttagaaagcaatatgtttacaatacttttcactttgggttggactgtatttacatttcctgggatgaaaatcctctctctttaggatgctcagattttaaactgttcatgggctcatgatgtgatgaggagcttgcaccagagtggaggtcaccatgctacttcctttattcacattctcactaactagaccatgccttaacgctgtagcagatgggttctggcatagccatctgtcttgtcgagactgagaccactaacagcctctgggaccctggttcataggttgctttggtccctccaggcaccttagaaccacctctcagaatttcactgcttttcctgagtctctcaggcctaggtcgtcttagatccaattttaagttggccttttaggagatcatagaactgtatgagattgtaatgggaagtaataagccccttttacagaaaaatatgtggacatggcagaaacttacatgtatttcaagaaactgtgggctctagattaggctgtcatggttgggctttgcactcacagcaaggatgaacatggaaccctttggaagtagagtgattgcccttgatgtaaagaatacctttgaggctatcactgaaggcgagtgtacaaaacgtaggaattaaccaaagtccagttaagtcacaaccctgacccctgagaaacagcatgatggggcctccaccgtcttatgctcatggatcccatgtgtcacccacacctgcacctcagggtctttgcaccggcccctgccactctgaggaatgctgttcccagaatccagcttgcttcctcactcttcgatttctctgtgaggcctccctgatgaaatacacacagcaggaagcctgctagcacataccacgctgtgctcctgttcctctttcctatttcactgtttaccacagcacgtgttgccagggacagtgtatatttacttattcattgtctctacttcccactaaagtacgtgccatgagggcaggactttgtattccctatttgtatccctaacaccccgtccttaataccagtgcttggcatgttgtaagccatccagtaattgttgattagacaagaaaaccaaatgtgaacaatttcagtgacttacgagatgttctggttatttgttgctatgaaacaagtaactcaaaaacctagtggttcataacacccatagttttgttgtctcacagttcgagaggttgactgggcttagctaggccattgtcactgagggtctcttgtgtctgaaggtggctgggctgaggatcaccttattcatatgtctggtacctgggcactggggcccctgggacatctctcactagccctgtgtggctcccagcatgtagtcagggaagccggtcctcttacatgctggctcagggctgtaggggagagtcctcagagagagcccgatggaggccatgttgccttctttgttccagccttggaagtcaacggtgttccttttgcttcatttgttggccaagatggtcacaatggcccatccaggtttatggggagaggccataggctccccttcttgatggtgggagtgtaaatgtactctcagacttgtgtgaaaaccctaccaaaggctttgccccatgtgtgtcatcatagagcgaatgtttttattggatattgttcagattctaaggcaaggagaggtaaaactaaggcagtctaagtaagagttaaagctttggacccgaaggaatgcgtcctgactcctttctctatatctcaagtgtgaggctgaagcttgccctgtggtcattttgggggaacatatttgaggtaatggaagtgtcttttcttgcagtaccaagaaaggtatcagttaagggtccgaaactgtgatgttgacatttgtttttgttctttgctttggtttactttcattttcttagaacagcagaaccctttctcttgccattgtgtaacatgcaggagggacacgggatgcctggaattccccttgtggcctcttctatctaaataaacccatgggactccggggagcacaggggaaaaacactgtgtggaggagatctcacttagtgaactcattaggtctatatttaggagtagacagcgaccccataattaaaaaaaaaaaaaactgtccaaagaggtcttagaaatatcttcttgtcctatttaattgttcggctcttgtgtattgaagtttatcttcccaagggaatagatgtcccattttatgtttctacttcatgtaggtcaacttgcaggtctttctttgcaggataagctgatgttttataacattttgaaaatttcttgatttttatattttttagctattttgagatgaaattatactctttttgcctaggctggagtgcaatggtgggatcttggctcactgcaacctctgccttccgggttcaagcaattctcctgccacagcctcctgagtagctgagataacaggcacccaccaccacacctggctaatctggtatttttacaaaattaatataggctggtcttgaactcctgacctcaggtgatctgcctgccccagcctcccaaaatgctgggattatagacatgagccacagcaccgagctgaaagtttctttagaatctatcaggtcttatcctggtttgcaatgtcatatacctatagttaagctaagtagactagcaaacatttaaaaataaagtttaatttgtatttacttaaaagaaatatgtcggccgggtgtggtggctcaagcctgtaatcccagcacttgtggaagccgaggcgggcggatcacaaggtcaggagatcgagaccatcctggctaacatggtgaaaccccgtctctactaaaaatacaaaaaaattagccaggcgtggtggcaggcgcctgtagtctcagctactcaggaggcagaggcaggagaatggcgtgaatccgggaggcggagctttcagtgagccgagattgcaccactgcactgcagcctgggcaacagagcgagactccgcctcaaaaaaaagaaaaagaagtaagtcataatcttaggggaggagggtgttactaaataaaatagttgtagctccattaatttgggaatctagcccctgtttctttattgaccctgtctaatctttgattctttagacggtaatgggaagccatgcttatatatttatttttttagcatggtgtaggaaattgattcaaaaacttattcctgccttctgtcattcaggtgggaatacagaagcccctgggctctgcgaggccaccagatcctgtagctctcctcctccttagtgccactgcacacaccctgcacagaccctgaggcctatccctttaaggactctgtctgagccaccttccctctcaggaaagaagcctagacacatggcagctgtcatgtctgagtcacttgtgttttatactgacctgatattttaaaaactgatattcctgttaaccagcaactttaatttcaatccaacaggatttgttttcttctcaaagtgcgagtaagttaaaaggtgcgtctctgctgcctggcaagctccccacgttggtttccctgtttgatgatgaagatgaagaggtaaacattgttattgtaacactagataatttagattaggagaaaacggttgttgatgcaactttctacccagaggctcatatactagcaaaaggtggtagggaagcagtcaggccacctgaagtttatataacaaaaatatttctgtttttatttcagtgacttcttccttatattttcctagctgtgcaatggagaagacattagattcttgatgcagttcttttttttttttttttccgagttggagactttctctgtcacccaggctggagtgcagtgatgcgatcttggctcactgcaaccgggttcaggtgattctcctgcctcgacctcccaagtagctgggactacaggcgtgcaccaccactcccggctaatttttgtattgttaatagagacagggtttcaccatgttggccaggctagtttcgaactcctgatctcaggtgatccgcctgcctcggcctccctaagtgctaggattacaggtgtgagccaccatgcctggcttcttgacacagttcttatggagtgaaatctacaggttttatttttagaaatctgcctttgagaaatacaattgaccctttaacagtgtggaggttattttgacttccacattgcagtgaaaaatccatatataacttcttacttcccaaaaacttatctactgatagcttactgttaaccagaagcctcatggataacataaacaggtgattaacatataaatagtataatatctatttatatatttttgtattcctgacatatccagcttttccttattttttttatgatatttctaggccacatggtttgtctgcaagatttttcaaattgttgcaaatgtccaaaaaaattttcaacatattactgagaaaacatttgtgtagaagtggacctgtgcagctcaaacctgtgtcattcagggtcagctgtactttagtctagaggatggatcaacatatacccaatgacctacaagaatgttttggatcaagtggagatacaaaggagaaggcagccatgtcctgaccattgtctttctttcccatcctggctggagagagcacagtggggaagagaaataagagagaagacaacccaaaccttaactctcatgcagtactgggcggtggtgagctcaaaggctttgccatcagacccctgggttcatatcccagctccaccacttgcaaaccagggacctggggcaagtaacttaaccttccttaagcttatgtggcttaacagtgagtagggtcactgtggcagctgtaactactagtgtgaagctcttgcagagtgctggcacataataagtgcatagtgaatgtgagctctgtcattagcatccccaatggacaccagctcattattctcctggcctgtcctacattaccgcactctccttaaaggagacttcatccaggaagacactcccttcatccatcttcacattccagggctgttcacctgagtttgtccatcctaactcagattcaggccctctgatgcttttgttccccttatctgaataaaagcaccttaataaatataacttttggggagtgcttgaccacagaagaatttacaaatgccattaaacttagtacaccagcaattttatttagtaagctatttctccactttgtataatctctttgaaactaatgagaaacacaagtcatgccttccctccatcccaggtgtatgtctttctgacctgtaaaggagtggagacagacccccagttctctcctttcagccattgttctggtttctcattcgtggagacaacagtgtgagtttctggctgctgcgggggctcccgtgcccattgcaggctgtaaccccctgaaatgagcagagaggcacttgcccacagggtgactggatggggctcagtttctccttgtacttcatgatctcatttgcatgttgttctcctgcttatatgcagctgttctgccttcgagttctatggtaatctctttcccttctatgggtgcagtgagaaaaggctgtagtttgggatttactagcattttgcggtttttccccgccagagttgttatttgtatacctgactggagacttacttccttaaagtttgatataggaggacatcctatgttttctgattataaagttgtcttacctttctgccatttgcttttctaggataatctttttgggggtacagctgctaagaagcagacattgtgtctacaagctcagagagaagagaaagcaaaagcctccgagctctccaaaaagaaagcatctgccctgttgttcagcagtgatgaggaggtgagctgaggtttctgctaaagaagaggggattatttcatgggatttaagagttaaagccatcccaagtctttttctacctgttttatatctcgtgatgttcagtcaccaaaggcgatgttcacaagattgtcttttctgacggaagacatttaatgtaatatattaatttaaagatgaatctcttcaaaatggttaggaataggtatgactcccacacaatagtgtatgctccttcaaatgagttaggccggctaggggggaaatgatttctcagccatcgctagttcatggtcgagtcccttagaacaaatgacagattaaccagagaaaagtgtgcaagtttacgtaagataagttttaccagacacaggagccttcagaaagaaaaactcaagagaaacaggaaatcctgtgtcaattttatgcagtctgatgaagaagcggacagttttggggagcacgattagatgaaaggggtgtgacctgatgggaataagctggggggagctcagcaaggcctgtgtggtcagatcattctctgcatctttacaaataaggaggctcctttcctctgggaatagggaggactggaatgaaggttttatgacctactccagagagggttagaggattcttctatgtcctgcttcagaggagaagggccagggaaaggtcagagagacctttctgcttctgttttctcaaatgccaaggtgtcatattttgaggtagcatgtcccgtataccccaatggccatatatactagtatcttgttaaatgactactgtgtttcattaatttagaactatagttaggaggagttacctattgaggttaaactcctttttgagggagtcttaacaatatttctgtttgtgatctggatagatactaccaaatcagttagtttagttgctaactcaatcagatttagtagcagggaatcagatttagctgtgcagaaaaagactttaaatatgatgatataaaaaatcctgagtagtaaacatcttcctgtgttataataattcctctttttttttaacattgtaggcaagttaatagggggtgaagtggatatataagtcatagatatgttcatgttcttactgaaagcaatttaaaaattccgaagcagattgcaaaaaaaaatgtattaaaagcttatgcggccgggcgtggtggctcacgtctgtaatcccagcactttgagagtctgaggcaggcagatcacttgaggttgggagttcgagaccagcctaaccaacatggagaaaccttgtctctattaaaaatacaaaaaaattagcaggttgtggtggcgcatgcctgtaatcccaactactcaggaggctgaggcaggagaatcacttgaacccaggagatggaggttgtcgtgaaccgagatcacgccattgcactccagcctgggcaacgagcgaaactccgtctcaaaaaaaagcttatgcaacacacatgtgaacaagacacaatgaaaaactgctagtaatccttttactacaaaagtctgagtctggcctttagaaagcgtttaaggaattcccacccagctgtgctcatgccttcacatcaaggaactcccaagcatatataatttgtgttttctactcaaatgtatgaatttatgatagattatccagtttttttcttttaaacattgtcggtgattgttccccctgtagcaacagccagacatcagtgtagttgctcctactagagtattatagtggttcagggaaaataaaaacattacctaaagcttggagcaaaaagacatgcagaagaaagacagccaaggttctagaacaggggcgtccagtcttttggcttccctggcccacactggaagaagaagaattgtcttgggtcacacataaagtgcgctaatactaacaatagctgacgaactaaaaaaataaaaaggttcgtgcataaatcccataatgttttaagaaagtttacagatttgtggtgggccgcattcaaagccatactgggctgtgtgtggcccatgggccacaggttggacaagcttgtcctagaacaaaggctgtcaacttcggctgctcattgggatccatggggaacttaaaagagtgctgacaggccgggcacagtggctcacgcctgtaatcccagcactctgggaggccaaggaggtgggcagatcacctgagattaggagtttgagaccagcctggccaacatggcgaaactctgtctctactaaaaaatacaaaaattatctgggtgttgtggtgcttgcctgtaatcccagctactcaggaggctgaggcaagagaatcacttgaacccgggaggcagaggttgcagtgagccgagactgcgccactgcactccagcccgggccacagagcaagactctgtctcgaaaaaggaaaaaaaaaaaaaaaaaaaaaaagaagacctgacgagtgctgacagtggatcccagctccagagattctgaattaatctggttggggtacagcctcgtcattggagttttgtgatactctctagtggatttcagcgtttagtcactgctaaacattgaggagcacttctcaaaccttcatgtttaggaaatcacccaggcaccctgtgaaatgcaggttctgattcagaaaataggcgcggggcctgaaattctgcataatctgctgctggcttgtggactccagtttgatttgcaagactctagactccagagatagagcacttatgcaagtgcttgggagttctttgatttgaaggggtgtgagcatagtcgagtagaatttccttaaatgctttctaaaggccacattcagacttgtggtaaaaggattactagcagtttttcattgtgtcttgttcacatgtgtgctgcatgagtttttacacttttttttcaatctgctttaggatttttagaattaaaatattcttctctggagttggaagttcttgagttcttggtatttttacatttggcttccttcttatagcctctgtaattaatgttgattccctgaaatagacaagtcgcttgtcgtaatacagtgcagaaccacagtgggaagagacatcgtggcaggtgttggaggaggaaatcatgagaagctctgtgaggtcagagagcccagctgtctagatttgagttcaaagaaaagtcttaagcatgagctttcttcaagactgatgcactaagtttaatacttagtttaaatacaacttagtttaacaaatataagtttgattttactccccatgttttataatctaaattgccattggacttttttttctttttttgagacagagtctcgctctgtcccccaggctggagtgcagtggcacgatctccgttcactgcaagctctgcctcctgggttcactccattctcctgcctcagcctcccgagtagctgggactacaggctcccgccaccacgcccggctaattttcttgtatttttagtagagacggggtttcaccatgttagcaaggatggtcttgatctgctgatctcgtgattcacccgcctcggcctcccaaagtgctgggattataggtatgagccactgcgcctggcctggagttttaatatatattttatgttttaaggaccagtggaatattcctgcttcacagacccacttagcatctgacagcaggtctaaaggagaacccagggattctgggaccctccagagccaggaggccaaggctgtgaaaaagaccagtctctttgaggaagacgaagaagatgatctttttgccattgccaaggacaggtgagatagtcattggaaggagtccctcactccgttaccgtggtaacaagaaaaggaatctgatgcacaatctagttcatcgggtgattgctaatcatggatcacatagtgattgtgccagtgagaatgtctttgcttttcaatggcaccatcttttccctcagtacccggaaatgtttgtctttgtggatccttatctgatttcttccccaatcattattttttaaccatattctttttctttgtttgtcagggatttgagtatcttttgtttgtgatttttctctgggctactctaaagtatgtcaggtttggtcaggattacttaaaagttactttaggccaggcacgttggctcatgcctgtaatcccagcactttgggaggccgaggtgggcggatcacgatgtcaggagttcaagaccagcctggccaatatggtgaaaccctgtctctactaaaaaaatataaaaattagccgggtgtggtggcacgcgcctgtagtcccagctacttgggaggctgaggcagaagaatggcttgaacttgggaggtggaggttgcagtgagctgagatggcaccactgcactccagcctgggcaacggagcaagactccatctcaaaaaaaaaaaaaaaaaaaaaaaagttatttgaatagaaatctgctcagcatttaacacatcctgttaggaggaagttccctgtagagctgtgcagtatcactccaggggctgataacccatagccaacctaggtgcctctccccattaatgctggaactgaagctgctaggatattcagagtgagcgtgggctgtggttggtataacatgctgccagattagcttatgggttcagaattacttccctgcaaatactttttttccttttgaaagcctgacatgattactttgaaattcacctgaatgttattagcagaaagaagtaactgattggacatgtaaatcctatgctttggtgtggttaagcgtcatttgatagattcagaagtacgtcaggtttctgtctccaaatactcgaatcttgtcaagcatcaccatttctgcattaggcctctgtaacttgacactcggatgcatctttggtctctgatttagaatataggctctggaaacttgatattaaattctgattctgccagttcctgtctgaataaccttgggcaagttacctaacttccctgtgcctcaatttcctcatttgttaaacaaaaataaaaacagcatttctctcatcggtttgttgggatgatgaggtggaatctaaatgtgaaatgctgagcacaagagctggcacattctgagccctcaggtattgccagttagcatcgtgactgcagggaaatagtacattcctttatttttgttgctctctcctgggacattcttcttcctgtgttgcctggccaccttctttcaaaactaagtgtaagtcttgtttcataagaagccttcccggctgggcgcagtggctcacgcctgtaatcccagcacttggggaggccgaggcaggcagatcacgaggtcaggagttgaagaacagcctgaccaacatggtgaaaccccgtctctactaaaaatacaaaaatgagctgggcgtcatgtcacgcacctgtaatcccagctactcgggaggctgaggcaggagaattgcttgaacctgggaggcagaggttacagtgagccaagatctcaccactgcactccagcctgggcaacagagagagactccatctcaaaaaaaaaggcctttcctaactttaaacagacgagaaagagaagaagtagggagtcgagggcggtcatggctccaccttcataccccaacaccctcagctgagcattttctgcactgtatccaggttagcttattcccatgagtgtccactacccccaccccacacaaggtcataaatctggcagtctgaaccccatcttgtttgtgggtcctggttccagccacacaccatacctggctttcaggaatgctttctctgctccagatacatcctacctcctattgttcccgaagttgtctgtcaagttttgtgtatggaaagtaattcataccttcatcagatctcaaaagaagctttacacacacaagaagaagttgaggtgaggatgtggaggaattggaaccctcatacactgctggtgggaacgtaaaatggtgtagtcactttggaaagtagtttggcatttcctcaaaatgttaaacatagagtcaccatatgacataatagtttcattcctatgtatatacgtataaagagaaatgaaattagttgttcatataaaaacttgtacatgagtgtttattgcagccttagtcataacagccgaaagtgtaaacaacccaaatgtccatcaactgatgactggataaacaaaatgtataaccatacgatggactgttcttcagcaataaaaaagaataaagtagcgatgcatcctagaacatgaatgaacctagaaaattttatgttacttgaaagaagctggtcacagaaaaccacatattgtattgttccatttatatgaaatgtatagataaaccacagagacagaaagtagattagtggttgccagggcctgtggggcagggggaatggagagtgatggctcataggcatggcggttctttttggggtcatgataatgttgtgcacttaggttgtagtgatattgcacaactcgatgagtatattaaagaaaacattgaagtatgcactttaaaagagtgaatctggattaagaaaaccattgaagtacgcactttaaaagagtgaatctggccaggtgcaacggctcatgcctgtaatcctaactgattgggaggccaagtggaaggatctcttgaggccaggtgtttgagaccagcctgagcaacatagagcgacctcacctctccaaaaaagtaaaaaaattagccaggcatggtgacgtgtgcctgtagttgtagctacttgagaggctacttgagttcaggaatttgaggctgcagtgggatatgattgtgccattgctctccagcctgggcagtagagtgagaccctgtcttaaaaagtaaaataaatattaaaaataaagtaaatacaaggtgaattttatggaatgtaaattatgtctcaataacgctactaaaaaaaagaaatagaagccaggcacagggtcatttcccagtgctgatcctggccctgtgatctctcttggcaaccgtcttcatgacaattctggaaataggcctgtccgctttgattctttttgtgctataggaagtgggagagaatgttctgcttgggaaggctcaggcatcgtgtgccttgcagcggtaacagctgatgaacctgcactggatagtaacaggaaaggggcaacctgaggcaggagggacagaggctggtgatttgttggagtcagatttcatctatttcaaaggtctttcctgtttgctttcaactgtgtaaggtcaactaatggcttgggtgtttgggtggtaggtggattcctgtaggtgcagtctagaagaaatattgttgttatggtttttgtttttttcatcacacttttccttaatttgaccttttgtttgtttgtgtagccaaaagaagacccagagagtgtcactcctctttgaagacgatgttgatagcggaggctctctgtttggctctcctcccacatctgttcctcctgcaacaaaggtattcttcatctcttagtcccaggaaatgtccttgagtttatgctgcatcagtagtggtacttccccgaatcagctcttcatacctaaccttggaggctgagtcttatggaagaccttatttgcctggtttcagaaagagatcttctgattaatagtattctagagaagaagcacacgtgcaaaaccatcattcagtgtcaggtgtaggaacaaggaactgggtctcagaagaggcttgggccccattgtcatggaattctgctaacattagactaggccagttaaggcaaaatcattccttttatgagtgtgtgtcgagtactaacactggtcctggtttatattagccagtcagtaaaaaggaaggaaattctcacatgtgctacaaaatgcatgaaccttgaggccgttatactctatcagtggagaaatggtcacacaggtcctagtacagttagactgtggaatactatacagtggtaaaaaaaacccagggtggagcttattgggatgaaaaacatactgcaggccaaaaaaaaaaaaaagcgtaaacacgtaaacatggtgtaatttaaactttacaaaacaagaaatacacatgaatgcctggaaaccggcctgaaagcatcgatagcacattgttaccagtgattatgtccagggaaaggtatggaatggggaacttcatactctcaatgcctttttaaagcctttttaaggaaggcatttgtgcattactgtggaattagaaataaactccaaacaaaaaatatctaggagatatggaagaagacccttcctgttaaatggagttgctcagcttataccagaagctctcagccctgggccagcatgctgcccaccctgggccccaggctccctgctgctgcttctacggggctcctgagcctttccttgggtgctctgtacttacatctccccctttaaggacatccagtggttgtacaattaaaggagtcaggagatctgattggtttttctttgtaaattataaataaactactctggaggataactgagcaataaattaatgaattttggagcctctggagctgtaaaacttctttcaacctatggtaattatgattgttaaataaaacaaaaggtcaagacacacaacttaagtagctgaatagcctacacgtttttgattatttgtgaaatataatcatctttagacaatagtaaataaaagatatttcttgtttacagatatttcagtgtaagttaattgtgacttggttgtaagcctatgttgaccaaaaggttaaaccacaggcaggagaacttaaagaaatgtaatgtgagttttgttttgagccaagcttgagaactactagcccagtaaagagactccacacaaactgagaatgcgtcccagagtgggccacacgagacacagcatttatacatttctgttatatagaaaatgggaaaagggggcagtgaagcaacggtgactttcttaattcagattggtgctcggtgacattgaatataagataaagtaaatatgtggttaatgtattttcctcattagccttttaccctaatgagtacataggggtcgcagttgcagggtcaggagagggatggttgattttgtgctgcctttgtgcttcatccaataggcaggttgtaatcggtgcctgtcagtgtgatatttgacagactctggccttgcaggtgaggttcagctttcgttcataggcccggtttctattacccatatggccaagatgcagccattttagacaatttttttttcttcagactttccttattttctgacacctatcaagaaagtaaatttgaccaggcgtggtggctcacgcctgtaatcccaacactttgggaggctgaggtgggtggatcacctgaggtcaggagtttaggaccagcctggccaacatggtggaaccccatctctattaaaaatacaaaaattagccaggcatggtggtgcacgcctgtgatcccagctactagggaggctggggcaggagaatcgcttgaacctgagagatggattttgcagtgagctgaggttgtgccagtgcactccagcctgggcaacagagtgagactccatctcaaaaaaaaaaaaaagaaagaaaaaaacaggaagtaaacttcatgacaaggatgagcttgtcttcaagaagattaaaactggtactttgggtagcattttctgtggtttaaggaccttagttatatatgaaggaagaatatgatttgccatacttaagtctctttttgtctcccctatcaactatttgcattgaattattattatttttttttttttttgagacggagtcttgctctttcgtccaggctggagtgcagtggcgcatcttggctcactgcaagctccgcctcccgggttcacgccattctgcctcagcctccctagtagctgggactacaggcacccaccaccatgcccgactaattttttgtatttctttagtagagacggggtttcactttgttagccaggatggtctcgatctcctgatctcatgatccgcccaccttggcctcccaaagtgcttggattacaggtgtgagccaccgtgcccggcctgcactgaatttttatgtagttttcagtgagtccaggatgttccacaaaagccttttcctttgattacttcagtgttgccttatctcttctgaaattctttatgccttccagtgttcttttatgttaagttcaatggttttgcactttacttatctcttcctaactaaaaatccccttgctctcttctttcttcattcatcacattttaaaatcatgattagcaatgtccttccttagtttcccaaatctgccttcctaacttgatttaggcattgcctcaaagcacacttcctcgtgtcatatggtatgatttgtatctgtactatactataatagatctttagttttttctcaagcacttgttgataagtcacttgctgcaaaaatgccatgaattccaggaaagtcacaaacctcagtttcctagtccccaaatccctgcctccctgataaggaagagatgagaaatgggctgaagtgcttgcagacttgtattgaacactgagttggtataaaacactgggactgtccatgaaaatatagtgtatagtcctttcagatgaacagacaaacagatgtgtgctagctgttatataagttaggaagaaagtcaaggaagggtcaagtagagagataaatattatgcttattcaacaaagcaactgacacttaactgaagaggacagagaccgtgggtgacatctgcgtgggggccctgcttgaaggatggggaggatttgcacctacagacatcgagggcagcgtggcatggaagtttgaaagtttgcagcgaccttaaggaacagcagggaaaggaggagatgcatatgagtagagggatagaatggggtatctgctgagtgtcatttgcttcatgcaaggagtgctggtttgggttgggagaggacctgatccagcaggtgttttgttttagcaagacaacgctggataatgtcttctagttgaaatataagaggagtgaggcagagagagagactcataatcgtctggtggcagagataaggatctgagggagggaggcatgggggttgacagacacaagtagacagatacaggtgatgtggtggcgtgaagtgtcctgtccacaagtcccgggtggtggtgtttgttgcttctcccttttggtgctaccttcactatcctgtcctctcttccttgatcacatttagctgaagccctaagaggatggtttgggcttgttctgtatatggccatgctggtcagacacacttttttattgttgtggatgtcatgtactcttcttttggtagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggtggacttttttctcttgtatacttgaatgcatttgtctctcgtatgttgtttcaaacacacacaaccccttaagttttttgaccacagaaaataaatggcccatttgtagacagatttgaaaacatagacaagcaggctgtgtccccacagtgcaggaagcctctgcagggcctttcctcccggcccttctccaagacatgtgcgcactgtggtgtgcctgctcctgtctctgtggttactgtcacgtcatggcatctttgctttctaacttgttctcttctgtgcagtgttcctgttacccttggtcctcctttggtccccaagtgcacttgaatttaaatgtcagttttaaggagattttagtttagcatccttttacttttagatgatattggcaaggattacagagtagagtgaaatttctactctttctaaaacactagctttcaagtcctggacggtctgccgtctcttgcaggaggcctgtgggtagttctgctggccacacctgggcatccagctttgtggttgccttcagtctctatatgcctcttttctttctctaacttttcttatacgctgtgtgtccagctgcttaggtctaagatctcccagggcctgtgtgaagagcgttgcatttgcatttgctgctgaggctccttggagctacagtgatacaagcatttcatttgtacctgtgttcctgtgtgaaattctcttcctagtggctgtgtgtggaccccagtcctatcccagtcctggtccacacttgactctgactggttgctgtactgccctctccctgagtgtaagccccttgcggactaggcccagtttgttttgctcaccatcatatctgtagtactggcatattaccttgcacacagtaggcactatgttataaactttgtatttctttaaagaagcatttttttaatagtttgagtactctgaaatcgggatgtacctcataatcaatggtatcttacctgaaatgtgccatttgttgaatgaataaatactgcattttagaattatttcagagattcttcttcaattgcctatacagtgtaagccttttacaatttgagggtctgattttcctgattagatttcccccttggggcttatgtattagttaaatgctacgaattcatggtccactcccaatgattggcacttgtattggttatctttgacacttagaagttcttcctagttcatgagcaaccagtgtgcatcaggattatagccatcctatcacttgataggagagagggacccatggtcttaatgcttggaaaagttatctttggctacggatgattgtacaagactgtctcttggagcagccaatcaagaattgacctcagtgttttgttacttgggcacagatgtgattcactgtgccctgagtcatgcaaatgtggcagttactgaattaacgagaagcttggcaggctccatgataggatttgtatttccaggtgttacttattttttccccctattattttcattttcaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaaggtaagcaaaaagcaatagtggttcaagtctctggatgagataaaagactctcatctcatggttgtcattctgtcatgtgagtttctgaaggaatcttaaccttcaatgtagtgtgttaatgattctgtgcagtcatttagatatttgggaatcttaatcaggaactcttacctcaagtagcagtgttaggataggggattagaatttcaccccccctcttctgggatttacagaccttgttgttccttctagcaaaactttgccccttggccagttgtgggatgtaaacagcaggaaagggaagttaggctggagttgtacagttaagtatttctaacattcagtttaagaaaaagtgttgtagatgaacctttcatactgatcaggtgtcagcaaactatttctataaaggaccatataatgactattctagcttttgcagcctatttgggctctgtcataactgcctagctctgccattggcagcatgaaaacagccctaggaaacatgaagatggatgggcatgactgtgttccagtaagttttattaataaaaataggtgatggtcagctgggcatggtggctcacacctgtaatcccagcactttaggaggccaaggtgggtggatcacaaggtcaagagatcgagaccatcctggccaacataatgaaaccctgtttctactaaaaatacaaaaaatagcttggcgtgatgacgcttgcctgtaatcccagctacttgggaggctgaggcagaagaattgcttgaaccaggaagtcagaggttgtagtgagccgagatcgcaccactgcactccagtgtggcaacagaacgagactccatctcaaaaaaaaaaaaaaaaaaaaatagatgatggtcattctgtgaggttagtatgaccctgatattaaaactagacagtgacatcaccagaaagctagatatcctttatgaatgtagaggccaaaatcctcaacaaaaatactactaaacccaattcagcaaaatataaaaaggattgcacattatgagaagtgagatttacccctggaatgcaaggttggttcaacatctaaaattagttgatataatgcactgtatcaataaaatacagaattaaaaggcgcatgatcatctcaacagatgcagaaaaagcttttaataaaatccaaaccttttcatggtaaagcactcaattaggcataggaggaagcttaatgaacttgataaaggacatctatgaaatccctcagctgacatcatacttaatggtgaaagactgcatgcttttcaaccctaacatcatgaacaacacaacaatgtccactcttggtaattctaatcaaccttgtactggggattctaagcaggccatgtaggtgagaaaatgaaataaaaggcattcagattggaaaggaaaaagtgaaatgaagcaatctgtatttgcagatggcatgatcttttatatagaaagtcttaaggaatctgcaaaaaacatccattggaaataattaaagtcattaagattgaaggatgtaagatcaatatgtgaaaaccaattgtagttctgtaagctagtaatgaacatttactaacttacaaaagttactactagtaactttctttttttttttttttgcaatggagtttcactcttgtcccccaggctggattgaaatggcacaatcttggctcactgcaacctttgcctcctgggttcaagcgattctcctgcctcagcctcctgagtagctgggattataggcacccaccaccatgcccagctaatttttgtatttttagtagagacagggtttcaccgtgttggccacgctgaccttgaactcttgacctcaggtgatccacctgccttagcctcccgaagtgctgggattacaggcatgagccactgcacccaacctactagtagtaactttcataagcaattaccagcttatgaatgaaattaagaaatcagtttcttttatagtaataccaagaagggtaaaatacttaggagtaaatttagcaaaagaagtacaagacttgtaaactaaaatctacaaaacattgaaagaaattaaagacctaaaattgatggaaagacatctcgtgtttatggaccagaaaccttaatattggtaaggtggcaatacttccttcccaaattgatttattgtaatctctatcagaattccagcttgctttttgcagaaatggacaagctgatcctaaaatttttatggaactgtaagagaccaagaatagccaacagtcttgaaaaggaagaacaaagttagaagactcacacttcctgatttcaaaacttactttaagacaggatggtattggcataaggttaaaatatatagatcagtgaagtagaattgagagtctagaaataaaccctcacatttacagtcagttgcttaaggtgccaagatatttcagtggggacagaatagtcttcagcagatgtgccaggatgctgattatctacatgcaaagggatgaagttggacccattaataaataaactcagatccaatgtaagatccaaatgtaagaactaaaactgtacaactcctagaatctagagagtatgtgagtaaattatcatgaccttggattaggcaaagccttcttagataagacaccaaaagcacaagtgacaaaaatagctaaattggactttatttaaatgaaaaacattgtgcttcaaagggcaccatctggaaagtcaaacgaccacccacaaaatgggagaaaagatttacagatcatgtatttgataaaggactcagatccagaatatgtaaaagacttataagtcaataataaaaagacaaatagcccagttgaaagaagggataggccaggcgtcgtggctcatgcctgtaatcccagcactttgggagaccaggacgggaggattgctttaggctgggagttcaagaccagcctgggcaacatagcaagatcctgtctctacaaaaaattttaaaaattagccaggcctggttgcgtgctcctatagttctatctccttgggaagttgaggcagaagagtcctttgagcccaggagttcaaggctgtagtgggctatgatcacaccattgcactcaggctgagtgacagaacgagaccctgtctgaaaaaaaataggtaagacagacatctgaatagagattttactgaagaagatagacaaatggccaaaaaggatatagaaagatgctcagcatcagggaagccaaaaccacagtgacataccacttcatacccgggaagaggaccataataaaaaaaaaaaaaaagggaagtaacgagtgttggtaaggatgtggataaatggaaattctcattccttgctgctgcaagtgtggaacagtacaaccactttggagaacagtttgctgttcttcaaattcttataacataaagctaccacacaatccggaattttattcctgggtacatatccaagagaaataaaaacatgttcacacaaaacttgaatatgattgctcccagcagcattattcgtaatagccaaaagatggaaacaatggctaaacataatatagtatatccatacaatggaatattatttggtaataaaaaaggcaaagtactgatacatgctgccacatggatgaaccttgaaaacattctaaataaaataagccagtcatgaaagaccacatattatgtgattccatttatatgaaatgtccagaataggcatatcaatggagacagaaagtagattagtagttactgggggctgggagtagcagtgagcaggaatggataattactgctaatggtttggggtttcttttgggagtgatgagaatattctaaacttagattgtggtagtggatacacagatctgaatataccaaaaaatcattacattttatacgtaaatgggtagattttatggtatatgaatttgatctcaatggtgatgttatgcaaaccaggttggcaggtcatagattgccaatcctttttatagatctaaccaaagaaatagtctatgtttatttctacaaaaaatgttatatgaatttttttgttataccaatactataagcttatttataaatgagagctgcacacagtgaatatgattaatttgatatattttctcccagtctcttactgtgtatggttttgtaatatttttccatagttgtgaaatatttaacattacttgctgtgttaaactcatttttatatataacaataataattattgttaatgtgatttattttgttagaagtaagtttttcattagtttttttggtttttttgttttgttttgttttgttttgttttgagatggagtcctactgtgttgcccaggctggagtgcagtggcgtgatctcggcccactgcagcctctgcctcccaggttcaaggattctcccacctcagcctcccaagtagctggaaccacaggcacacgccaccacacccggctgatctttgtatttttagtagaggtggggtttcaccacattggccaggctggtctcgaactcctggcctctggtaatccacccaccttggcctcccaaagtgctgggattacaggcatgagccaccacgcctggcctttttgttaagttttaatctgtggctgtgataaggaaatagggatgaattttagaatgtcaggtctggagcattgtattatcaaaccaataatgttgatggtaacttttaaatgttagatatctagtaaacaaaaagggactcactcggagtctgaaagtagggcagaagtgatggacagccataggaaggcttgtggtcgcacctgtgccaggtctttggcctgcagtgcttacaggtgagggacacatacttgaccactctgtgtagtttgtgcttgattcagctgctgtctcttcttccctttggaaatgagatgaagagaattcattcagttttatgttttttaccttcaaaatgtttctcattatggaactaatggattgcttttctaataaaaaatttagatactatacaaagtttatataatatatataacctggaaagattatctctaaagcttgtgcatatatatatatgtaaactttgtatttataaatatattttctggtatttttggaagcgccatagcattccattttgtcaatgtttcattcccctactgagtggcttttaggctgtggccagccttttgctaatataatacagctgcaggggacatctttgttgtgtccatctttacatatgtaacttccttgagataagttcttacagctctaatcacacatgaccttccctcctgttcccagggccgcgatcctgatgcccaccccaagagcacaggtgtcttccaggatgaagagctgcttttcagccacaagctccaaaaggacaatgacccagatgttgacctttttgctggcaccaaaaaaaccaaggtcagttccaaatggttccccacagtatgacttgttattgtattgggtgctgtctcaacagctcacctagttctctttgtaaattgttttgcttttggatattgaacttgggtcttgtttattctagctgttagagccaagtgttgggagcctgtttggggatgatgaagatgatgatcttttcagctctgccaagtcccagcctttggtaccagccttttgttctcaatactgggttgtgtgggaaagattctgggaaaggaaactaacgtccagttagatcattaaggaaaatcctaggagagtcgtgctgcttcctactaaatgaatggcaaataacatgctgaggggagcgtgtgtggaggatgcaatgcttagtttctgttgttcctcattttatgttccctatactaacattaaaacattaataatccaggctctctgactgtactgcacatctgtgtgatgtttaaatggttgattgaaagaccattgcatacactggggtgactaaatattcgtgcctttcaggtgcaaagttttgagtctgagttttagcctttctatgtcattttctcccccagccccagtaggtttttgtaagtactctgttttctttttatcatagagaggactcctgtgacagccacagtcttcagaatgctatttctgaaatgctacctttgagttggttcagccctcatttgagaaagtatttttaagactcagaagccaggattgttttttgcattatgatttttccttaaaatttctaagatatttgatggctttttggtattttttttcttttgaaggtacaagagaaaaagagagtagtgaaaaaagaccactctgttgactctttcaaaaaccagaaacatcctgaatccattcaaggtagtaaagaaaaaggcatatggaagccggaaacacctcaggttagaaatcctctttaaggattttcagctcttgtttgcatcccagtacagagaaattccattatgcagacccacagttattcagacttgtctgcattaaggaggaaacagcaaccagggctaccgctttgtcttcactgcactccccccaagtcatctcccctctcctcgctccacacgccagagtttcatgaatctatactttaatagttagtgttttttgatgccatgccagatttaactctgaagtggagttaaggtaggatgaagaatcttcttcccactaaagaatttatttctccctctggatttccttggaatagaattaaaatagaaataaatataaattacatctgatttcctgcctgctctcagtgttgcctctcccaaggtcattgctgttgggccgtactctgcagcagtcttcccagaacgctgtggagctcctcctgggaacagcccaggactggagagcgagtgccagttccacgtgcaggtgtcccagggtgtctcactgaagccttagtgtcctgagccgtaaacctgaggcacttggacgaacacatcaccactgacccttcctggggctcagatcttttgcttttagagccagtgcattaggctatggttgaatttttgtgtgctccttgaaatttctatttgataaccaacatggtaattttgcctgctggtcagttttaggtgctctgataaactgtgactcttgggaatcttactcatcttgtattccttgactccatatctgatctggcagctttccacttacgtgacagaggaggaggcatacgtgaagtagtgctagtgaaacatcaggccccaggagagatttgaatgcctttcccattaaagagctacagaaagtgacagttttgctccatcacagatttatttacaggcataagaaacacttgtctttctgtttcccaaatggatttttaactggatgtaattttacacaggactcatcaggtctcgctccatttaaaaccaaagaaccatccactcggatcgggaagatacaagtaattaaaacactggaatcttcattgcctgccctgtggcatctataaacttttttgggtttcctacttttgtcagctgctgccaagcatcttctcatctcttcccccgcctcccctcccctgcacctagttgttgtctcctgtgtgctgcgtctttaacatctattttttgagcccagtggtgggcataggtgtaagacgctctgttttaattctgagactagatcgggcgattttcctacgtttctctactcctctcgtattatacattatgtgcaccgaatcttgtcatgtgtcacaataaagataatagactgctgtgttgaagaacaaatacagagtttcatttttcttctttaggcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaaggtgatgaaaccatctttgcttccttgctctcttcttttaaccagaacatgcatatgcttctttctagtttatcagttgcatacacagcagtctttgactctccttttgaaggaggtgcctcatccttccttcagccactccccactccattctccccacccccctcatcctgcacctgcttttccgtggcctgcatttggtacatttgcattctgctcagtagccacagtaacgtctcaccactttggctggtgtctgacacctgcaggtttccagcactgccacctgggggtcttctaaccacagagcagatcatgcccctcctgctggcgcttcctcactactccaaggagagcattcgggctcctgggtttggtatgaaacccctttgcaatcggtgccagcccatgtgtgcagcttcctcactagtcacttcacactttccagcctgactccaggcacaccaggtgccactccctgaacacacatggtctgttctgctgctgcccaaggctcctgctgcctcctcaccaggaatgctcctctctgtccacagctgtgcttccacatccccacttctgtgactgtgccctgcactccccgcaccaagttcccacagcagcgacactgtttcatgggatctcctcaatggactgtgaaccctttgaagttttcctttcattgtagttgggtttcttgtttctatccagtctcccttctctagaaagctttagctgatttccaagtaagcgacaggacacagaatgacctaccccggcaaatagattcatttcaaatgtttccaaacctgtttccttgtgcaaaacaaaaccgccttccttttaaagagaattttcattggcttttttttagttaagtttaaattggcaactaaaattgtgacattcccctgaagttgacaacacaatcatactttgcccaaagtagattgtagcttctcaaaattctacttgattgtatattttggaaactatcataaatactgcatcattgctactaagtgattcatgttttgagattatatgaaaagttctgatttctaagccatatttcttatgtggaatatttaacgtttgaattcaatgtttattgacttgaagaaaacagcaccttagattacctctctttattgtgtcatgtttctccccgctcctggagcctgaatttagactagccccctaacaaaggttagtaccagaattccccgattctttcttgttttgaaagatacccacgtttctattgagggtagagtaggggccaagggaggggttgtgagacagagagccaacatacctactttccaggtttccagcaacagataaaactttttgtgtgaaactgaactgaaactgccctgagaagattaaaaaatggagaactctaaaggattaagaatgacttagtcttggagtactaggagctattaaactccttccttggaaatcattaagaaataacctcttctatgttcttagataatatcttcattgaagtagaccagataaccttacaatattttgagtcactgattctttgccatggtagctttgaacactttattttatcgtcagatcaatgtgtgtttttttgccattgcagagccgtgtcaagatgagagggaagcgtagaccgcagacccgtgcagctaggcggctggctgctcaggagtccagcgagactgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacagaagcccctttgcaaagtctctgggtcattccagaggggaggctgacctttttgattctggggacatcttttccacgggcactggatctcagtctgtggagagaacaaaacccaaggcaaagatagcagagaatcctgccaacccaccagtgggtggtaaagcaaagagccccatgtttcctgctctaggtgaggccagcagtgatgatgatctctttcagtctgctaaaccaaaaccagcaaagaaaacaaatccctttcctctcctggaagatgaggatgacctctttacagatcagaaagtcaagaagaatgagacaaaatccaatagtcagcaggatgtcatattaacaacacaagatatttttgaggtaataggacttaacacgtttttgtgtctgttctaagttaaggaaggtatctgattggcttatttgagccatagattatgtctagcttgttgcgtgcataccccatagccacttgcttagtaattataattaggctcttttattaataagtttaacattgattcagaagtggttttttgttttgttgcatgtagattgtatttcttggctggccatgatcattgatactggtcttggtttctctagtttttacagtttttttatttttatagaatattgtaatcagcttcctgggcatgccactcggtgacatggcatacagctccactggtccagcttgggagtttaacctctggttctggggacattggccctggctggagctgacaatgtagtgcatgcaggcaataagactttcagtggcatttgctcagcagatgtttattgagcacctggggactgcaggcacgaggtgaactcagagaagtgctaggctcctcagagctctctgggaagataatcaaatacaaacagggcaatggataattaagatgttttcaaatagtactaagtgtcatgaagaaaataacctggggcagagtggtgggtagggctgggaggtgctcctttaggcaggactggtagagaaggtgtcactgcagtgccggcatttgagccggggtgagatgggcgggccaagctgtgcagagatctggggtagtgcatcccaggcagagtgggcagtctcgaggctgttccacacaccctggccaattgtatttccatagctcgttgttgtgtttgagcttaaaaagaaaaattgatttaacattattttgtatgtatttttggcttaacaaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatgggtaagtttggttttctacatctgacctagagaattcttacctttctgtcacttggtatttttcttgctaccttttcttggcccttttctggaaaatgcaccccagcgggttcacttcagtgtaatcctgagttaggctgaagataggtaagagatggactaattattttagtgaagtaactctttcctatgatagtcatcaaagaatttgaaggcacccagagtttgacgtttaagtataatttaactttgatctcagtgcacctcaccaatcatctgtgacacaccccggtgttatgaaaggaggtttgatcagaaatgacctcacgtgctaaagtaggctgaggggactgccttgggtgtgatgtggttggttgagtcagagctccagatagacagggagtgtccatggttctgtgcgagaagagagcaagtctagacctgggtgtaggctctacctcaggcgttgcatttcactgaggtctttggtgtttgggaacaagcttgtcttccttatatggcacaacttctgctttattagtagacaaggcaaatgcccgagaaccctaaatattggacttttgataaatcctgtgggctgaggccacatacacatttcctactctccccatcaatctagaccttgagactaactgggagacagctggtgctgcagagtcacacactggctctgtgcctccagcaagccgtgtgctctgtctcccctgcttcccgccacatggagtgcagaagggaactcattcattattttaaatacaaaaaaagtaatacatgcttattgtaatagattcatgcaattcagaaaatgtaagaagtgaataacccctagaggtaatagtaacagtttggtgtgtatcctttcagacacagtgatattaatatatgtttgtgtacacatcaatatatacccacctttttaaaaagtaagaatatatttacctattctgctctgtcttttagttacttaatgtcttttcatgtcagtacatagagatctccttccttgttttcagtggtgtgcacgatttctttgtatttagccattagcctgttgacggcaatctcagttgtttctgttttctttattacaaataatgctgtggtctttaccatttgtgtacacctaactttatgtatacatgttaaatcatggttggataaaaccctagcagtaacattactgggtaagtaccataattagataagacaagcttttgagtcagtgaaacactaaaagaatgcagtgacggaggcttacagtcttacatcgagatgcctcaaatcagtgcatttattctgaaagaaaacaggtgggtcctatgttggatttccctttgcgtatttttattgctcttttaaaacccagtatgaaaagaatatctaaataagtccattgtccctgatggtaggggcgtgggctggtttggagatcaagttacgcttcccttttttctgtcctacacacgcacatacatacacttttgtagctgaagaaattgtgctccaagagaaacctgtgtgtgatcataaaatttaatgagtaacaaacacagaaccagaatctaagaggcttgagttctaggttagtgttttagggtactccatgctgttaccagagctgggtctttggtggtttgcttgcatgtgtcttaaaagtacctttctccacccctcttcagcaaccgttcttcttttttctttctaaagatgacatcttctcctctggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatgttgtatatgctgatggtcttaactggattacaaaaagcaaatactagaacagctagctcatcgttcacccaatgtacttggtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatcccagagatagcaaatgccacctgaccagaagtctttgttatatggatgggaaccctaacttagggcctgggcaggggaaagagaaagaaggtgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaaccac

SEQ ID NO: 38059 - DNA, 65743 bp, Homo sapiens
gtcacgccccgggcagcttggctggggctaggcttccggggctctgcggtcctcggcctgtgctggcagcctcggagcccaccgagccgggcggctgggatggtgagggcggcgggccggagaggggccggcctgggctggggccgccgtccctgccgccctcaggctcagcctctcttctcgtttttttcgctgcagatgaaccggacgacccccgaccaggagctggtgccggcgtcggagcccgtgtgggagcggccgtggtcggtggaggagatccgcaggagcagccagagctggtcgctggcggccgacgcgggcgtgagaggcgggccccggggacgcgagagcggcaggggtgacgcttggcttgcgcgcaggagggccggaccgcgactgcccctgcacctggcccgtcccgttgcctgccctcttaggaacacacgccccgtttagcccccgagaatgccaccctggcagtccccggccaccagggagaggggcagaccctgaccgtggcccagacgcgacgttcccttcatggggtttctggctcagctccatccggaggggagatccgtttccgccacactgagggattgctcgggcactagggaggcgattcctgttgggacctggactaaatggggtgggaaacaagccagtatgtggatatcctttaatgggattcttcaaatcgggggcccaaaaagctcagaactgttcgagtcccaaatgaataggatttttgaataagagtggtggttgattagctaacccttggtctgtgatctctgtagattgacaaccaaagaggacttttaaaaggagacagggttttgccctgtcgcccaggctggagtgcaagtggctcgatcttggctcactgaatcctctggggttcaggtgatcctctcacctcagcgtcctgagtagctgggactataggcgtccaccacacctgtctgatttgtttatttatttaattttagtagagatgggggtcttgctatgttgcccagactggtctgcaactcctggactctagcgataaccctgcctcagcctcccaaagtgttggattacaagcgtgagccaccatacccagtgccaaaaagggattttaaatttttccagaaacgagataggtgtccattagctcactgccactcttttgatgagctttcttagtgttttccaatgtcacttggttttagtacttgtcaaaccagcattccggccgggcacagtggctcacacctgtaatcctagcactttgggaggccgaggtgggcgaatcacgaggtcaggagttcgagaccagcctggccaacatggtgaaaccccgtctctactaaaaatacacaaaattagttgggcgttgtggcgggcacctgtaattccagctactcgggaggctgaggcaggagaatcgcttgaacgcgggaggtgcagtgagccgagatggcgccactgtactccagcccaggcaacagagtgaaactctctctcaaaaaaaaaaaaaagcatttctttcacattctaacactcaaaggtgaaaggaaatgggttcttttttgatgtgacatgcagaatagttacatgtaacattgatactactgtatgtttattttttaaaatagctactacagtttctacaggaattctcacagcaaactatctctaggacccatgaaatcaagaaacaagtggacggactaatccgggaaaccaaagccacagattgtcgcctgcataatgtcttcaatgacttccttatgctctctaatacccagttcatagagaatgtgagttatttagttatattataattccttttttgggagtaggagatattgtaattttaaataacttactgttaggttccctcctaaattttggtggaagtgtggttcttggtaattgtagcttttttctctgggattaacgcctcttttttatttgtaaagttttaagtccttttttccaagcctctaaaaaagtctaatgataaaattttcttatacttcagtgcttccatcttttgtcgttttgagagtagtcagcaattgtgctgaattgtgtggcactcacactgcctttgttgtggcgtgatctgtaaggacagctgtttacctggttagaccctctggacaccagcatatggtttcagttgttgattggggtcattctgttctgataaattatattcaggggatatatatgtctgcttgcaatattctcaactaaagtttatgatggccgaacttacaatatggaatcaactgtaaacagattactgagcttaaatctatgtgtgatttctgtctatttactgtttcttctaggtggtaggaatacataggtaaattagatagagcctctcccttggcaaatagtataattccagcatacaaaggaagtaagtatggctggagcagagtggagacttaagagatgaggatggagaggaagcttaggtaacagacctgtgtttctcatagggtgtcccaactttctgaatatcagcattcatttgtggaaaaaggattattaaagtaagcgatctcccgagattgttagatataaagtaataaaattttcagaatcacaaaattattaaaaaagcccaagatttagaatagttaagagaatgccatgtagtcaacttgtgcagcatgtttgtgcattttttaatagctcaagttaaatgccacttcctgtctttttttggagagctatatataaaataaagacattaataaaggtgttagagatctctttgccagttatttcctttaacagcaaaggagtacttatgagtttgaaaaataacaagtattcggccaggcgtggtggctcatgcctgtaatcccagcactttgggaggccaagacgggtggatcacctgaggttgggagttcgagaccagcctgaccaacatggagaaaccccgtctctactaaaaaaatacaaaattagccgggcatggtggcgcatgcctgtaatcccagctacttgggaaggctgaggcaggagaatcgcttgaacctgggaggcggaggttgcggtgagccgagatcctgccattgtactccagcctgggcaataagagcgaaactccgtctcaaaaaaaaaaaaaagtattcaagtaaaatcagtagttttctgattgtttacacagaatgtccatgcttggtcctgactatctcactggaaaagtcagggactctagactcaacttctctggtgtgcacagccccataatgttttcatcaagattaatttggtgtccttttaagcactcctgttcttttcattctgtacttttcttgctggatcaggtagtcagcacttctctgcagtcagtgctgcagcaccagagtcccaaaggatttgggaagtttctttttttttttgagatggagtctcactctgtcacccaggctggagtgcagtggtgcgatctccgctcactgcaagctccgcctcccgggttcacgccattctcctgcctcaaccttccaagtagctgggactacaggcgcgtgccaccacgcctggctaattttttgtatttttagaagagacggggtttcaccgagttagccaggatgatctcgatctcctgacctcgtgatccgcccacctcgacctcccaaagtgctgggattacaggcctgagccacggcgcccggcaagggaagtttactttgtacccagtgtgcctgtaccagattggtactagattggtaccagatcaatacttcagtgggaagaaatggggaacatcatacaatttttctcaatcacagtcttaggtcttatcttttctccagctcttttctagccaagttttcgtagattctgagttttccatgttgtagtttttgtggagtttttttggttttgttttattgtgttttggtaattgttctttatttctgtccaatactggggatttcctgttttccatccatctctccatccctttagccttagcttttttttttttcttccgagacagagtcttgctctgtcatccaggctggagtgcagtgacaccatctcggctcactgcaacatccgcctcccgtgttcaagcaattctcctgcccacacctcccatgtagttgggattacaggctcccgccaccaggcctggctaattttttttctatttttagtagagatggggtttcaccatgttggtgagtctgcttttgaacttctgacctcaagcgatctgcccattgcaacctccgcctcccgggttcaagcagttatcctacttcagcctcccaaagtgctaggattacaggcgcgagccactgcgctcggcccttagtgttaagtcttgatgccccttcgccttccagtctgcagccagaactcttctccggatgtgctggttgccgctgccaaatcttaattacttcccagaccttccataaggccacatgctataggtttttttcatttgtggcaaagcatgataatactgagaaaacagctaatgcataataaaactctgaaaaaatatacttgctgatatatatttgtaagtgatctggctttttttttttttttttttgagacggagtctcactctgtcgcccaggctggagtgcagtggtgcaatctcagcccactgcaagctctacctcccgggttcatgccattctcctgcctcagcctcctgagtagctgggatgacaggcacccgccaccacacctggctaattttttttgcatttttagtagagatggggtttcaccgtgttagccaggatggtctcgatctcctgacctcatgatccacccgccttggcctcccaaagtgctgggattacaggtgtgagccaccatacccggcaatctggctttttaatgttttattttcaatccctgacatcagtacttaggtgttacaattccagcttgaattatggtgccatttggtttcatggtaatttatcagaaacattcaaagtcagataggtttctgggttttattaattagcctcaggggcagccacaaagttgcaaactatattataaagttagtgaaacaatccgtactttctagggcgagaacagtcaggactttttagggcaagagaaattagtaccattagtaaaggctcaagaggggacttggagggagaagaaatactaattaacattggccagtgttctagtgtctaattagaaggcaacacaattctaaaggcttaattatctgttaatttaggaattggatcctgaaatagcaagtgccatagttaatgactttagtttgttaaatgaactggtgagggaggattttttctttttaaagtcaattgtttcaaaatcttagctttgtaaaattaaaaaaaaaattccagaatgaaacaaattaacctgtttatgcccaaggttagaattttttttgtgaaaagccagaccttggcaatgaccttgagcagtaggatatacataattctgacaagcttagtgttccaataatgggacactaggcataaatgggttaattttccagatcatcttcctgttgatttataaaagctgaattttggtcatttttccctccttttctacttttctattgaagaaacagatggagttgctgaaactgtcaagtactcagcaattagagagaaggaggtaaagcccaaaagccttattaacatataatttcctgcacaggtttttccctctccccctagacctgctttattttacataatgccccttgcttttgacactccagccttctcattccttggagatgccatatgccctgctgctacggggcctttgcttacattgcttcctatgcctctaccctttgattgacatctgtctgtcttctaggtctctgctcaattatattacttcctcctggaccctctgcactaggcacaccccctggataaaagcagctgaagcatcacattctttagtagacttcttacaattgtaattttacaattattgatgggatttgatgagttggaccctcccactaaatcaagccccatatttttaacaacaaatatatttgaggggtccagcacaagcctgatatttagggatccagtgaatatttgaatgaatgagagtacgcataaatgaaaggggaccagggctgtgtatagtctgttactctccagccctggtccctttttccccagttcccctctttccccttttaccctgtctccccagatgaggagcaataccaaagatatttaacagtcctgggtatagctatctgactgtaaattgatcacaaaacacatgaagctgtgagtttagcaggtgaggatgaaagaagttagcattggttatctgctggatatgaagtacttgaggatgcatagtcctgctcaccctgaaaagatcccatgggctttaggtcccatgggtttaggtttcttagatgtcatgtttggctttctagctgcaggctgctgatgggtaaccatggtagctgccaggtcttaaagtctcacttttgagatttacttaactttttggagtcctgactttgaaaattaccaaagtaatccctgatctttatagagcaattaggaaaagtaagaaaaagaaaaatcatgtgaaatttcctcagcttgaggggagcctctcaacgtttagcacatatattctaagtccatttcccatgcagacatcaggcttaaaagaattgaacctacagtaggccgggtgcggtggctcacgcctgtagcactttgggaggccgaggtgggcggatcaggaggtcaggagattgagaccatcctgactaacacggtgaagctccatctttactaaaaaatacaaaaaaattagccaggcgtggtggcaggcgcctgtagtcccagctactcgggagcctgaggcaggagaagggcatgaacccgggaggcagagcttgcagtgagccgagatcccgccactgcacttcagccagggtgacagagcaagactccgtctcaaaaaaataataataaataaataaataaataattgaacctacaaaaaatcagctaccccaaattaaccaaccattgaacttttcagtgtatttttttctgttcttgttttttaactttaaccttttctagatgactgtgtgtgtgtgtgtgtgtgtgtgtgtattttcatttgcagcctactttttttcttaatgtgaacttatttaacccatctttgagacttttgtgaatttaatttttttgttcttaaaccgtatcataatttatttaataatcttctaatattaaatgttatttatgaaatgtttcataaatttcataaatgtttcataaataaatagaaaagttcagagagaaaccacaagtgctaagaaaatgtagcacctagcatcagtggttttgtatcttgccacatttgcttcaaaggtgcctacccaccatattcgtccttaactctaatcattttgggtggggattccttggtatctctgcctttttattctttttttgtttttgagacaggatctccctctgttgcccaggctggagttcagtggtgcagacagctcactgcagcctcaaactcctgggctcaagccatcctcccatctcagcctcctgaatagctggctaggaccacaggtgttcgccaccatgcctggccaactttttattctttttacctagagagggatttcatttttatcccttatagataacctttattgtgtagttgttcttttcttcattgactattatgtatgaatgtttgtgtgtgtttatgtgaaaataaaatcaggcctccatggaattgtgggtctgtttctgccctctgctgtttgttttgtttctctgctgtttgacagtatcataatcttaaatactgcagatttctaatgtcttattagggcaagtccccataatctgtttttattcagaattgtcatggttatcaatctttggctttttacttttctgtgtgaatttgaggattatcttttacttatttatttatttttttgaaatagagtttcagtcttgttgctcagactggagtgcaattgtgcaatctcggctcactgcaacctctgcctcccaagtttaagcgattctcctgcctcagcctcctgagtagctgggattacaggcaccggccaccacatcaagctaatttttatatttttagtaaagatggggttttgccatggtttcaccatgttggccaggctggtctcaaactcctgaccgcaggtgatcccaaagtgctgggattacaggtatgagcctcccaaagtgctgggattacaggcatgagccactgtccccagcaggattatcttactatattgtgccacagaatattttattagcgtttgattggaattacatagaattataaatttggtatttgtgactttctgctggaaatcatgataccatgaacattctgatgtttgcgtttatgataattttcatgggagctaaatttcaagaagtagaattttgggtcagaggatatgatcatttaaaagcaacattgtttgatcagattggcagatacttaaagatgggtggacaggagccattgctggcaaaggtttgggtaaggggcacttgagtatgctgctagtgacagggaattctacgcatttgtgcatagaatctgggaatgactattaagatttatttattccctctctaggtaaaatccttctctaggtatataaataaataataaataataaataaataatcagtttcagccaggcacaatggctcacacctgtaatcccagcactttgggaggccaaggccgatggatcacttgaggtcaaggagtttgagaccagtctggccaacgtggtgaaaccccatctctactaaaaaaaaaaaaaatgcaggccgggcatggtggctcacacctgtaatcccagcactttgggaggccgaggtgggcgaatcatgaggtcagattgagaccatcctggttaacatggtgaaaccccatctctactaaaaatacaaaaaaaattagctgggcatggtggcaggcacctgtagtcccagctactcaggaggctgaggcaggagaatggcgtgaacccaggaggcagagcttgcagtgagccgagatcgcaccactgcactccagccttggcaacagagtgagactccatctcaaaaaaaaaaaaaaaaaaaaaaaaaaaaaaaagggcaaaaacaaattagccgggtgtggtggtgcacgcctgtaatcccaattacttgggaggctgaggcaagagaatcatttgagcctgggaggtggcggttgcagtgagccaagatcctgccactgcactccagcctgggtgacagagctagactctgtctctaaataaataaataaataagcaggaagggtaggagagctctaaatatatgcacgtgttagcttatatttgtgttcagagcctcaggaaatgagcatacacaccaggcttaaattgggtattccaaggatcaggttggggatagggagggaactattttaaaatacatctcttttccatgtgcctttatattgacttaaaattttaaaaattgagatagaattcacataccataaaattcagtcctttaaaaagtatacaatttggtggtttttactgtactcaaagttttataatcacggccactgtctaatgccagaagattttcatcagttcatttatattgacttcttatttctttctttgtaaaaaattttaatttcatttcattttatttttgagatagagtctcactttttcacccaagctgcagtgcagtggtgcaatcagggctcactgcagcctttacctcccaagctcaagagttcctcctgactaagccccacaagtagctggaattacaggtgcacaccaccatacctggctaatttttgtattttttgtagagatgaggtctcactatgttgcccaggctgatcttgaactcctgagctcaagtgatccccttgcctcggtctcagagagtgctggccttacaggcgtgagccaccgcacctggcctatattgactttttataacaagcatgttgtacttcggtagtttttaaaacataaaaatgattttaaaaaccaagaatcacagtgatttggcagagcagtgggtcttttctggaaaagagagtcttgcctacccatgctgtcagggttagtcaaatgcccaggctttctggcaagtcagtggtagatttttctctctgctttcatacaaatgggataataaaaatttatcagccattttaagcaactgaatgaaaataagttttgcctttaccattttccttgttcaaaatcctgaagttctagtttcctagttgataaattacatcagttgacattctccataagctggggtcagaatactgtatcattgcccatcaacattattaggttaaatgaaaaggtgtgaaaactgatatcttactgtttttgcaactcttggtttacaacgaggttaaagtttcatcatgtttcctagtcatttgtatttaaattttttttttttttttttttggtgaatggactattctttgctgttagtccatgacccactgttacggacacccacctggtagtggtctcagccctttgctgaataaccatttccttccgcatctttgtccttagttactgtgtgaattcttatattgtgatttatttccaatgacgtgttgaccttttaacattgagtttgcttccatatttagcgtgtatatgatgaagaagtggaggagccagtactcaaggctgaggcagaaaaaacagagcaggtacttgtataaaatcactcttagctgagtttctgactttgaaaagtgtggtggagatcgatgtgttatgtgggaactgggggatggtgggtggggttgggaaagggagggactgctcctgacagcagcccaagaggggattctttcctttgtttctgaaatgtagtatattaactaatacagagatcaaatccttgaattctgatataagaatagagtagaagtcagcaaacttcttttgtaaagggccagatagtacatattacagatttggagggtcacagaggtcatttttttcctgtggcttcctgagttacagatggaccagccttcttcctgagatcttctcacaccagagcccaaaacatagctaagaggttctgggtcacactgacttcttagcactccagcagagatttctttttcttccactcaggaaggcacatggactgtgaataagtttattattggagtagctttgattttgttctcatttattcagaaaatatggatcacctgtaaaggttggccctttgtcagcaattattacttgtaacagatgaagctgttagactaggaaaagggtattcaaaaccagctatagttctgcctgttgccagcatttttttaaaaaagttattttattttattttttatttaaaaaatttttttattttgagatggagtctcactctgttgcccaggctggagtgcagtggcacgatatcagctcactgcaacctctgcctcctgggtgcaagtgattctcctggctcagcttcccgagtagctgggactacaggcgtgtgccaccacgcctggctaatttttttgtatttattgtagagacggggtttcgccatgttggccaggctggtctcaaactcctgacctcaaatgatccgccagccttggcctcccaaagtgctaggattacaggtgtgagctactgtgcccagcaggttattttatttttaatagaactcaaggatttgctagccatttaagtgcagtagtatctggttataccaattcagggtttaatttgaaggtgataggtatttagtgtactatttttaaaaactgctatatatttcatacacattttcacaaactcagtacaatattagctatttaactcagaatcaagcatatccaaatagaaaaatacacaaccaagacaaaaaagttcagttagaaagacttcagtacttgagataaaagactaaaatgctcgtagggtttttttttttttttgcctttggccctcagaacaacactgtgtggtttggttccttctagaatatttgtagagggggaaatgacactaaatatttttcggtatttctcacaatggcacacttgtgtctgtggggactgccattgagaactgctgttgcaggaagaagacacctgagggagattctcagcctgttggtgatatgaacaaaccttttttcttgaatggggcattgttgtagggtatacacagaatagaccggagatgaaaatgacccccttttgatgtagaacagatttataaaataattgtaattgtccagttttttttttttttgtctctttaaactgtaattgaaaaatgagacctctgtgaccttccttctaagtcttaacacctaaaattacccaagggataaccagggctcgtgggatagtcatggtgagtctgagagtctaggccctccagcagtggggaaacagcatgcattcattgttgggatacttctccacacactagttgtacctctgcttttgtagacgatgacccttgagctctggaaccttaggtagtttgatgcatgtccagaaaggggcaaacttgggatttaaaacttgcagtcttactccaaagtctgtgtcaaggcattcagcagaatttgacttttttaacatttttaataagtttttttggagcttgaggctaggctttagagaacattcacagtattcttttggggcagtatcagtatattggagacccatactgcatggtatttattttgtaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggtgaagacattcaacttaaatatttattgcacaactattatgtttgggctactttaattgggcacacgattagtaagtcatggacttaacctctgggaagtgagtatgtcacttagtagtctcacattgactccaccagaaagactcgctttacctgagcactgatggagtacttgtgaggtgcaaggcaacatgtcaagttggggtgcaaagatgcagagcatggcctctactctcgaggtgtgtgttgcagtctggtgggagagaggagacatacatacgaataaccattgtaaatgccctgagagagaattgatttccagctggaattttggggcaaagatgatatttgaattggggtttgaagggtggggaggctcaaaagagacagagagtgttgggaacctgaaattatgtagcttgggctaaggaagactgcagaagaactgaaaggcatttgggttgtttccggtttgggcaattattaaatacaaatgaagctgctgtgagcattcatgtccaggctccctcatagcctagtgagtgttggttgcttgacacactttctcccacattgttcaaagagacaattggggtgacacagagtctctcggtagtgaacacagaaagttaccacagtgatttatagaaagaggccttgtgacacacaaggccttccgaattaaaacatgccacagaaccaaacccttttttttttttgagacggagtttcactctgtcctccaggctggagtgcgtggcacgatgttggctcactgcaacctctgcctcccaggttcaagcgattctcctgccccagcctcccgagtagctgggattacaggcgcccaccaccacacccagctaatttttgtatttttagtatagacagggtttcaccatgttggccaggctggtctcgaactcccaacctcaggtgatccgcctgccttggcctcccaaagtgctgggattacagacatgagccaccccacccagcctgaaccactcttctagtcattctgtagctgcacatttctcttccagtttgagctttgctgagtcacaccaaattgaggcagatcatttggcactgaccagtacacttgctgcttggattttcactgtatgcctttaaaagtcagcagtggactctgggaaatggattgcctggaccacacttgatacttccaagacacacagcactttctcccttttttttttccccttgcagagaaagttgtggaggtacacttttcttttgtaggaggatttggggatgtcttctgagtcagtgagaattagtccaaattaacgctgtctttgccttatgctccattggttgctgtgacgtcgttgaacctttactttaaccttcccaatctttctgttgttgtgtgaaacgtcagaattattctcccctgccccagagtcctttgacaaggaagagatatcattgccaaagggcaatgcctcacaggggacagggcagcatttccttcagcagtggaggtaggaggctgtgcaagggtggagcactttcttgaccctatttttttttttttttttgagacagagtttcactcttgttgcccaagctggagtggcgcaatctcggctcactgcagcttctgtctcctgggttcaagcgattctcctgcctcagccttccaagtagctgggattacaggcatgtaacatgacacctggctaatttttgtattttttagtagagacggggtttcaccatggtgaccaggctggtcttgaactcctgacctcaagtgatccgcccgcctcggcctcccaaaagtactgggattacaggtgggagctactgcaaccgaccaaccctaaatttttaatgtgtgtgtggtgtgggactgacaggagtagacggctgacatgggcagatctccagcatgtgctgttggggccacagtctcctgccctcactctgttttctcatctggtcttattttaccaacttcacttttctaaattcaacagtgtggaaccactagggggtattgttcttctgtttattgagttataatcttttttatttatttatttatttattttgagtcggagtttcgctcttgttgcccaggctggagtggagtgatgtgatgttggctcactgcaacctccacctcctgggttcaagagattctcctgtcttagtctcctgagtaaatgggattataggtgtgcgccaccacacccagctaatttttagtattttcggtagatattgggtttcaccacgttggccaggctggtctcaaactcctgacctcaagtgatccatctgcctcagcctcccaaagtgctgggattacaggcatgagccactgtgcccggcctaatctatttttatattaaaatatatagatatattatgtctcattagtactgctttttaggggacagctcaccagaatgttcagtttctttccttggtcctcctcttcttggaccttatactaggaggttgtacccttttccctgtttgcttgctgctgatagacttttggtaggcttttgccatttttgttaaattttgttaattaggcccttggggagggagattctgtgtgatacagctttactttggcatcttttttctttttttttttttttgagatggagttttgctcttattgcccaggctagagtgcagtagtgcaatctcagctcactgcaacactgtttcctgggttcaagtgattctcctgcctcagcctcccgagtagctaggatgacagttacccgccaccatgtcccgctaatttttttggatttttagtagagacggggtttcaccacgttggtcaggctggtctcaaactcctgacctcaagtgatccacccgccttggcttcccaaagtgctaggattacaggcgtgagccatggtgcccggccttaccttgacatctttacctaggatttgacttttaaaaaaatcagtgaaaaaaagaattttttttttaacttttagtcctgctgtgtttcttattctccaccttcgttatgtagcttgtttgggatagtcagatggaacagggtatcaggtggcacatgtaagtttgttttcaactgaaatgtttgacagcctattcctttcatcatgtacaggatctatacattgatcgtcctttaccatatctcattgggtcaaagctgttcatggaacaagaagatgtaggtcttggagagctgtccagtgaaggtacttttcttcaccaaataattttattccttaacatttcttttttattttaaaataatttcaaattttacattaaagtttcaagaatagttcaaagaactctcatatacccttcacctgggtttaccagttaacatttcaccacatttgttagattgttctctacatatacgtaatattttgtcttgagcctatttgggagacatcatgctcatgccctgttacttctaaatgtttctctgtgtgttttctttttttcttttctttgtctttttctttttttgagacagagtctcgctctgtggcccaggctggagtgcagtggtgcgatctcagctcactgcaacctccgcctcccggatttaagcgatttttctgcctcagcctcctgagtagctgggaccacaggcgtgcaccaccacacctggccaatttttgtatttttagtagagatggggtttcaccatattgtccaggctggtctcgaattcctgacctcatgatctgcccgcctcggcctcccaaagtgctgggattacaagcatgagccaccgtgcccggctctttttctttctttctttctttcttttttgagccggagtttctctctggtcacccaggctggaatgcaatggtgcgatcttggctcactgcaacctccacctcctgggttcaagcaattctcctacctcagcctcctgagtagctgggattacaggtgcccaccaccacacctggctaatttttgtatttttagtagagatggggttttaccatgttgggcaggttggtctcgaacgcctgacctcaggtgatcctctgtgtgtgttttctaagaacaaggacatctcttgtataatcacagtagaattacaaagccaggatattttcctggacataagggtattatccaatctgctgctatgttcacattttgccgtttgtcccagtgacaccctttacagtctctctcttttgttctgtggtccgggactcaatccaggaccagccaccacatttggttgtcaaatcttcagttatcttttaatctgatgccatttctcagcctttctttgctttttatgaccctgacatctttaaagagtacaagcaagttttttttttatttgtaatgaataatttttggggggagagatacttcaagactacataaatatgtaattcctcaccataatgacactttcaattccagtaagtgggtatagatggttttatcaagatctctgtgatgctgttgtatggtggtttgtgattttgagctaaggacattttcttgtgaatattggtgtggtgacccttatctctcttctcaacagaaggctctgtaggcagtgatcgtggcagtattgtggacactgaggaagagaaagaagaggaggtaagggctgtttggtatgaccaggtcacggtgggcagcaagcttaatttaagatgggcctagcaggctaagtaaatagcataactgtgaattcgtaatctgcttccataaagcttttaacagtgatagaagccacattctgagttttttttcccaagggttagatttcctttttgccttatgtacaataatagggaaagctgctttcatctcttccactattatcctctctcccaccttgccaccaaatatctctttcacccaatatatttttgagaagggcagcttagatgttttggtggaatctctgcctgggatatagtctttgagtatattccgtctttgaataattctaagggaaaaaatctacatttagaacttttgtaaactataaaacctagagcaggatataccgaaagccaccacttacattctattttgctgctgccgctagcgctttcatatccacagagcataatttcatttccttgtctagagtttgagtctgtgggccttgactacagttgaatctgtagttgttctttagatgggatattcgttattggaaaggacacagccatgttgcaggagagtcctcgagtatgggatttccgaaaggagacagtgttgtgtatgtgcttttctcttctggttggtccccctttctgcactctccctgcccgcctttcttccagtcctccaaagaaaaacctgacagcaggaaatgagcttttcttaagtaactttcgtataacaaaagcagtgctcattaggggaatcccttgcttttagccaccgatgtggcacttctatgtggcacttcatcaatagttgctcgtagcaactattgatgtccccttcttgggcctaatgaagtagttatttttattttttatttttattatactttaagttttagggtacatgtgcacattgtgcaggttagttacatatgtatacatgtgccatgctggtgcgctgcacccattaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccagtttcatccatgtccctacaaaggacatgaactcatcattttttatggctgcatagtattccatggtgtatatgtgccacattttcttaatccagtctattattgttggacatttgggttggttccaagtctttgctattgtgaataatgcaaggaaatagagacagtatagtccaaaatgtaaaataacacaaactgactttcagtaatttagttagttaaatgtgcaactctttaaatccaaaggcaagagttgaaagtgcaggtgatgtgaacaaattgttagaggcatttaagtgaaccacaaaaattacatgttaactggaacaacccttcacaatattgccagctacccagcttatctgcaccttgatacttaaggtgaccagtagtcagtacaaagagactgagtgtcagagctttttctccacttgacatagaatcagcctgccccagagacttagacctgcaatcatttctgtgcttctaagtaaagcccatttaacaacaaagccttttcttacccataaaggagtcagatgaagattttgcccatcacagtgacaatgaacaaaaccaggtaaggctcatatattgaaatgactttgtttttacattttaattgaagcatagtatatatactaaaattactttggaatgatttatgaccaagtgaggattttttcatgtatacaatttattttcctttaagcatttcatgtatttaggctaactacctcctttgtatatattttttccaattttgctttatagtttatttttcttagaaaagaagtttcaaagaagtgaaaagcacaattggaaaacagagcctctaaaagaagactcagttacccaaactgaactactttgcatgagtccctcttctgttttaaaattggagacaatctagcagtaacattattgagtattcacaagatgaaaacttcttaccctactgtcttagcacggttatcttaatttttgaatatctaaaggcgtattcttttcatagtgtgcatcgttcattttctgccattttatgttaacattttataaatgtgtccttatttattattattatttttttgagatggagttttgctcttgttgtccaggctggagtgccgtggcgtgatctcagctcactgcaacctccgcctcctgggttcaaataattcttctgcctcagcctcccgagtagctggcattacaggtgcccaccaccatgctcagccaattttttttgtatttttagtagagatggggtttcaccatgttggccaggctggtctcgagctcctgacctcaggtaatccacccaccttggcctcccaaaatgctgggattacaggcgtgagccaccatgcctggcctccttattttaaatagcctttgcagtttgcgttgtaaacttctatacttttaaacatactgagtatgatactgtcatagtctctaaatgtataagggaaagagtttatttctagagttgtatttttgatgtaataatgtattcaatattttcttttcttttttttgagacagagtctcgctctgttgcctaggctggagtgcagtggtgtgatctcagctcaatgtaatctccgcctacagggttcaagcgattctcatgcctcagcctccctgagtagctgggactatgggtgtgtggcaccatgcccggctaattttttgtatttttagtggagtcagggtcttcccatgtttcccaggctggtcttgagctcaggcaaaccacccactttgccctcccagagtactgggattacaggtatgagccaccacgcccagccaatattttcatatatagaaatcctttgcttcggtgaactgtttcttcagaatgaggtggtatagagttatgttaataactcttaatgtctggtggacattctaaattaagtattatgcatgtagattttcctacaatctcatcactggggtgattattttaaatttcttttagttaaaaatttgcatttaaatttcttaactgggaaatatttttttcacaaaaatgtttaactatcaaatgaaggattttatactttctggttgttactgtattttcctggttgtattcataaatgtggttgatctctataattttaacgatcagtctttcttcataggatatttgtttctatggaatttcctattaagatctgtaaatgcaaacagtttttctttccttttttttttttttttttttttttgagacagagtctctctctgttacccaggctggagtgcagtggcacgatattggttcactccaacctccacctcctcggttcaagtgattctcatgcctcagcctcccaagtagctgggattataggcatgtgccaccatgcccagctagtttttgtatttttagtggagatggggtatcgccatgttggcgcggctggtcttgaactcctgacctcaggtgatccgcctgcctcagcttcccaaagtgttgggattacaggcgtgagccaccacgcccggccacaaacagtttttcaaaaacagtacagtatagtgagtaaaagcactagcttatgcaacaggttggttttgtgtgctgcagctaacctcaaagttgtaaggattaaattagataataaagtgcttttagtaacatgcctggcacagttcattgattcaaacattgaaaaaaaatttttttaattatacatagtagtgtgtacctttggaaaaattagaacttaacagataaggctaagtttgagccttccagtcctttccttctctgcatactcttcagaggtaactgggatcatgctctgggagcatgtcattccaagtctgtttctttgcttttataaacacatctgtttccatagaaatgctgtagtgtttgcagagggggcggggcttggtatcatcctggatttgttattctgcgcttttttgcttgacctaccttggatggctctctagtcattacagcttttaccttttaactattactcagtattcttactaaggtaagactatgctgatgatgtttatatttctctagtaaaaggctgggcatggtggctcacgcctgtaatcccagtgctttgagaatgtaatcccagcgctttgggaagctgaggtggttggatcacctgaggtcaggagttcgagaccagcctgcccaacatggtgaaaccccgtctctaccaaaaatataaaaattagccgggcgtggtggcgggtgcctgtaatcctagctactcagagggctgaggcaggagaatggcttgaacctaggaggcggaggttgcagtgagccgagatcaccccattgcacttcagcctgggcaaaaagagcgaaactccttctcaaaaataaataaataaaaatatttctctagtaacagccatttttgatattttaatattctgctttttatattcttgttgttacattcttataaaggatacatttttaggccgggcttggtggctcacgcctgtaatcctagcagtttgggaggctgaggcgggtggatcacctgaagtcaggagttcaagaccagcctagacaacatggtgaaaccccatctctactaaaaatacaaaaaatttgctgggcgtagtggtgcatgcgtgtaatcccagctactcggaaggccgaggcaggagaatagcatgaactgggcaggcagaggtttcagtgagccgagatcgtgctgatgcactccagcctgggccacagagcaagactccatctcaaaaaaaaaaaatatatatatatatatatatttatatatatatatatttatattttatatatatttttatatattttttttcttagattcaaagtaaatcttgtgtattatttcttccagcacatcttttgcttcataacttgctgcatcatgtttatgattattattttaaaaagctgttacttctttgaaggaggagcctaaaggctgacagtatctcttctttagcttaataactagtagttctaatttggtattttatactcttagcacaccacacaaatgagtgatgaggaagaggatgatgatggctgtgacctttttgctgactctgagaaggaggaggaagatattgaggacattgaagaaaatactagacctgtaaggaaggctgtagttgctatcacttggcagagttttagaaccaatgacttgtttttctttttattgtgacttactttgtacatcactcattttggcatatttgtcatttcatttacactttggaaaataatggcaagcatctcaaattgcctcacaagtaccactttcttgtccagatgttatgattttatgagtcagatcattcagaatatgtctagttccagagtttgaagaccatagtgctcctgtctctccacccattcacctttttcttattttcgtatttagatttttaagtattaaagtcaagtattaaaaagaataaggaaataaagggcatctccctttgaaggaacattttatgagtcctattccttgggtgagctgtatagggtacatatgtttaaattcatttaattaaactctgttttctcctcagttcaatttctttgctcttgtatacataatgttgttaggtgtccaaagtgaagtgtactagtttgttacaaaaaagcgattcttttgatttctcctgctgtagaaaagaagcagacctacatcgtttgcagatgagctggctgcccgcatcaagggggatgccatgggtcgagtggacgaggagccgacaagtgagccccagccacgttgatggggagtaggggaggagtagtgcagggccctctgctggcttcaccaaaggcggatttctctttttattagtaattactacatatatttattagtaattgctacatataatttaaattgtagcgcttattccttttttggttaatgggctcctttagataactgaacactgtggacccacaagaaaaacgtacatgtacacatgtagataaccctttacatataatttcaggggattaatggaaactccagagaaccatgggcaacagcttaagaattcctggctgaatatttactcctatattttgaacacgtaagaatgtgctatatagcatattctagttataacagggtagaaagataacacaataattctttcaacaaatacaatcctgttatgcacatgagcctggtacgaaagcagaagccttctgccttacaaagagactcttgagtgcccactgtgggcagggccagggagttcagtgctctggtgcagctgagatgaaaggcagatgtcttgctcttagctgtgagttatgaggatgacagacgtggaaagaaccaggatgtgtatactgagggaggacttagtactattaaaactgtgaactgttcttcaagccttaccctcaggagaagcaaaacctcggaagacactcaaagagaagaaggaaaggagaactccttcagacggtgggccttttccctcaattctgttattttaggagcctgttgactaaggaatgttgcttacataattcatgaagtactgctttacatgctgttttccctctgacaaatgggtctgtctccatttacttttctaaagcctctgggctggacgcggtggctcacacatgtaatcccagcgctttgggaggccgaggcgggtggatcatgaggtcaggagtttaagaccagcctggccaacatagtgaaaccccatttctactaaaaatacaaaaaattagcttggcatggtggtgggtgcctgttgtcccagctacttgggaggctgaggcaggagaatcacttgaacccgggaggcagagatggcagtgagccttgatcgcgccactgcattccagcccgggtgatggtgcgagactccatcccaaaaacaaacagaagccttggaaggcatgttttggggtgctgggaggatatgtgggtgtggagtaaaaattcctgtagagatttgatttattagattttacagcaatcatttcttgtcttcctagaattcttagaagtatagaaacttaggaatctcaagcatttgttttcaataaaggatacaccaggccttttcctgcaaacagccatgtcgattacattagacttgtccctgtgtcagtttgcagatccctttgtttattctgcccttccttcccccagattggttggggaatgggtcttgaatgtggcgtctgacccgaatgcttgcttcagagtaaatctagatccagggtgctggcctagagaatgaatgctgtgtgccacagacgtggacagacttgagagtggaggcccagagagtcttttgagggtgtcagtggactgtgccaggggtttagtgtgaaattcatcagactgcctcacactttgttaaatagtgtcagataaactccatgccagtttggagacacagcagatgccaacccgggaatttgagttctggacccatctttaatactccctgcaaaacattgctttctgtttgctagatgaagaggataacttattcgcaccccccaagctgaccgacgaggacttctcgccatttggctctggaggtggcctgttcagtggcggcaaggggctatttgatgatgaggacgaggaggtgagtccatggcacccagcaacactccctgcagctagctgtgtcaggggtccacagggaagatataggctttgcttgtttagtgggggaaaaacagtttctcagttggaagttgcttctattttcatattttgggacattttgaactaagaatcacagagtgagaaatgccgtatccttctatgctttgttaggtgaggagaagatgtgcacgtgttaatgtgaataatttactaggtgattgtttcttgccttatctgttgtcttccacgtttgtttttaattcctggacaggcctaaattattttagggtctgattttgccatagttatcactttgcaactgattttctggcagagtagtaaatatgtagctttaaatcttgtaggttatttttccttaggaatcctcacatgcagctatgctttctcctggttttttgaattctttgtcatataccttatttcaaccagagtgacctcttcacggaagcctcccaggatcggcaagctggagcctctgttaaggagggtaagctggggctgggcagctgcgtctccgtgtgcagagttccaaaactgtctttctcactaggagatggaacaaggttgttcccaagccttgtttctgtgtcaagcaagaagctgttgtttttactgcggtccagttgaaagtaattcatcttcactaattcatgtcttggaaaaaacagtaccatctgtaaacccataccacagtcttgcctctttgttaggagagaactcatagaaagtcaaacaagaaaagtaccctagagcaatgttgaggatggttttcattgaatgaagtttaatttaaagaaacatttttaacattctgtatataagttggagaccagtaattccccaacccagtgtgcattaaaatcatctgtgcaggtttttttgtttttttgttttttgtttttgtatttttagtagagacagggtttcaccatgttggacggttggacaggctggtcttaaactcctatcctcaagtgatcacccgcctagacctggcaaaatgctaggaatacaggcatgagccactgcacctgtccccttggtgcagtttttaaaaaacacaaatataaatatgttttttttttttttctttttttttaacctacaaatgttactcaataggtttgtggtagttcttgggacttgggaattagtgattctaagtgccgagtctcccgggcgcaggcatcagagctgggccttggaggccgctccttgtgcctgctgtgcgggctgctagcctggctctcctctgctttctgctgtccatgttttggcatcagtgacttgcttggtttccccctttgctcttatgtctttatttttttactgatgactcacatgtttttgcggttctttttcacccgttcattctcatccaactggaatgggtagaggtggaactgtttgggggagccccggtcatgctgtccctgcctctgctgtgctcacctcctcccttggtgtcccccagctgacccactgctgtggcttgatgacggtcagcatgctcttccatttgagtcacagctcagattgtgttaatcccaaaaaaaaagtcctgacatcggtagagaagaaaatactaaggaattttaaaatggcttgttcaggaaaaagtagtttcaaaaggtctggtactagctgtgtgttacattgcacgtatttcaggaagaaaatagcaaggaaagttatttcccttgtaaaatggttaccccttgctttctcattctagagtcttcatcatccaaacctggaaagaaaatcccagcaggagctgtttctgtatttttaggtaacataacttaggtttgttttctaaaaactacacaaatactgttttttgcatttcaaaattatcatcttctaaagtctggctggagatgaggaagtacctgggagcttcaaagggctttgagcatcttatagaaagagctcatttactgatattagctcttattctcctagagctcagtggccttggacttttttgtgtttgagcgacctggtgattctccgttgtgagatgttctgtagcagtaatggatggaggctattgggccctgttatgcattttgtggattaactgaaatggaaagtttttggtgggtgataatttttttctgtaaattcaaccggcccacactggctcacagctgtggctgtcttgtcccttcactcacaggagacacggatgtgtttggtgctgcctccgttccatcactgaaggagccacagaagcctgagcagcccactccaaggaaaagcccctatggtccccctcccactggcctctttgatgatgatgatggtgatgatgatgacgactttttctcggcaccccacagcaaaccttctaaaacacgtatgtgttcctgcctccgtttctaggacttcagccagaaaaagaatgttgcctaaaaagaacataagctcacctagttctgtatctcttacagtgccagaatcccttctccagcattcctgtcattgagttgttgtgtctgtacttacataggtgtggtgcctgggaggtctgttttatgacccaatcttttctgctctgtaagctaattactatgattattttccttatagagagctgaaatccttttctgtataatttttgcttgcaatttccagttctgacctttggtattgtaaagttttaatcatcctttcttccagccgaccttagtcaattacatgagcagcaggttgtgtgccggccatttatttcccagcttctcatttctctgccaaaaagctcaggtggccttggtctttcctcagatgatgttttcatccccttggccactttggcattctcctctcttttcctcttaaatgtaagtcctatgtcctgaagtcattcccataaatcatttgtttttaaatgtgcagatgaatcttccaggggcttttgtcaaaatgaagattccgattcagtaggtccagggtggggcctgagaatttacatttccagcaagcttcatggtctgtagatcacacttcgaatagcaagacttagatccattgactgctcttccagaaaagaaaggtagatccctagatccctaaggtgcacatgattttcagcaactttaaaaaataaaaaaggatggcataggaatggatggaactagaatgcatttagaagccggctgtctggactcactctcttccagtgttaggtgtagaaagtaaggatggaagccgaagtgtgagggaaaacgatagcctagttaatctagaaagagtgcaaacggatgcagaatgcacacaggtctcagtgaagatgacaatgcacacaggtctcggtgaagatgacagtgaatgaaggtagtagtgctttttgtagctccacagggctcttacttagtggatatctttgagaactgatttagaatccctagtaaattgatgctgctttctttgacaactcctagtctcttcagacattcatgagtcagtgacctcatttcagcaacacatgccctattcggtacagcagtgcttatggtgatgaaaggttggaaaccacccaaatacttatcagtagagtaagctatggcccttctattcagtggactattctgtgacagttaaaaagaaaggggtctacgcttgttgacttgggaagattttgtaggtacattgagtggaaaacacaaatggtaagacattgttcaaattatcttcttatttatagccttatttataaataactagtgttaattcattagtacatcctttgggggaattagaagcatgtatgctgaactgttcccaatgttcatcttgtttgagtagactggtggaattatgaggggatttcattatttgcttttatctgcttttgtacagtttgattttttttaaagcaggagccaagccttcatttctcagattccttagatgattgacttggtggccctcttaaatgatctttcttcctctagatctctcttcaccttgtaagccagtccaagctactctaagcacaggaaatggctgcttggataagcatgtcagccacgtggataaactatctgttctgtctttcaactgaactgctactatgcactttgaaaaattccaagggaagagtatagttccacttactatttctttataactaatcaagaaacaacataactttttatgtttattctttgggagggaagaattttttaatctgtgaattttgtgataggatgtttgacgttagtgtcattttatgccttggtattttttacaggcaaagtccaatccactgccgatatctttggtgacgaagaaggagatctgttcaaagaaaaagccgtagcatcgccagaagccactgtgagtcagacagatgaaaataaagcaagagcagaaaaaaaggtgagcaggagggaagacttaacgcaggagcattgatctgcagcattttaataattcatccggaacccagagggaagtactgttccctttcacgttcatattgaagaacttcaaacagaaagtggaaagaacattgcagtgaacacccaaataactgccacccagattgatcagttcttagggttttggcaaacactttatggatgtaaaccttgttacatatctatttttttcctgaactatttgcatgtaagttgtttgaactgtttgctgcatggaactgtttccatgtagtcattgtgacattctacccctaaatatttcattaagcctctcttgaaaagacttccatataagcacaatgccattatcaacagctgtgagactaacagtaattctatagtagaatctaatatctagtctgtattagaattgctccagttgccccagaatgtctttgcaaaatcaccccaacaaatagaatacagatttaaaattatctcgcatatagttcatactgcaatttcctctcttgtccccaaaatgccatttacggcagtgatccccaacctttttggcattagggatataaggagagtgcaacctgcaatctagatccctcgcatgcacagttcacaatagcgtttgccttcctatgagaatctgatgctgccactgatctgacaggaggaggagcttaggcagtaatgcttgctgctcacctcacctcctgctgtgcggcccggcttctaacaggccatggactggtctgcagcccagggttggggacccctgctttatagtatttttttatgttttgattttttttttgttctaagaaactcaggattcggacagtgtgtctgcattgcatttggttgtcatgtctctttggtctccttaatctagagcaacacctcccacatctttttttttttaatatccagccacttgtcttgtagaatgtgtctcgtgaatttgcttgattattttcctatgaatagattcagggtgagaagttttggcaagaatacaagcaggcagggttgtgcacttccagttggatcacctcccaagacacatcaggtccactgtctgcctcattcagacacgtttgtcacttggttgttagggtgcccaccacactgcttcattggaaaggtaccctgttctcttttgccattgctcagttgatctctaaagtgatagttgaacacagtgtgaatacctgttctctcccagccttttactcagtgttttgaaaatccactgatgatcttttcttgactcagttaatctgttagcgggcacaaaccactatttttttaattctatatttcttattagttggcattcttctgaataaagttctttctctccccctccttccccgatttttagtattgctttgggatcatgtattcattcttcagtgtagatgataatccattaccatcattcttcttctttttttttttttttttgtgagacagggtcttgctctgttgcccaggctggagtgtagtggtacaatcacagctcactgcagcctcaacctcctgggttcaagcgattctccagcctcagcctaccaagtagctgggactatatgcgtgcgccaccatgcccggctaattttttgtggagacgggttttgcccatgttggccaaaccatcattctttttgatgctcagattgacctgcatttggccagtgtgtgtgtccccagcagtctttaagcccttctgactgcttgtcctttcactgctgtcctgtacagctggtccctcctctttctacagttttgtctctttgtgtcatgtcctggctgtgaagccctgactttctcctgccgaccacctaaggcccagcattcagaacctgtcaggcccgtcaggcagcctgtctttccatgctgtctctcattgcatatgtcccatctgtgcacccattgacccagactgtgtgtcctgctccctgatacaccagatgtgtcctctgtttgtcttgctgttctcttaacagccccctcagcttgctgcctatcacagcagagactccgtgcgttttctcgattgattgagtaaaccctcttttctgggtatcttacgtgttaatgcttaatttttctttttctttttttcttccccaccccccccccacccccgacaaaggttaccttatcttacagcaaaaatctcaagccctcatcagaaacaaagactcaaaaaggcttattttcagatgaggaggactctgaggtatggaattcttttgcttagttgtgggtattagtctatggatatgacatagaaactatttttgaatcaggtttttctcaatagagttataagactttttgttaagtactccagttctttaaaaattatctctagaggcaaggagtggtggttcatgcctgtaatcccagcactttggtaggccaaggcaggcggatacctgaggtcaggagttggagaccaggctggccaacatgatgaaaccctgtctctattaaaaagacaaaaattagccgggtatggtggtgcgagcctgtaatcccagttactcagaaggctgagataggagattcacttgaacccgggaggcagaagttgcaatgaaccgagatcacaccattgcactccagtctaggcgacagagcgagacttcatctcaaaataaataaatgaataaaaaataatctcttgagagcacaggggctttagaaagcaatatgtttacaatacttttcactttgggttggactgtatttacatttcctgggatgaaaatcctctctctttaggatgctcagattttaaactgttcatgggctcatgatgtgatgaggagcttgcaccagagtggaggtcaccatgctacttcctttattcacattctcactaactagaccgtggcttaatgctgtagcagatgggttctggcatagccatctgtcttgtcgagactgagaccactaacagcctctgggaccctggttcataggttgctttggtccctccaggcaccttagaaccacctctcagaatttcactgcttttcctgagtctctcaggcctaggtcgtcttagatccaattttaagttggccttttaggagatcggagacctgtatgagaaatgtaatgggaaataataagccccttttacagaaaaacatgtggacatggcagaaacttacatgtatttcaagaaactgtgggctctaggttaggctgtcatggttgggctttgcactcacagcaaggatgaacatggaaccctttggaagtatagtgattgcccttgacgtaaagaatacctttgaggctattatttcattgaaggcgagtgtacaaaacatggcaattaaccaaagtccagtcaagtcacaaccctgacccctgagaaacagcatgatggggcctccaccgtcttatgctcatggatcccctgtgtcacccacacctgcacctcggggtctttgcaccggcccctgccactctgaggaatgctgttcccagaatccagctttcttcctcactcttcgatttctctgtgaggcctcgctgatgaaatacacacaacaggaagcctgctagcacataccacgctgtgctcctggtcctctttcctatttcactgtttaccacagcacgtgttgccagggacagtgtatatttgcttattcattgtctctacttcccactaaagtacgtgccatgagggcaggactttgtattccctatttgtatccctaacaccccgtccttaatacctgtgcttggcatgttgtaagccatccagtaattgttgattagacaagaaaaccaaatgtgagcaatttcagtgacttacgagatgttctggttatttgttgctatgaaacaagtaactcaaaaacctagtggttcataacacccatagttttgttgtctcacagttcgagaggttgactgggcttagctaggccgttgtcactgagggtctcttgtgtctgaaggtggctgggctgagggtcagctcactcatatgtctggtacctgggcactggggcccctgggacatctctcactagccctgtgtggctcccagcatgtagtcagggaagccggtcctcttacatactggctcagggctgtaggggagagtcctcagagagagcccgatggaggccatgtcgccttctgtgttccagccttggaagtcaacggtggtccttttccttcatttgttggtcaagatggtcacaatggcccatccaggtttatggggagaggccataggctccccttcttgatggtgggagtgtaaatgtactctcagacttgtgtgaaaaccctaccaaaggctttgccccatgtgtgtcatcatagagtgaatgtttttattggatattgttcagattctgaggcaaggagaagtaaaactaaggcagtctaagtaagagttaaagctttggacccaaaggaatgcgtcctgactcctttctctatatctgaagtgtgaggctgaagcttgccctgtgaagtcattttgggggaacatatttgaggtaacggaagtgtcttttcttgcagtaccaagaaaggtatcagttaagggtccgaaactgtgatgttgacatttgtttttgttctttgctttggtttactttcattttcttagaacagcagaaccctttctcttgccattgtgtaacatgcaggaggggcacgggatgcctggaatcccccacgtggcctcttctatctaaataaacccatgggactccggggagcacaggggaaaaacactgtgtggaggagatctcacttagtgaactcattaggtctatatttaggagtagacagcgaccccataattaaaaaaaaaaaaaaactgtccaaagaggtcttagaaatatcttcttgtcctatttaattgttcggctcttgtgtattgaagtttatcttcccaagggaatagatgtcccattttatgtttctacttcatgtaggtcaacttgcaggtctttctttgcaggataagctgatgttttataacattttgaaaatttcttgatttttatattttttagctattttgagatgaaattatactctttttgcctaggctggagtgcaatggtgggatcttggctcactgcaacctctgccttccaggttcaagcaattctcctgccacagcctcctgagtagctgagataacaggcacccaccaccacacctggctaatctggtatttttacaaaattaatataggctggtcttgaactcctgacctcaggtgatctgcctgccccagcctcccaaaatgctgggattatagacatgagccacagcaccgagctgaaagtttctttagaatctatcaggtcttatcctggtttgcaacgtcatatacctatagttaagctaagtagactagcaaacatttaaaaataaagtttaatttgtatttatttaaaagaaataagtcggccgggtgtggtggctcaagcctgtaatcccagcacttggggaagccgaggcgggcggatcacaaggtcaggagatcgagaccatcctggctaacatggtgaaaccccgtctctactaaaaatacaaaaaaattagccgggcgtggtggcaggcgcctgtagtctcagctactcaggaggcagaggcaggagaatggtgtgaatccgggaggcggagctttcagtgagccgagattgcaccactgcactgcagcctgggcaacagagcgagactctgcctcaaaaaaaagaaaaagaagtaagtcataatcttaggagaggagggtgttactaaataaaatagttgtagctccattaatttgggaatctagcccctgtttctttattgaccctgtctaatctctgattctttagacagtaatgggaagccatgcttatatatttatttttttagcatggtgtaggaaattgattcaaaaacttattcctgccttctgtcattcaggtgggaatacagaagcccctgggctctgcgagcccaccagatcctgtagctctcctcctccttagcgccactgcacacaccctgcacagaccctgaggcctatccctttaaggactctgtctgagccaccttccctctcaggaaagaagcctagacacatggcagctgtcatgtctgagtcacttgtgttttatactgacctgatattttaaaaactgatattcctgttaaccagcaactttaatttcaatccaacaggatttgttttcttctcaaagtgcgagtaacttaaaaggtgcatctctgctgcctggcaagctccccacgtcggtttccctgtttgatgatgaagatgaagaggtaaacattgttattgtaacactagataatttagattaggagaaaacggttgttgatgtaactttctacccagaggctcatatactagcaaaaggtggtagggaagcagtcaggctacctgaagtttatataacaaaaatatttctgtttttatttcagtgacttcttccttatattttcctagctgtgcaatggagaagacattagattcttgacgcagttctttttttttttttttccgagttggagactttctctgtcacccaggctggagtgcagtgatgcgatcttggctcactgtaaccgggttcaggtgattctcctgcctcgacctcccaagtagctgggactacaggtacgcaccaccactcccggctaatttttgtattgttagtagagacagggtttcaccatgttggccaggctagtttcgaactcctgatctcaggtgatccgcctgcctcggcctccctaagtgctaggattacaggtgtgagccaccgtgcctggcttcttgacacagttcttatggagtgaaatctacaggttttatttttagaaatctgcctttgagaaatacaattgaccctttaacagtgtggaggttattttgacttccacattgcagtgaaaaatccatatataacttcttacttcccaaaaacttatctactgatagcttactgttaaccagaagcctcatggataacataaacaggtgattaacatataaatagtataatatctatttatatatttttgtattcctgacatatccagcttttccttattttttttatgatatttctaggccacatggtttgtctgcaagatttttcaaattgttgcaaatgtccaaaaaaattttcaacatattactgagaaaacatttgtgtagaagtggacctgtgcagctcaaacctgtgtcattcagggtgagctgtactttagtctagaggatggatcaacatatacccaatgacctacaagaatgttttggatcaagtggagatacaaaggaggaggcagccatgtcctgaccattgtctttctttcccgtcctggctggagagagcacagtggggaagagaaataagagagaagacaacccaaaccttaactctcatgcagtactgggcggtggtgagctcaaaggctttgccatcagacccctgggttcatatcccagctccaccacttgcaaaccaggaacctggggcaagtaacttaaccttccttaagctcatgtggcttaacagtgagtagggtcactgtggcagctgtaactactagtgtgaagctcttgcagagtgccggcacataataagtgcatagtgaatgtgagctctgtcattagcatccccaatggacaccagctcattattctcctggcctgtcctacattaccgcactctccttaaaggagacttcatccaggaagacactcccttcatccatcttcacattccagggctgttcacctgagtttgtccatcctaactcagactcaggccctctgatgcttttgttccccttatctgaataaaagcaccttaataaatataacttttggggagtgcttgaccacagaagaatttacaaatgccattaaacttagtacaccagcaattttatttagtaagctatttctccactttgtataatctctttgaaactaatgagaaacacaagtcatgccttccctccatcccaggtgtatgtctttctgacctgtaaaggagtggagacagacccccagttctctcctttcagccattgttctggtttctcattcgtggagacaacagtgtgagtttctggctgctgcgggggctcccgtgcccatcgcaggctgtaaccacctgaaatgagcagagaggcacttgcccacagggtgactggatggggctcagtttctccttgtacttcatgatctcatttgcatgttgttctcctgcttatatgcagctgttctgccttcgagttctatggtaatctctttcccttctatgggtgcagtgagaaaaggctgtagtttgggatttactagcattttgcggtttttccccgccagagttgttatttgtatacctgactggagacttacttccttaaagtttgatataggaggacatcctatgttttctgattataaagttgtcttacctttctgccatttgcttttctaggataatctttttgggggtacagctgctaagaagcagacattgtctctacaagctcagagagaagagaaagcaaaagcctccgagctctccaaaaagaaagcatctgccctgttgttcagcagtgatgaggaggtgagctgaggtttctgctaaaaaagaggggattatttcatgggatttaagagttaaagccatcccaagtctttttctacctgttttatatctcgtgatgttcagtcaccaaaggcgatgttcacaagattgtcttttctgaaggaagacatttaatgtaatatattaatttaaagatgaatctcttcaaaatggttaggaataagtatgactcccacacaatagtgtatgctccttcaaatgagttaggccggctaggggggaaatgatttctcagccatcgctagttcatggtcgagtcccttagaacaaatgacagattaaccagagaaaagtgtgcaagtttacgtaagataagttttaccagacacaggagccttcagaaagaaaaactcaagagaaacaggaaatcctgtgtcaattttatgcagtctgatgaagaagcggacagttttgggggagcacgattagatgaaaggggtgtgacctgatgggaataagctggggggagctcagcaaggcctgtgtggtcagatcattctctgcatctttacaaataaggaggctcctttcctctgggaatagggaggactggaatgaaggttttatgacctactccagagagggttagaggattcttctatgtcctgcttcagaggagaagggccagggaaaggtcagagagacctttctgcttctgttttctcaaatgccaaggtgtcatattttgaggtagcatgtcccgtataccccaatggccatatatactagtatcttgttaaatgactactgtgtttcattaatttagaactatagttaggaggagttacctattgaggttaaactcctttttgagggagtcttaacaatatttctgtttgtgatctggatagatactaccaaatcagttagtttagttgctaactcaatcagatttagtagcagggaatcagatttagctgtgcagaaaaagactttaaatatgatgatataaaaaatcctgagtattaaacatcttcctgtgttataataattcctcttttttttaacattgtaggcaagttagtagggggtgaagtggatatataagtcatagatatgttcatgtccttactgaaagcaatttaaaaattctgaagcagattgcaaaaaaaaatgtattaaaagcttatgcggccgggcgtggtagctcacgtctgtaatcccagcactttgagagtctgaggcaggcagatcacttgaggttgggagttcgagaccagcctaaccaacatggagaaaccttgtctctattaaaaatacaaaaaaattagcaggttgtggtggcgcatgcctgtaatcccaactactcaggaggctgaggcaggagaatcacttgaacccaggagatggaggttgtcgtgaaccgagatcacgccattgcactccagcctgggcaacgagcgaaactccgtctcaaaaaaaagcttatgcaacacacatgtgaacaagacacaatgaaaaactgctagtaatccttttactacaaaagtctgagtctggcctttagaaagcgtttaaggaattcccacccagctgtgctcatgccttcacatcaaggaactcccaagcatatataatttgtgttttctactcaaatgtatgaatttatgatagattatccagtttttttcttttaaacattgtcagtgattgttccccctgtagcaacagccagacatcagtgtagttgctcctactagagtattatagtggttcagggaaaataaaaacattacctaaagcttggagcaaaaagacatgcagaagaaagacagccaaggttctagaacaggggcgtccagtcttttggcttccctggcccacactggaagaagaagaattgtcttgggtcacacataaagtgcgctaatactaacaatagctgacgaactaaaaaaataaaaaggttcgtgcataaatcccataatgttttaagaaagtttacagatttgtggtgggccgcattcaaagccatactgggctgtgtgtggcccatgggccacaggttggacaagcttgtcctagaacaaaggctgtcaacttcggctgctcattgggatccatggggaacttaaaagagtgctgacaggccgggcacagtggctcacgcctgtaatcccagcactctgggaggccaaggaggtgggcagatcacctgagattaggagtttgagaccagcctggccaacatggcgaaactctgtctctactaaaaaatacaaaaattatctgggtgttgtggtgcttgcctgtaatcccagctactcaggaggctgaggcaagagaatcacttgaacccgggaggcagaggttgcagtgagccgagaccgcgccactgcactccagcccgggccacagagcaagactctgtctcgaaaaaggaaaaaaaaaaaaaaaaaaaaagaaagagaagacctaacgagtgctgacagtggatcccagctccagagattctgaattaatctggttggggtacagcctcgtcattggagttttgtgatactctctagtggatttcagcgtttagtcactgctaaacattgaggagcacttctcaaaccttcatgtttaggaaatcacccaggcaccctgtgaaatgcaggttctgattcagaaaataggggcggggcctgaaattctgcataatctgctgctggcttgtggactccagtttggtttgcaagactctagactccagagatagagcacttatgcaagtgcttgggagttctttgatttgaaggggtgtgagcatagttgagtagaattcccttaaatgctttctaaaggccacattcagacttgtggtaaaaggattactagcagtttttcattgtgtcttgttcacatgtgtgttgcgtgagtttttacactttttttttcaatctgctttaggatttttaaaattaaaatattcttctctggagttggaagttcttgagttcttggtatttttacatttggcttccttcttatagcctctgtaattaatgttgattccctgaaatagacaagtcgcttgtaatacagtgcagaaccacattgggaagagacatcgtggcaggtgttggaggaggaaatcatgagaagctctgtgaggtcagagagcccagctgtctagatttgagttcaaagaaaagtcttaagcatgagctttcttcaagactgatgcactaagtttaatacttagtttaaatacaacttagtttaacaaatataagtttgattttactccccatgttttataatctaaattgccattggagttttttttcttttttttgagacagagtctcgctctgtcccccaggctggagtgcagtggcacgatctccgttcactgcaagctctgcctcctgggttcactccattctcctgcctcagcctcccaagtagctgggactacaggctcccgccaccacgcccggctaattttcttgtatttttagtagagatggggtttcaccgtgttagcaaggatggtcttgatctgctgatctcgtgattcacccgcctcggcctcccaaagtgctgggattataggtatgagccactgcgcctggcctggagttttaatatatattttatgttttaaggaccagtggaatattcctgcttcacagacccacttagcatctgacagcaggtctaaaggagaacccagggattctgggaccctccagagccaggaggccaaggctgtgaaaaagaccagtctctttgaggaagacaaagaagatgatctttttgccattgccaaggacaggtgagatagtcattggaaggagtccctcactccattaccgtggtaacaagaaaaggaatctgatgcacaatctagttcatcgggtgattgctaatcatggatcacatagtgattgtgccagtgagaatgtctttgcttttcaatggcaccatcttttccctcagtacccggaaatgtttgtctttgtggatccttatctgatttcttccccaatcattattttttaaccatattctttttctttgtttgtcagggatttgagtatcttttgtttgtgatttttctctgggctactctaaagtatgtcaggtttggtcaggattacttaaaagttactttaggccaggcacgttggctcacgcctgtaatcccagcactttgggaggccgaggtgggcagatcacgatgtcaggagttcaagaccagcctggccaatatggtgaaaccctgtctctactaaaaaaatataaaaattagccgggtgtggtggcacgcgcctgtagtcccagctacttgggaggctgaggcagaagaatggcttgaactcgggaggtggaggttgcagtgagctgagatggcaccactgcactccagcctgggcaacggagcaagactccatctcaaaaaaaaaaaaaaaaaagttatttgaatagaaatctgctcagcatttaacacatcctgttaggaggaagttccctgtagagctgtgcagtatcactccaggggctgataacccatagccaacctaggtgcctctccccattaatgctggaactgaagctgctaggatattcagagtgagcgtgggctgtggttggtataacatgctgccagattagcttatgggttcagaattacttccctgcaaatactttttttccttttgaaagcctgacatgattactttgaaattcacctgaatgttattagcagaaagaagtaactgattggacatgtaaatcctatgctttggtgtggttaagcgtcatttgatagattcagaagtacctcaggtttctgtctccaaatactcgaatcttgtcaagcatcaccatttctgcattaggcctctgtaacttgacactcggatgcatctttggtctctgatttagaatataggctctggaaagttgatattaaattctgattctgccagttcctgtctgaataaccttgggcaagttacctaacttccctgtgcctcaatttcctcatttgttaaacaaaaataaaaacagcatttctctcatcggtttgttgggatgatgaggtggaatctaaatgtgaaacgctgagcacaagagctggcacattctgagccctcaggtattgccagttagcatcgtgactgcagggaaatagtacattcctttatttttgttgctctctcctgggacattcttcttcctgtgttgcctggccaccttctttcaaaactaagtgtaagtttcttaagaagccttcccggctgggcgcagtggctcacgcctgtaatcccagcacttggggaggccgaggcaggcagatcacgaggtcaggagttgaagaacagcctgaccaacatggtgaaaccccgtctctactaaaaatacaaaaatgagctgggcgtcgtgtcacgcacctgtaatcccagctactcgggaggctgaggcaggagaattgcttgaacctgggaggcagaggttacagtgagccaagatctcaccactgcactccagcctgggcaacagagagagactccatctcaaaaaaaaaaaaaaaaaaaaaggcctttcctaactttaaacagacaagaaagagaagaaatagggagtagagggcagacatggctccaccttcataccccaacaccctcagctgagcattttctgcactgtatccaggttagcttattcccatgagtgtccactacccccaccccacacaaggtcataaatctggcagtctgaaccccatcttgtttgtgggtcctggttccagccacacaccatacctggctttcaggaatgctttctctgctccagatacatcctacctcctattgttcccgaagttgtctgtcaagttttgtgtatggaaagtaattcataccttcatcagatctcaaaagaagctttacacacacaagaagaagttgaggtgaggatgtggaggaattggaaccctcatacactgctggtgggaacgtaaaatggtgtagtcactttggaaagtagtttggcatttcctcaaaatgttaaacatagagtcaccatatgacataatagtttcattcctatgtatatacataagagaaatgaaattagttgttcatataaaaacttgtacatgagtgtttattgcagccttagtcataacagccgaaagtgtaaacaacccaaatgtccatcaactgatgactggataaacaaaatgtataaccatacgatagactgttcttcagcaataaaaaagaataaagtagtgatgcatcctagaacatgaatgaacctagaaaattttatgttacttgaaagaagctggtcacagaaaaccacatattgtattgttccatttatatgaaatgtatagataaaccacagagacagaaagtagattagtggttgccagggcctgtggggcagggggaatggagagtgatggctcataggcatggcggttctttttggggtcatgataatgttgtgcacttaggttgtagtgatattgcacaactcgatgagtatattaaagaaaacattgaagtatgcactttaaaagagtgaatctggattaagaaaaccattgaagtgtacgcactttaaaagagtgaatctggccaggtgcaacggctcatgcctgtaatcctaactgattgggaggccaagtggaaggatctcttgaggccaggtgtttgagaccagcctgagcaacatagagcgacctcacctctccaaaaaagtaaaaaaattagccaggcatggtgacgtgtgcctgtagtcgtagctacttgagaggctaaggcaggagatcacttgagttcaggaatttgaggctgcagtgggatatgattgtgccattgctctccagcctgggcagtagagtgagaccctgtcttaaaaagtaaaataaatattaaaaatagagtaaatacaaggtgaattttatggaatgtaaattatgtctcgataacgctactaaaaaaaagaaatagaagccaggcacagggtcatttcccagtgctaatcctggccctgtgatctctcttggcaaccgtcttcatgacaattctggaaataggcacgtccgctttgattctttttgtgctataggaagtgggagagaatgttctgcttgggaaggctcaggcatcgtgtgccttgcagcggtaacagctgatgaacctgcactggatagtaacaggaaaggggcaacctgaggcaggagggacagaggctggtgatttgttggagtcagatttcatctatttcaaaggtctttcctgtttgctttcaactgtgtaaggtcaactaatggcttgggtgtttgggtggtaggtggattcctgtaggtgcagtctagaagaaatattgttgttatggtttttgtttttttcatcacacttttccttaatttgaccttttgtttgtttgtgtagccaaaagaagacccagagagtgtcactcctctttgaagacgatgttgatagcggaggctctctgtttggctctcctcccacatctgttcctcctgcaacaaaggtattcttcatctcttagtcccaggaaatgtccttgagtttatgctgcatcagtagtggtacttccccgaatcagctcttcatacctaaccttggaggctgagtcttatggaagaccttatttgcctggtttcagaaagagatcttctgattaatagtattctacagaagaagcacacgtgcaaagccatcattcagtgtcaggtgtaggcacaaggaactgggtctcagaagaggcttgggccccattggcatggaattctgctaacattagactaggccagttaaggcaaaatcattccttttatgagtgtgtgtcgagtactaacactggtcctggtttatattagccagtcagtaaaaaggaaggaaattctcacatgtgctacaaaatgcatgaaccttgaggccgttatactccatcagtggagaaatggtcacacaggtcctagtacagttagactgtggaatactatacagtggtaaaaaaaaacccagggtggagcttattgggatgaaaaacatactgcaggccaaaaaaaaaaaaaaaaaaaaaaagcgtaaacacgtaaacatggtgtaatttaaactttacaaaacaagaaatacacatgaatgcctggaaaccggcctgaaagcatcgatagcacattgttaccagtgattatgtccagggaaaggtatggaatggggaacttcatactctcaatgcctttttaaagcctttttaaggaaggcatttgtgcattactgtggaattagaaataaactccaaacaaaaaatatctaggagatatggaagaagacccttcctgttaaatggagttgctcagcttataccagaagctctcagccctgggccagcatgctgcccaccctgggccccaggctccctgctgctgcttctacggggctcctgagcctttccttgggtgctctgtacttacatctccccctttaaggacatccagtggttgtacaattaaaggagtcaggagatctgattggtttttctttgtaaattataaataaactactctggaggataactgagcaataaattaatgaattttggagcctctggagctgtaaaacttctttcaacctatggtaattatgattgttaaataaaacaaaaggtcaagacacacaacttaagtagctgaatagcctacacgtttttgattatttgtgaaatataatcatctttagacaatagtaaataaaagatatttcttgtttacagatatttcagtgtaagttaattgtgacttggttgtaagcctatgttgaccaaaaggttaaaccacaggcaggagaacttaaagaaatgtaatgtgagttttgttttgagccaagcttgagaactactagcccagtaaagagactccacacaaactgagaatgcgtcccagagtgggccacacgagacacagcatttatacatttctgttatatagaaaatgggaaaagggggcagtgaagcaacggtgactttcttaattcagattggtgctcaatgacattgaatataagataaagtaaatatgtggttaatgtattttcctcattagccttttaccctaatgagtacataggggtcgcagttgcagggtcaggagagggatggttgattttgtgctgcctttgtgcttcatccaataggcaggttgtaatcggtgcctgtcagtgtgatatttgacagactctggccttgcaggtgaggttcagctttcgttcataggcccggtttctattacccatatggccaagatgcagccattttagacaatttttttttcttcagactttccttattttctgacacctatcaagaaagtaaatttgaccaggcacggtggctcacgcctgtaatcccaacactttgggaggctgaggtgggtggatcacctgaggtcagaagtttaggaccagcctggccaacatggtggaaccccatctctattaaaaatacaaaaattagccaggcatggtggtgcacgcctgtgatcccagctactagggaggctggggcaggagaatcgcttgaacctgagagatggattttgcagtgagctgaggttgtgccagtgcactccagcctgggcaacagagtgagactccatctcaaaaaaaaaaaaaagaaagaaaaaaacaggaagtaaacttcatgacaaggatgagcttgtcttcaagaagattaaaactggtactttgggtagcattttctgtggtttaaggaccttagttatatatgaaggaagaatatgatttgccatacttaagtctctttttgtctcccctatcaactatttgcattgaattttttttttttttttttttgagacggagtcttgctctttcgtccaggctggagtgcagtggcgcatctcggctcactgcaagctccgcctcccgggttcacgccattctgcctcagcctccctagtagctgggactacaggcacccaccaccatgcccgactaattttttgtatttctttagtagagacggggtttcactttgttagccaggatggtctcgatctcctgatctcatgatccgcccaccttggcctctcaaagtgcttggattacaggtgtgagccaccgtgcccggcctgcactgaatttttatgtagttttcagtgagtccaggatgttccacaaaagccttttcctttgatcacttcagtgttgccttatctcttctgaaattctttatgccttccagtgttcttttatgtcaagttcaatggttttgcactttacttatctcttcctaactaaaaatccccttgctctcttctttcttcattcatcacattttaaaatcatgattagcaatgtccttccttagtttcccaaatctgccttcctaacttgatttaggcattgcctcaaagcacacttcctcgtgtcatatggtatgatttgtatctgtactatactataatagagctttagttttttctcaagcacttgttgataagtcacttgctgcaaaaatgccatgaattccaggaaagtcacaaacctcagtttcctagtccccaaatccctgcctccctgataaggaagagatgagaaatgggctgaagtgcttgcagacttgtattgaacactgagttggtataaaacactgggactgtccatgaaaatatagtgtatagtcctttcagatgaacagacaaacagatgtgtgctagctgttatataagttaggaagaaagtcaaggaagggtcaagtagagagataaatattatgcttattcaacaaagcaactgacacttaactgaagaggacagagaccgtgggtgacatctgcgtgggggccctgcttgaaggatggggaggatttgcacctacagacatcgagggcagcgtggcatggaagtttgaaagtttgcagcgaccttaaggaacagcagggaaaggaggagatgcatatgagtagagggatagaatggggtatctgctgagtgtcatttgcttcatgcaaggagtgctggtttgggttgggagaggacctgatccagcaggtgttttgttttagcaagacaacgctggataatgtcttctagttgaaatataagaggagtgaggcagagagagagactcatgatcgtctggtggcagagataaggatctgagggagggaggcatgggggttgacagacacaagtagacagatacaggtgatatggtggcgtgaagtgtcctgtccacaagtcccgggtggtggtgtttgttgcttctcccttttggtgctaccttcactatcctgtcctctcttccttgatcacatttagctgaagccctaagaggatggtttgggcttgttctgtatatggccatgctggtcagacacacttttttattgttgtggatgtcatgtactcttcttttggtagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggtggactttttttcttgtatacttgaatgcatttgtctctcgtatgttgtttcaaacacacccaaccccttaagttttttgaccacagaaaataaatggcccatttgtagacagatttgaaaacatagacaagcaggctgtgtccccacagtgcaggaagcctctgcagggcctttcctcccggcccttctccaagacatgtgcgcactgtggtgtgcctgctcctgtctctgtggttactgtcacgtcatggcatctttgctttctaacttgttctcttctgtgcagtgttcctgttacccttggtcctcctttggtccccaagtgcacttgaatttaaatgtcagttttaaggagattttagtttagcatccttttacttttagatgatattggcaaggattacagagtagagtgaaatttctactctttctaaaacactagctttcaagtcctggacggtctgccgtctcttgcaggaggcctgtgggtagttctgctggccacacctgggcatccagctttgtggttgccttcagtctctatatgcctcttttctttctctaacttttcttatacgctgtgtgtccagctgcttaggtctaagatctcccagggcctgtgtgaagagcgttgcatttgcatttgctgctgaggctccttggagctacagtgatacaagcatttcatttgtacctgtgttcctgtgtgaaattctcttcctagtggctgtgtgtggaccccagtcctatcccagtcctggtccacacttgactctgactggttgctgtactgccctctccctgagtgtaagccccttgcggactaggcccagtttgttttgctcaccatcatatctgtagtactggcatattaccttgcacacagtaggcactatgttataaactttgtatttctttaaagaagcatttttttaatagtttgagtactctgaaatcgggatgtacctcataatcaatggtatcttacctgaaatgtgccatttgttgaatgaataaatactgcattttagaattatttcagagattcttcttcaattgcctatacagtgtaagccttttacaatttgagggtctgattttcctgattagatttcccccttggggcttatgtattagttaaatgctacgaattcatggtccactcccaatgattggcacttgtattggttatctttgacacttagaagttcttcctagttcatgagcaaccagtgtgcatcaggattatagccgtcctatcacttgataggagagagggacccatggtcttaatgcttggaaaagttatctttggctacggatgattgtacaagactgtctcttggagcagccaatcaagaattgacctcagtgttttgttacttgggcacagatgtgattcactgtgccctgagtcatgcaaatgtggcagttactgaattaacgagaagcttggcaggctccatgataggatttgtatttccaggtgttacttattttttccccctattattttcattttcaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaaggtaagcaaaaagcagtagtggttcaagtctctggatgagataaaagactctcatctcatggttgtcattctgtcatgtgagtttctgaaggaatcttaaccttcaatgtagtgtgttaatgattctgtgcagtcatttagatatttgggaatcttaatcaggaactcttacctcaagtagcagtgttaggataggggattagaatttcacccccctcttctgggatttacagaccttgttgttccttctagcaaaactttgccccttggccagttgtgggatgtaaacagcaggaaagggaagttaggctggagctgtacagttaagtatttctaacattcagtttaagaaaaagtgttgtagatgaacctttcatactgatcaggtgtcagcaaactatttctataaaggaccatataatgactattttagcttttgcagcctatttgggctctgtcataactgcctagctctgccattggcagcatgaaaacagccctaggaaacatgaagatggatgggcatgactgtgttccagtaagttttattaataaaaataggtgatggtcagctgggcatggtggctcacacctgtaatcccagcactttaggaggccaaggtgggtggatcacaaggtcaagagatcgagaccatcctggccaacataatgaaaccctgtttctactaaaaatacaagaaatagcttggcgtgatgacgcttgcctgtaatcccagctacttgggaggctgaggcaggagaattgcttgaaccaggaagtcagaggttgtagtgagccgagatcgcaccactgcactccagtgtggcaacagaacgagactccatctcaaaaaaaaaaaaaaaaaaatagatgatggtcattctgtgaggttagtatgaccctgatattaaaactagacagcgacatcaccagaaagctagatatcctttatgaatgtagaggccaaaatcctcaacaaaaatactactaaacccaattcagcaaaatataaaaaggattgcacattatgagaagtgagatttacccctggaatgcaaggttggttcaacatctaaaattagttgatataatgcactgtatcaataaaatacagaattaaaaggcgcatgatcatctcaacagatgcagaaaaagcttttaataaaatccaaaccttttcatggtaaagcactcaattaggcataggaggaagcttaatgaacttgataaaggacatctatgaaatccctcagctgacatcatacttaatggtgaaagactgcatgcttttcaaccctaacatcatgaacaacacaacaatgtccactcttggtaattctaatcaaccttgtactggggattctaagcaagccatgtaggtgagaaaatgaaataaaaggcattcagattggaaaggaaaaagtgaaatgaagcaatctgtatttgcagatggcatgatcttttatatagaaagtcttaaggaatctgcaaaaaacatccattggaaataaagtcattaagattgaaggatgtaagatcaatatgtgaaaaccaattgtagttctgtaagctagtaatgaacatttactaacttacaaaagttactactagtaactttcttttttttttttttttgcaatggagtttcactcttgtcccccaggctggattgaaatggcacaatcttggctcactgcaacctttgcctcccgggttcaagcgattctcctgcctcagcctcctgagtagctgggattataggcacccaccaccatgcccagctattttttgtatttttagtagagacagggtttcaccgtgttggccacgctgaccttgaactcttgacctcaggtgatccacctgccttagcctcccgaagtgctgggattacaggcatgagccactgcacccaacctactagtagtaactttcataagcaattaccagcttatgaatgaaattaagaaatcagtttcttttatagtaataccaagaagggtaaaatacttaggagtaaatttagcaaaagaagtacaagacttgtaaactaaaatctacaaaacattgaaagaaattaaagacctaaaattgatggaaagacatcttgtgtttatggaccagaaaccttaatattggtaaggtggcaatacttccttcccaaattgatttattgtaatctctatcaaaattccagcttgctttttgcagaaatggacaagctgatcctaaaatttttatggaactgtaagagaccaagaatagccaacagtcttgaaaaggaagaacaaagttagaagactcacacttcctgatttcaaaacttactttaagacaggatggtattggcataaggttaaaatatatagatcagtgaagtagaattgagagtctagaaataaaccctcacatttacagtcagttgcttaaggtgctaagatatttcagtggggacagaatagtcttcagcagatgtgccaggatgctgattatctacatgcaaagggatgaagttggacccattaataaataaactcagatccaatgtaagatccaaatgtaagaactaaaactgtacaactcctagaatctagagagtatgtgagtaaattatcatgaccttggattaggcaaagccttcttagataagacaccaaaagcacaagtgacaaaaatagctaaattggactttatttaaatgaaaaacattgtgcttcaaagggcaccatctggaaagtcaaacgaccacccacaaaatgggagaaaagatttacagatcatgtatttgataaaggactcagatccagaatatgtaaaagacttataagtcaataataaaaagacaaatagcccagttgaaagaagggataggccaggcgtcgtggctcatgcctgtaatcccagcactttgggagaccaggacgggaggattgctttaggctgggagttcaagaccagcctgggcaacatagcaagatcctgtctctacaaaaaattttaaaaattagccaggcctggttgcgtgctcctatagttctatctccttgggaagttgaggcagaagagtcctttgagcccaggagttcaaggctgtagtgggctgtgatcacaccattgcactcaggctgagtgacagaacgagaccctgtctgaaaaaaaataggtaagacagacatctgaatagagattttactgaagaagatagacaaatggccaaaaaggatatagaaagatgctcagcatcagggaagccaaaaccacagtgacataccacttcatacccgggaagaggaccataataaaaaaaaaaaaaaaaagggaagtaacgagtgttggtaaggatgtggataaatggaaattctcattccttgctgctgcaagtgtggaacagtacaaccactttggagaacagtttgctgttcttcaaattcttataacataaagctaccacacaatccggaattttattcctgggtacatatccaagagaaataaaaacatgttcacacaaaacttgaatatgattgctcccagcagcattattcataatagccaaaagatggaaacaatggctaaacataatatagtatatccatacaatggaatattatttggtaataaaaaaggcaaagtactgatacatgctgccacatggatgaaccttgaaaacattctaaataaaataagccagtcatgaaagaccacatattatgtgattccatttatatgaaatgtccagaataggcatatcaatggagacagaaagtagattagtagttactgggggctgggagtagcagtgagcaggaatggataattactgctaatggtttggggtttcttttgggggtgatgagaatattctaaacttagattgtggtagtggatacacagatctgaatataccaaaaaatcattacattttatacgtaaatgggtagattttatggtatatgaatttgatctcaatggtgatgttatgcaaaccaggttggcaggtcatagattgccaatcctttttatagatctaaccaaagaaatagtctatgtttatttctacaaaaaatgttatatgaatttttttgttataccaatactataagcttatttataaatgagagctgcacacagtgaatatgattaatttgatatattttctcccagtctcttactgtgtatggttttgtaatatttttccacagttgtgaaatatttaacattacttgctgtgttaaactcatttttatatgtaacaataataattattgttaatgtgatttattttgttagaagtaagtttttcattagtttttttggtttttttgttttgttttgttttgttttgagatggagtcctactgtgttgcccaggctggagtgcagtggcatgatctcggcccactgcagcctctgcctcccaggttcaaggattctcccacctcagcctcccaagtagctggaaccacaggcacacgccaccacacccggctgatctttgtatttttagtagaggtggggtttcaccacattggccaggctggtctcgaactcctggcctctggtaatccacccgccttggcctcccaaagtgctgggattacaggcatgagccaccatgcctggcctttttgttaagttttaatctgtggctgtgataaggaaatagggatgaattttagaatgtcaggtctggagcattatattatcaaaccaataatgttgatggtaacttttaaatgttagatatctagtaaacaaaaaagggactcactcggggtctgaaagtagggcagaagtgatggacagccataggaaggcttgtggtcgcacctgtgccaggtctttggcctgcagtgcttacaggtgagggacacatacttgaccactctgtgtagtttgtgcttgagtcagctgctgtctcttcttccctttggaaatgagatgaagagaattcattcagttgtatgttttttaccttcaaaatgtttctcattatggaactaatggattgcttttctaataaaaaatttagatactatacgaagtttatataatatatataacctggaaagattatctctaaagcttgtgcatatatatatatatgtgtgtgtgtgtatatatatatatatatatatatatatatatatatatacacatatatatatatatatatacacacacatatatatatatatgtaaactttgtatttataaatatattttctggtatttttggaagcgccatagcattccattttgtcaatgtttcattcccctactgagtggcttttaggctgtggccagccttttgctaatataatacagctgcaggggacatctttgttgtgtccatctttacatatgtaacttccttgagataagttcttacagctctaatcacacatgaccttccctcctgttcccagggctgcgatcctgatgcccaccccaagagcacaggtgtcttccaggatgaagagctgcttttcagccacaagctccaaaaggacaatgacccagatgttgacctttttgctggcaccaaaaaaaccaaggtcagttccaaatggttccccacagtatgacttgttattgtattgggtgctgtctcaacagctcacctagttctctttgtaaattgttttgcttttggatattgaacttgggtcttgtttattctagctgttagagccaagtgttgggagcctgtttggggatgatgaagatgatgatcttttcagctctgccaagtcccagcctttggtaccagccttttgttctcaatactgggttgtgtgggaaagattctgggaaaggaaactaacgtccagttagatgattaaggaaaatcctaggagagtcgtgctgcttcctgctaaatgaatggcaaataacatgccgaggggagcgtgtgtggaggatgcaatgcttagtttctgttgttcctcatcttatgttccctatactaacattaaaacattaataatccaggctctctgactgtactacacatctgtgtgatgtttaaatggttgattgaaagaccattgcatacactggggtggctaaatattcgtgcctttcaggtgcaaagctttgaatctgagttttagcctttctatgtcattttctcccccagccccagtaggtttttgtaagtactctgttttctttttatcatagagaggactcctgtgacagccacagtcttcagaatgctatttctgaaatgctacctttgagttggttcagccctcatttgagaaagtatttttaagactcagaagccaggattgttttttgcattatgatttttccttaaaacttctaagatatttgatgcctttttggtattttttttcttttgaaggtacaagagaaaaagagagtagtgaaaaaagaccactctgttaactctttcaaaaaccagaaacatcctgaatccattcaaggtagtaaagaaaaaggcatatggaagccggaaacacctcaggttagaaatcctctttaaggattttcagctcttgtttgcatcccagtacagagaaattccattatgcagacccacagttatttagacttgtctgcattaaggaggaaacagcaaccagggctacagctttgtcttcactgcacttcccccgagtcatctcccctctcctcactccacacgccagagtttcatgaatctatactttaatagttagtgttttttgatgccatgccagatttgactctgaagtggagttaaggtaggatgaagaatcttcttcccactaaagaatttatttctccctctggatttccttggaatagaattaaaatagaaataaatataaattacatctgatttcctgcctgctctcagtgttgcctctcccgaggtcattgctgttgggccgtactctgcagcagtcttctcagaacgctgtggagctcctcctgggaacagcccaggactggagagcgagtgacagttccacgtgcaggtgtcccagggtgtctcactgaagccttagtgtcctgagccgtaaacctgaggcacttggacgaacacatcaccactgacccttcctggggctcagatcttttgcttttagagccagtgcattaggctatggttgaatttttgtgtgctccttgaaatttctatttgataaccaacatggtaattttgcctgctggtcagttttaggtgctctgataaactgtgactcttgggaatcttactcatcttgtattccttgactccatatctgatctggcagctttccacttatgtgacagaggaggaggcatacgtgaagtagtgctagtgaaacatcaggccccaggagagatttgaatgcctttcccattaaagagctacagaaagtgacagttttgctccatcacagatttatttacaggcataagaaacacttgtctttctgtttcccaaatggatttttaactggatgtaatcttacacaggactcatcaggtctcgctccatttaaaaccaaagaaccatccactcggatcgggaagatacaagtaattaaaacactggaatcttcattgcctgccctgtggcatctataaacttttttgggtttcctactcttgtcagctgctgccaaacatcttctcatctcttcccccgcctcccctcccctgcacctagttgttgtctcctgtgtgctgcgtctttaacatctattctttgagcccagtggtgggcataggtgtaagacgctctgttttaattctgagactagattgggcgattttcctacgtttctctactcctctcgtattatacattatgtgtaccgaatcttgtcatgtgtcacaataaagataatagactgctgtgttgaagaacaaatacagagtttcatttttcttctttaggcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaaggtgatgaaaccatctttgcttccttgctctcttcttttaaccagaacatgcatatgcttctttctagtttatcagttgcatacacagcagtctttgactctccttttgaaggaggtgcctcatccttccttcagccgctcccccctccattctccccacccccctcatcctgcacctgcttttccatggcctgcatttggtacatttgcattctgctcagtagccacagtaacgtctcaccactttggctggtgtctgacacctgcaggtttccagcactgccacctgggggtcttctaaccacagagcagatcatgcccctcctgctggcgcttcctcactactccaaggagagcattcgggctcctgggtttggtatgaaacccctttgcaatcggtgccagcccatgtgtgcagcttcctcactagtcacttcacactttccagcctgactccaggcacaccaggtgccactccctgaacacacatggtctgttctgctgctgcccaaggctcctgctgcctcctcaccaggaatgcccctctctgtccacagctgtgcttccacatccccacttctgtcactgtgccctgcactccctgcaccaagttcccacagcagcgacactgtttcatgggatctcctcaatggactgtgaactctttgaagttttcctttcattgtagttgggtttcttgtttctatccagtctcccttctctagaaagctttaactgatctgcaagtaagtgacaggacacagaatgacctaccctgacaaatagattcatttcaaatgtttgcaaacctgtttccttgtgcaaaacaaaacagccttccttttaacgacaattttcattggctttttttttattaagtttaaattggcaactaaaattgtgacattcccctgaagttgacaacacaatcatactttgcccagagtagattgtagcttctcaaaattctacttgattgtatattttggaaactatcataaactgcatcattgctactaagtgattcatgttttgagattatatgaaaagttctgatttctaagccatatttcttatgtggaatatttaacatttgaattcaatgtttattgacttgaagaaaacagcaccttagattacctctctttattgtgtcatgtttctccccgctcctggagcctgaatttagactagccccctaacaaaggttagtaccagaattccccgattctttcttgttttgaaagatacccacgtttctgttgagggtagagtaggggccaagggaggggttgtgagacacagagagccaacatgcctactttccaggtttccagcaacagatgaaactttttgtgtgaaactgaactgaaactgccctgaaaagattaaaaaatggagaactctaaaggattaagaatgacttagtcttggagtactaggagctattaaactccttccttggaaatcattaagaaataacctcttctatgttcttagataatatcttcattgaagtagaccagataaccttacaatattttgagtcactgattctttgccatggtagctttgaacactttattttatcgtcagatcaatgtatgtttttttgccgttgcagagccgtgtcaagatgagagggaagcgtagaccgcagacccgtgcagctaggcggctggctgctcaggagtccagcgaggctgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacacaagcccctttgcaaagtctctgggtcattccagaggggaggctgacctttttgattctggggacattttttccacgggcactggatctcagtccgtggagagaacaaaacccaaggcaaagatagcagagaatcctgccaacccaccagtgggtggtaaagcaaagagccccatgtttcctgctctaggcgaggccagcagtgatgatgatctctttcagtctgctaaaccaaaaccagcaaagaaaacaaatccctttcctctcctggaagatgaggatgacctctttacagatcagaaagtcaagaagaatgagacaaaatccagtagtcagcaggatgtcatattaacaacacaagatatttttgaggtaataggacttaacacgtttttgtgtctgttctaagttaaggaaggtatctgattggcttatttgagccatagattatgtctagcttgttgcgtgcataccccatagccacttgcttagtaattataattaggctcttttattaataagtctaacattgattcagaagtggttttttgttttgttgcatgtagaatgtatttcttggctggccatgatcattgatactgatcttggtttctctagtttttacagtttttttatttttatagaatattgttgtaatcagcttcctgggcatgccactcggtgacatggcatacagctccactggtccagcttgggagtttaacctctggttctggggacattggccctggctggagctgacaatgtagtgcatgcaggcaataagactttcagtggcatttgctcagcagatgtttattgagcacctggggactgcaggcacaaggtgaactcagagaagtgctaggctcctcagagctctctgggaagataatcaaatacaaacagggcaatggataattaagatgttttcaaatagtactaagtgtcatgaagaaagtaacctggggcagagtggtgggtagggctgggaggtgctcctttaggcaggactggtagagaaggtgtcactgcagtggcggcatttgagccggggtgagatgcgcgggccaagctgtgcagagatctggggtagtgcatcccaggcagagtgggcagtctcgaggccgttccacacaccctggccaattgcatttccatagcttgttgacgtgtttgagtttaaaaagaaaaattgatttaacattgttttgtatgtatttttggcttaacaaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatgggtaagtttggttttctacatctgacctagagaattcttacctttccatcacttggtatttttcctgctaccttttcttggcccttttctggaaaatgcaccccagcgggttcacttcagtgtaatcctgagttaggctgaagataggtaagagatggactaattattttagtgaagtaactctttcctatgatagtcatcaaagaatttgaaggcacccagagtttgatgtttaagtataatttaactttgatctcagtgcacctcaccaatcatctgtgacacaccctgatgttatgtaaggaggtttgatcagaaatgacctcacgtgctaaagtaggctgaggggactgccttgggtgtgatgtggttggttgagtcagagctccagatggacagggagtgtccatggttctgtgcgagaagagagcaagtctagacctgggtgtaggctctacctcaggcgttgcatttcactgaggtctttggtgtttgggaacaagcttgtcttccttatatggcacaacttctgctttattagtagacaaggcaaatgcccgagaaccctaaatattggacttttgataaatcctgtgggctgagccacatacacatttcctactccccccgtcaatctagacctttagactaactgggagacagctggtgctgcagagccacacactggctctgtgcctccagcaagccgtatgctctgtctcccctgcttcccaccacatggaatgcagaagggaactcattcattattttaaatacaaaaaaagtaatacatgcttattgtaatagattcatgcaattcagaaaatgtaaaaagtgaataacccctagaggtaatagtaacagtttggtatgtatcctttcagacacagtgatattaatatatgtttgtgtacacatcaatatatacccacctttttaaaaagtaagaatatatttccctattctgctctgtcttttagttacttaatgtcttttcatgtcagtacgcagagatctccttccttgttttcagtgctgtgcacgatttctttatatttagccattagcctgttgacggcaatctcgattgtttctgttttctttattacaaataatgctgtggtctttaccatttgtgtacacctaactttatgtatacatgctaaaatcatggttggataaaaccctagcagtaacattactgggtaattaccataattagataagacaagcttttgagtcagtgaaacactaaacgaatgcagtgacggaggcttacagtcttacatcgagatgcctcaaatcagtgcatttattctgaaagaaaacaggtgggtcctatattggatttccctttgcatatttttattgctcttttaaaacccagtatgaaaagaatatctaaataagtccattgtccctgatggtaggggcgtgggctggtttggagatcaagttacccttcccttttttctgtcctgcacacgcacatacatacacttttgtagctgaagaaattgtgctccaagagaaacctgtgtgtgatcataaaatttaatgagtaacaaacacagaaccagaatctaagaggcttgagttctaggttagtgttttagggtactccatgctgttacgagagctgggtctttggtggtttgcttgcatgtgtcttaaaagtacctttctccacccctcttcagcaactgtttttcttttttctttctaaagatgacatcttctccactggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgttatatggatgggaaccctaacttagggcttgggcaggggaaagagaaagaagatgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaatc

SEQ ID NO: 38060 - DNA, 6258 bp, Homo sapiens
gtgaaaggcgccaggtgccagtcctggcctctgatgtaacccagcgccccgcagtcccgacacagattcctggatctcagccccatagcagctatgatcccgctgctgctggcagcgctgctgtgcgtccccgccggggccctgacctgctacggggactccgggcagcctgtagactggtgagtgcgcagcggggggcctaccatcgccccggggtccggctgcggtcactcaaccgggatggctacctcctcggggaaccctggggtgccttctcttccctctctcctatttctgtgcattctccgacctccaggttcgtggtctacaagctgccagctcttagagggtccggggaggcggcgcagagagggctgcagtacaagtatctggacgagagctccggaggctggcgggacggcagggcactcatcaacagcccggagggggccgtgggccgaagcctgcagccgctgtaccggagcaacaccagccaggtgaagggggccccgggccaactaggggcgaaactctagggctgccctgcctgggaggaatttcacgttgcctccgtttatccgcccgcagctcgccttcctgctctacaatgaccaaccgcctcaacccagcaaggctcaggactcttccatgcgtgggcacacgaagggtgaggcctggattgggggctggggagagactcgggtcccatttttccaaggtaacccctgacgtgcatggggtggtcggggagatctgcactgtcagaccctgggcatctattccccccaacttttttttttctttgtttttgagacggtgggagttcgctctgtcacccaagctggagtgcagtggcacaatcttggctcactgcaatctctgcctctggggttgaagcaattctcctgtctcagcctcccaagtagctggtattaaaggcgcaccatcacaccaggctaattttcatatttttagtacagacgaggtttcaccatgttggccaggctggtctcgaactcctggtttctacctcaagtgatctacccgccttggcctcccaaagtgctgggattacaggaatgagccaccctgcccagccgagttcctatgcatttttccaagctaacccctgacctccatagtggggtgggagatctcccctgtcagaccttgggcatctatttcccctattttattttcttttagacaaggtctcacccagtcacctaggctggagtgcagtatcacagctcactgcagccttgacctcccagggctcaggtgatcctcctacctcagcctcccaagtactgggcctgccggtaccccccaccacgcctggctttttttttttttttttttttttgcggcactctctctccatcacccaggctggagttcggtggtgcaatctcagctcactgcaatctccatctccccagttcaagcgattcttctgcctcagcctctggagtagctgggattacaggtgtgcgccaccatgcccagctaaatgttgtatgttttagtagagatggggttttaccaggttggacaggctgatattgaactcctgacctcaggtgatccacctgccttggcctcccaaagtgctgggattacaggcgtgagccaccacacctggcctactttttgtatttttgtagagtgggcttttgccatgttgcctaggctggtctctaagtcctggttcaagcaatccacccaccttggcctcttaatgtgctgcgattaccggcatgagccgccacacctggcctgtttccctaccttacattactcttggcgttattctggactataagaatttatgcctgcaaaaactgagctcagctgtggttctaacactgctggcaccctctctaagccccgctgcaaactgagggtgttcctgattgcagatgagcttgctgggaggcctggagcaataccctctaattgccttttttttttttttttttttgagaaggagttttgctcttgctacccaggctggagtgcaatggtgcaatctcggctcactgcaacctccgcctcctgggttcaagtgattctcctgcatcagcctcccgagtagctgggattacaggcatgcaccaccatgcccggctaatgttgtatttttagtagtgatgaggtttctccatgttggccaggctggtcttgaactcccgacctcaggtgatccgccctcctcggcttcccaaagtgctgggattacactgcgtggggcctgccttctttttttaaatttttatttatttatttatttatttatttatttacttacttacttacttatgtttgagatgaaattttgctctgtggcccaggctggagtgcagtggtggatctcagctcactgcaacctccacctcctgggttcaagcgattctcctgcctcagcctcctgagtagctgggattacaggcgtccaccaccacgctcagctaatttttgtatttttagtagagatggggtttcgccatgttggccaggctgatttctaactcctgacctcaggtgatctgtgtgtctcggtctcccaaagtgctgggattacaggcgtgagccactgcgcccgacctcccctaatgccttcttttggtccaggtgtcctgctccttgaccacgatgggggcttctggctggtccacagtgtacctaacttccctccaccggcctcctctgctgcatacagctggcctcatagcgcctgtacctacgggcagaccctgctctgtgtgtcttttcccttcgctcagttctcgaagatgggtaagtcgagtcagggacacaggatgagtcctgggtttactgaccagaacctggaacgatcttgcatttcctcctccccttgtcctccaggcaagcagctgacctacacctacccctgggtctataactaccagctggaagggatctttgcccaggaattccccgacttggagaatgtggtcaagggccaccacgttagccaagaaccctggaacagcagcatcacactcacatcccaggccggggctgttttccagagctttgccaagttcagcaaatttggagatggtgagtctcaaggttgagggttggagagctccttctctgcagacagggtgactggtgtggccatggctgagttcaagtcagcggtagagaccaggtctgtttgggagctataatcacatgatcagtgaacagacctgggttcaaaccctgggttttgctgtgtgatgtataacttcacctgagccttggtctactcatctgaaaaatggggatactgacatctacttaaaaaattgtgaatgaagtggtacctgtaagtcatttgggtgccagaggtggtgcctcactcctgtaatcccagttacttaggaggctgaggcaggaggatcatttgaagacaggcatccaagacaagcctgggaaacatagcaagacctcatctctacaaaattaaaaattagccaagcaacttgggaggctgaggcaggaggataaattgagcccagagtttcagactgcagtgagctataatgactccactgcactccagcctgggtgacagagcaagaccctgtctttatttaaaaataaataaataggctgggcacagtggctcatgcctgtaatcccagcactttgggaggctgaggtgggcagatcacgagctcaggagatcgagaccatcctggctaacacggtgaaaccctgtctctactaaaagtgcaaaaattagccaggcatggtggcgggcacctgtagtcccagttactcgggaggctgaggcaggagaatggcgtgaacccggaaggtggagcttgcagtgagtcaagatagtgccactgcactccagcctgggtgacagagtgagactgtgtctcaaaataaataaataaataaataaatacaaataaataggccaggcacagtggctcacacctgtaatcccagtcgaggcaggaggattgcttgagcccaggagtttgagaccagcctgggcaacacagcgggaccccatctctacaaaaaaaattttaattagtggggcatagtggcacacacgtgtagtccccactactcaggaggctgaggtgggagaacagcttgagcccaggaggtcgaggctgcaagtgagtcatgatcctgccactgcactccagctggggtgtcaaaatgagacccagtctcaaaataaataagttaattaattaaaaacactcagggccggacgcggtggctcacctgtaatccccacattttgggagaccaaggcgggtgggtcacttgagcccaggagttcaagaccagtctggccaacatggtgaaactccatctctactaaaagtacaaaaattatctgggcatggtggagggcgctggctgattacacggtcaggagtttgagaacagcctggccaacatggtggaaccccatctctactaaaagtacaaaaattagccgggtgtggtggcgggcacctgtaatcccagctactcaggaggctgaggcatgagaatcgcttgaaaccaggaggcagaggttgcagtgtgccgagattacaccactgcactccagcctgggcgacagagtgagactctgtctcaaaaacaaatttgggaagggcaattaatattaatgtcatcattcccaggactgggaattgacaactgagctcagaaatatggaaactgtggcagggcgcggtgacacacacctgtagtcccagcattttggaagaccgaggtgggcggattgcttgagatcaggagtttgagaccagcctggtcaatatggtgaaacccctctttattaaaaaattagccgggtatggttgtgcatgcctgtagtcccagctactcagaaggctgaggcaggagaatcacttgaacctcggaggcagaggttgcaatgagcctagattgcaccaatgcactctagcctgggcgacagagcaagactccatgtcaaaaaaaaaaaaaaaaaaggaaatatggaaactgagctgagagaggggaagtggactagggactccctcgcagtggccctgaccctacctgtgccctctctccatcctttgcagacctgtactccggctggttggcagcagcccttggtaccaacctgcaggtccagttctggcacaaaactgtaggcatcctgccctctaactgctcggatatctggcaggttctgaatgtgaaccagatagctttccctggaccagccggcccaagcttcaacagcacagaggaccactccaaatggtgcgtgtccccaaaagggccctggacctgcgtgggtgacatgaatcggaaccagggagaggagcaacggggtgggggcacactgtgtgcccagctgccagccctctggaaagccttccagccgctggtgaagaactaccagccctgtaatggcatggccaggaagcccagcagagcttataagatctaacccttatggccaggtgcagtggctcacgtatgtaatcccagcactttgggaagccaaggagggaggatcacttgaactcaggaattcgagaccagcctgggctacatagtgagaccacatctctactagaacttaaaaaaagttagccaggcacggtgataaatgcctgtagtcccagccactgaagccagaggatcgattgaaccagggagatcatggtcacagtgaactatgattacgccaacctgggtcacatagcaagactctgtttcaaaaaaaaagggggggcgggggacgggtgggtgcagtggctcacatctgtaaccccagcactttgggaggctgagatgggcagatcacttgaggtcaggagttcgagaccagcctggccaacatggtgaaaccccatatccattaaaaatatttaaaaattagccagacatggtggcacgcgtctgtggtcctagctcctcgggaggctgaggcaggagaatcgcttgaactcgggaggcagaggttgtcatgagctgagctaacaccacggcacttcagcctgggtgacagaatgagactctgtgtcaaaaaaataaaaaataaaaaatctaagggctcaggaaccagtttggacttgattttgaatcccagttcatccccttcctagctgtatgaccttgattgtgtgccttaaccgctctgtgacacagtctacctgtctgcaaaatgggaaacataatacctgccatcaggattgttgaggagtaaataaatggaaattggtg

SEQ ID NO: 38061 - DNA, 45878 bp, Homo sapiens
ggcggcggacggggactggcaggatttctatgagttccaggagccggcccggagcctcctggaccaggagaactgtaacgcgagccccgagcctggggcggaggcgggggccgaggcgggtgggggcgccgacggtttcccggccccggcctgcagcttggaggagaagctgagcctgtgcttccgcccctcggatccgggcgccgagcccccgaggacggccgtgcggcccatcacggagcgcagcctcctgcagggggacgagtgagtgcggggccccggccgggagtgggcgggagcctcccctacccctcgcccgaccggcagccctacggccgcagctcctccctgcgccctccttccgcccggacgcgggagtccccgccctctcgcctccttcctccggccgtcggcctcggctcgcccagcaatttaaatcccctgccccccgccgccacgagccctgaaaacctccgcctcggtacctcccgccctccttcctgcaaaccaaaccctcgtttgtattagaagggaatcgcccatgcagagcccatagttagagacggcacctcctggggcacctcctggggcacgtgtgtcgccattcattcactcaagtcgcatttattaagcacctgctgagtgccaggcgctgcttcgcacagggaacaccaaaacgactgggcactgtccctcccacttaggacacaacgtaggatgggagatagatttgtaaacaaatacatgtatggatgtaattagcgctgcaatggttatatgtaccaaatgtgagagacttaaaagcgtgtgtcttggggagagtaaggaacgactttataaagaaatgtgcaaacgagatctgactgatgagtgggagtgtgcctggcaggtggaaaaaagtctaacgttctaggtggagtatattgcctgtgcataagtaccaacgtgcgaggcagcatttagggcacaggaatctgtgggacccacccgggagccctggtagagtgcgagccgccacagagacgaaaacgaagggccctgcttactgatggtaacgatcgcatggtctggtggggagaccaaggcatacacaagtaatattaataattacagaatcacctaagagcaatgataggaggttcacggggttttatcacagctgggagaggtgaggcgcagagttcctgagggcactttttaaaccacctgagccgcaattataatttggttaagtaagagttgtaattaggtaccatggttttacccccaaaagatggtaaataggaatggtgagagtaaagggacttgagcatgttgtgtatatagggggagaggagcctccggagaggctgaaggtaaaatgagtggaataagattgggcgcggtggctcacacctgtgatcccagcactttgagaggctgtggtgggaggatggcttgcttccagcagttcgagaccagactgggcaatatcgtgaaatctggtctttacaaaaaaattaaaaaaaaattagtgaagtccggtggcgcatgcccgtggtcccacggacccagctgcccggaggctgagatggcaggattgcttgagtcctggaggcgaaggttgcagtgagccatcatcgcacaactgcactccagcctgggtgtcagagcgagactttgtctcaaaaatgaggacatgggaaggaatggattttcagagcattgatgggatggagagactcttagaggttagggaagaatttttgagagacaggacaggagtcacgggcacggaaaggagtttccagcctgattgtctcctttcctttgtgaaacaaacagatttatcaggaataaggtaggaagcttgtaaagacagccttgggagtggggcctgtaaacatggctgagcagtggtgcaggcccacctgtgtttggagaccatctccttttattggttcctcagtacagtgttctgcccaggtgtagagaagggaaacacttataattggattttatacacacatgcatgccgtcagtagcaaaagatgacatttttggaagcctgttcccaaagagaagataattttatgtatatgtagatttagatactctgaatcactaaacccaggacacattctggatttaaaaattagtgtagatgtattatgtatttgggtttttcaagagtagctgacttaaatcaattagaggattgtacgtagatcgttaagagtttttgtttcacttagaccgtcaggagagtaggttattttagcctttgcttaaaaatattttgtcgctcttgttaatggtatttagtagatgatatgttggtggtaatgcatgtctcttgacttgggaatgcatatgaaatctctttttttccgggagttgggagctggtcatcactggcattgtcccttttatattgcaaaaacatactcatcattgcttgatagtctgttccagttcccttttcactagatataattgataattgttttactcagatattgctgtgctttaggtcaaggggtccccaacccctggtccacagaccggtactggaactgggccacactacaggaggtgagtggctgagtgagtgagcaaagcctcatctgtatttacagctcctccccattgcttgcattaccacctgagccacctcctgtcagatcagccacggcattagattctcataggagcgtgaaccctattgtgaactgcacaagtgagggttctagtttgcagacaccttatgagaatctaatgcttgatgatctgtcactgtttcccctctcccccagataggaccatctagttgcaggaaaacaagctcagggctcccattgattctacgttatggtgagttgtaaaattatttcatgatatatgacagtgtaataatagaaataaagtacaccgtaaatgtaatgtgcttgaatcaccccaaagccctccccgacccttggcacttcatttaacttctctgagcctcagcttttgttttggttaaatatggattgtatttacgtactgaggttttacttataagagtattctgcaggattcgatgttggcaggactttgacctccttgcaaaagagctgtcctgaccgttgtttacgactggttgtaatacttggtgataaagatgaaggcagttcatatgtcttgactgcagaattctagaaatctttcactagagttgcctctgtgtccttccaactaccattgttttgaccttggtggagactgttagttggctttcattttcttggaagatcaaactcactgacaggcacttctaagtgaaatattccatcccatttgcctttttcttatagccttgtttaagaaggagcaaatcagcagacaaagcaaactcctcaaattctggactgtcttcacctgctagtgtatcctgcttaaattcctgccaggattaggtctatagtcagtgatacggtttggctgtgtccccacccaaatctcaacttgaattgtatctcccagaattcccacgtgttgtgggagggatccagggggaggtaattgaatcatgggggctggtctttcctatgctattctcatgatagtgaataagtcttacaagatctgatgggcttatcaggggtttccgcttttgctccttcctcattttcccttgctgccgccatgtaagaagtgccttttgcctcctgccatgattctgaggcctccccagccatgtggaactgtaagtccaattaaacctcgttttcttcccagtctcgggtatgtctttatcagctgcatgaaaataacctaatatagtaagttagtaccagtagagtggggcgttgctgaaaagatacctgaaaatgtggaaatgactttggaactggggaacaggtagagattggaatagtttgaagggctcagaagacaggaaaatgtgggaaagtttggaacttcctagagacttgttgaatggctttcccaaaatgctgacagcaatatggacaataaaatccaggctgaggtggtctcagatggagatgaggaagttgttgggaactggagcaaagatgacccttgttatgttttggcaaagagaactggtggcattttgcccctgccctagagatttgtggaactttgaacttgagggagatgagttagggtatctggcagaaaaaatttctaagcagtaaagcattcaggaggtaacttgggtgctattaaacgtattcagttttataagggaagcagagcataaaagtttggaaaatttgcagcctgactatgcgatagaaaaaaaaaaaacccattttctggggagaaattcaagctagctgcagaaatttgcgtaagtagcaaggaccctaatgttaatccccacgaccatggggaaaatgtctccaggccatgtcagagaccttcatggcagctcctcccatcacaggcctggaggcccaaaaaggaacaagtggtttcgtgagctgggcctagggtctgcctgctgtatgcggcctagggacttggtgccctgtgtaccagctgctccagctgtggctgaaaggggcgagagtacagctcaggctgtggcttcagagggtgcaagccccaagccttggcagcttccatgtggtgttgagcccacaggtgcacagaagtcaagaattgaggtttgggaacctccttctagattcagaagatgtatggaaatgcctggatgcccaggcaaaagtttgttgcaggggcagggccctcatggagaacctctgctagggcagtgtggaagggaaatgtggggttggagcccccacacagagtccctactggggcactgcctagtggggttgtgagaagagggccgctgtccatgagtttatcaggggtttctgcttttgcatcttcctccttttctcttgctgccaccatgtaagaagtgccttttgtctcccaccatgattctgaggcctcctcagccatgtggaactgtaagtccaattaaacctctttttcgtcccagtcttgggtatgtctttatcagctgcatgaaaatggactatacagtcattcagtgtttgaaaatttcttatccaggaaggtatgagccagaaacccagcaagtttagtagtccacagaaacccagcaaatttagtagtccacagacattgcctctaattctacttcactggcattagaggagatattccaacagagaggagaataggaatggactgtgcatatgggagctttgctgggtagatgagttagttctctagagatttttgggttcacatttttattaaggctaattttattttttattttatttatatatttttagagacagggtcttgctctgtctcccaggctggagtacagtggtgccatcatagctcactacagccttgagctcctgggcttaagcagtcctcctgccttaccctccaaaagtagctgggactgcggcacatgccacaggcctggccaattttttttttttttttttttttgtagagatgtggggctcccttttgttgcccaggctggtcttgaactcctggcttcaagcaatcctcccactttggcttcccaaaatgctgggattacaggcatgagccaccaggcccatccctaacgtgcattttaaagccaaacatcatttgggatgttatgcttttagccgttgcagtcctattgcttctttttagcgcccaatccctatttgttaactatgttatgtctgtattttaaaattttcattcttgggcttaatacctaggtgatgggttgataggtgcagcaaatcaccatggcacatgtttgcctgtgtaacaaacctgcacatcctgcccatgtaccccggaacttaaaaaaaaaattcattcttatgtttatgccccagccaggattgtttttgtatcctagtgtcttacacacttggaaagaaagcctattgcttattcacaattagatacctaataaacattttagggtgtttttttctacatgacatctttgtgtatacctctagctagtaagtagcttgtatgtttagtgtttgattttacgtatcccaattagatttcaagtcacttgtatctctgaactttagtttttcataaaacatcatgttttattgtgctgattattactttggtattgaaacctgaattttggttgtgaaatttgagtttggtgttcttatctggtgtggtttgggactctcttcaatacacctcatttgaattaatgcttagagtaatggagctggaaggagtatctgcttcttgtccaggtctctcatttatagaagggcagaggatacctagggaggttaaggggcctggccaatgactcgttatttgaagaaggatggagatgagagtttgtttccctagtctcagtcaaatgcccttaccatttgaccctcttgcctccctgtaatgctgttgggtaataaggtcaggtaactgcattggatagagcctgggtgtgttttattgtgaactccctctctttctcctttttgttgtatctgccttagtgcttagcttctttattacaaattagatattaaatcctgttctcacattgagagcgaattctttctccagaaaggataacaaaccttttgtttgagagagatttttcactttttgaaatggtctgtttgtttgaagttacagaagaaaaataagtgtaatgcacagttgtatttattattcatgtgaccctggaaacatttcttccccgccctgtgtttcagtttcttcatctgtaaaatgaggttaataatggttcccccttctaatgttgtttttgaagattacatgagttaatacatgtaaattgcttagaacagtgcctagcacctaatataatggaagtgttgcctactgcctattggcagttttctgtacggcttcaccttcccttaggacttcttgtcagcccagttatgtgatttttcacctcgtttttgtttaggagactctactttgttgatgtttttctgagaaacaatgtgctgtctgtttttctctgtttcctttgacatttgctgttcatctttcactgaatatttgtttaagaaagacatacagaatgttaattttcattgattgtagctttcttctttttaaggatttggaatgccctgacagataattatgggaatgtgatgcctgtagactggaagtcatcgcatactaggaccttgcacttgcttactctgaacctctcagaaaaaggggtaagttaggaattgaaccaatagtgtttgaataactgatgctgataatagaactaaaacagtagcatttctgcttaacacagattcactgacctgcctctcatttctgaaattatagcagtttgggtggctctgtcttgatgtcttggctgtagggccatcaccttgctggcacattcctccagttcttctccagcacactcattttttatgtgtagctaaatttccatcacaatttttttttttttgacggagtctcactctgttgcccaggctggagtacagtggcttactacaacctctgcctcctgggttcaagcgattctcccacctcaaactcccgagtagctgggattacaggcatgagccaccagtcccggctaatttttgtattttcagtagagacagggtttcgctgtgttggccaggctggtctcgaactcctgacctcaggtaattcacctcccagagtgctgggattacaggtgtgagccactgcacctggcagtgatgatgcactgaaacactcagtaaaatttggtgcactgaaaccctcagtaaaaatgctagcctttggtttaatatactgagagtattggaatctcaacacggagttaactttttaatgagtgtagtgacctgctagacatgatatgttgtcaggagactgtgtattcctgtgaatactggagaacctttaaaagatattttagttcttggcttttaaaatacggtcttggctaacttacctttcttggggtctcctgtgtacatcctggtattgtaaagtgaagatgtcttgactaagaagtgtgagcacgagtggtgggacaggtagggaggcagaaaagggttgagaattacttgaaatggaaaatcacagtgttaagcttttttaaatctgatgagaaacatatccaaattatctaagtttcagggcctggctgtttaagttccttatcaaataataatgtaaactcatgccagatcttcttgcgtgctctatatttcattaagtgtaattatgtgattattgagaatatagtgcagtaggcctgtcactattttacatagtattgttaatgttttgttaaaaggattttcttacatatgtgatcagaaaagcctactgttattattttctagtaaaatgtagaattctggctgtatttcccagtattcagtagctatggaaatcttcctgactgtgccagtcattaatcccattaagctttgcagactgacctggcatatatttaatgaaaaggaataaaatgagggatcttttgctctgtcttgtttacttaggtcctggctatcattttgggcttagttcaagtttcccttcctctctgaagcttcctattactgttttagcctttgctgatctcatggaattatacaattttagagttggaaggggctttaaaggacacttaatccagcctctcacttggggggaatcctcacctccagcatctctgacagatggtcatttagccatggcctaaattcctgcacggaaggaaaacacactcccctctaggggaactgatggcacttgtggggttgtgaactttgaaaggacttgttatctgtgccacggggtttagccttgctgtctcatgggtgctagtccccagatcactttgtccctgtctctaaaattaccactgccttctcttgttaatcatatgtttctgggtctgtcactagattgtgacttcccggcaggtatttgtatttgtctttatagtaactatactgttcctggcacatagtaagtttgaagatacctttttattgagtgaataagtgaatagccttgtcagtgaaactgtagggccagagatcgtgatagaaaggttttaaaaaaatattttctatgttatttaaaataatgcagaatgcaccaaaaccagtccatgggtactacttttttgacatattaaaaaatagcatagaagagtttccattcatagtttcaaagtcaggcccattagcagcgtgagtgagacagtttaatccaatttcattgactaaatgtacagcgggcccaccatattctctggtttcacatctgctgctttagccaactgtggattaaaaaacttgaaaaaaaaaccccacaataaaataacaacacaacaattgaaaataatgaaaataaaaaaccgaaaaccgatacaatataactttataatataaatattgtatagttatatacaatataactataaaccatttaccttgtattaggtattataagtaatttacatataatttaaagcttatagggggatgtgcacaggttatatgcaaatactaccccactttatataagggacttgagcatctgcagattttgctattggggtgtcctggaacaaatttcccttggataccgagggactgctgtatgtcttgtattgttcttagattgcatcttgggaggttgctcccttttgctgccttttgaatgttattttcaatgccacggtaatgatatggccaaggcagtgattagtaatgacgtagagtttaatgctagtactgacattaaaaagccttacctggctgggcgcggtggctcatgcctgtaatcccagcactttgggaggctgaggtggatggatcacctaaggtcaggagtttgagaccagccttaccaacacggtgaaaccccgtctctactaaaaatacaaaattagccaggcgtggtggcgcatgcctgtaatcccagatacttgggaggctgaggcaggagaattgcttgaacctgggaggcagaggttgcagtgcgccgagatcacgccactgcactccagcctgggtgacagagcgagactctgtctcaaaaaataaaaaaaaaaacagccttacctggaaaaactcagcagatgaaagtgaacacgtgatcattcacctatcatctctctgttgtgacatgactattctggtgatgaatagaattgaaatcagaactctgtttctcagggaggattagcacacactgagtttctgaaaaacaaatgggcaataaggactatgtaagaagtcatcacgtcattctattacatggtatataattaagcattttttttttaatctggcaaagtgactgtatttaccattgccacctggtgctctgttcgtgccgtgactaagctatgtaaaatttaccctttgaaagcattctttagattattttacttataaaaccaagtgtatagaaattttttttgacaaaagaagaatggtttttgcattaaaaagagaaaaacattcaggaaaactagtttgctagattgcagttttaaatttttctttgattgaagattaagatggcacacttctaaatttgatatgtcttttttagagtaaggcaactggtatctttcaaattcttacgtgggcacattttttccatttgatgtatcttcagttttatacagggaaacagtaccaccaggtctgtatctaaccctggcattggaaggagtgatgggaatgcttggcaaagagaaggcacatttaatgctgaagggaggagtgaataatgatacccatgacagccagggctagtttgcaaagcctgaaagatattccagctcttagcatatgccatctctgtggggaatggacttggctctctctctggaaagatgatctgggatcatttctgttgtcatggaaatttattataatagtttactgttattactcatgtgttttggccataaccctattctaaatctggtgccattcttgaatatacttatatgatagaatgcttatcattcatttcagcttaagaacatcttctgtgctgtatttctccttccatgtgcatttctttcaggacagggacttttgtatgcatctttatacctttaagagtagaaataagaaaaagataatgtcttccacagaagcaatttgattgattgatagattgagagagtgtctccctctgttgcccaggctggagtacagtggcgccatcatagcttactgcagcctccaactcctgggcttaagcgatcttcccgctccagcttcctgagtagctagactacacacgagtaccgccatgcctggctaattttaagaaaatatatttctgtagagacgaggtcttcctgtgttgctcagggtggtcttgatgtcctgacctcaggagatcctcccaccttggcctcccaaagtgttgggattacaggtgtgagccatggcaacctgggcttccttaggagtaatttttttttttttttttgagacatggtctggctctgttgtccaggctggagcgcagtggcaccatcttggctcactgcaacctccacctcctgggctcaagtgatcctcccacctcagcctcctgaatagctgggactacaggcatgtgccatcatgcctggctaattttttgtagcaatggggtttcaccatgtttcccaggctgttctcaaactcctgagctcaagcaatccacccgcctcagcctcccaaagtgctgggattacaggcatgagccactgtgcccaccccggattaattttaaaattaaaacttttagtatttataagccagaaggggaaaaataaaacaaaatcatggtcctcaagttgcaacataggaagagtgattgggaagggggtgtgaagtgttcgaagtgtaaggatcgatgaaactaatcggtaggtctactccatggtatcgacatgcctttgtgatcacagtgtgccacattttcatcttctacagtatagaaatcatacatcccctctcatcaagagcctagtctcttgatctttctccttctttaaaaaattaaattattaaaggaacagctgtcatagtttaaaaagtaaattagaactataggacttaaatgaaaaggcagtctctgctccacttgatttctccttaccagaggtggccactttaaatgatatcagctatttcttttagcagataacatgctcatgccattttacttgatattattttctcaattttagactttatttattttctacccagagggtgaaggtttagctctcttctgtcctttgccaatccctgacactataccctcccaaaaacttccctttccccatcttcccaatgtaattacataacatctggggttgaattaatcttcatcatttatatttactatttaaatgtgcacagttgacccattatgatatattatgtttacattttctctttttctacttaggttttttcttaggatactacctgcctttttgtggtttatttagtttataattagctgaccagttcagcctcaatagagccgtagaactcattttagtaaatggaccgcactaggtaatctatctagtccttctgctctccctccccacccacctctccctcttctccatgctctctgcaataaaaattctaatctgaatgttactctctagtgtagctttacagtcatcattctgggattttcactttactatcattacgagaattctctttgtcacttgttattagaccacatatcttttttctttttcattttcctcctggtagctttttgagaaagggcacatgagaggtaaattttttcagaacttgtatgtctgaaaatgtctttatcctagcccctgcctacttgttttagctggatataggattctaggatggaatttctccaaacatggaagttacatcgattattttctagcatctattgttgctattgagaattcacttgacattttgattcctgatccttttaatgtgatttttttttccctccctggaagcttttagattctccttttttccacacagtgttcttagttcatgatgctgtgttgaaggtcatggccaggcctttgctaggctgatggtgcagtaagaaataaaatgagaagggctgtcgtcactgcgcaggagcctggagttgcattatagggttgtaggtggaccgtgcagtgttgatggggcccttctcccagcctaatgttggaaagtcagtgtgccagtgcttcttcccttggcccttctcacgtgcaggtttcttactctgtaggctgtgttcacctgcaaacttcagatgctcatgttatgaagaactagggaagcagtaggaacctacatccattccattgtgtcctcagctttagacatatatcctctgcatggataaataattttgccaggtaaaattttatcatgttagttctacactatgtaatagaatgacatggtggcttcttacgtaatccttgttgcccatttattctttggaaactcagtgtgtgctaatccttcctgaggaatagagttctagtttcagttccattcaacacctgaatagtcatgtcatgacagataggtagatgatagacagatgttcccttgttcattttaatctgctgagttttttcaggcaaagtttttacaatcagtactggtactaaactctaaggctgtttatattggtgtgggcagggttaagggaaacaaacttgatgtggtgcaatcccccagggctggcaacagaaactggtactttagcagtcctgggcatgaagaggtaaggagagggagaaattaccataaactgttgagattggccttgtgggagaagtctgctaatcagagctatggctttggtgaagagccatagtcaacaaatgacagtctgacagggaggaagacagcaaaatacatgcccagccttcaccatcccaccttccagtctgccagtgtctgccaatggggtttaacccacctggaagccagacagcaagggcatcctttgatgtcttccataaaggtcgtcctcctggagcgcagagcagggtggaagatggtgaggaggtgagtggtgaatcaccagcttagttaggtttaaagatgtttttggaacctagggttattattttttgttaagaaggaatgtgcaattggaagggctaagtgtgacgctcatggacagatcccgcctttcagggagttgatcatcttttactcagatattagaagttagtttgcaagtaactaacttttatgttttctttagaatgttaacgtctaccaatcttagtgtgtgttgctaaccctgcccatattctcccttctattcactgtaattccctatgacttgctaatgaataccgtatttttttctgcatatctgtcagcttttatagcagtcttatgcagcatctcagtgatttcatatttattctacattcttctcatttctgttcaagatgaatatatactcattgcctggtacagagtgattgtaataatttctccctcttgagggaaggctcttagtagttgcttttctctgcagcctcttttactcagagctgttaactttgttttgatgaggatgtcctgcttttaatgatgggtatttttgtttttaggtaagtgacagtttgctctttgatacatcagatgatgaagagctgagagaacagctggatatgcactcaatcatcgtctcctgtgttaatgatgaacccctcttcacggcagaccaggtatagaggagatcctcagcaacgcaaggaaaggagactctagagctgaaaaacggcttcttgttatgacagtaaatgatggctgttggtttacttatctttcctatttttttctggttatacaggcttaatagttaactcttccacagagaaaaataagtatttgtgatctgaagcagaagggattatgttagttgggaaggtttccaacagaggccttgttgaagattatagcaaggtaccaaggaaaggttgttgcttaaccccaaaccagaaaaatattgtgaatttccttgtttctttagatttacccaaacacggacaaactgtaaagtatctgtgtagaaattatttagtatcttcaaaaccctgggtaaaaagcattagcatgtattaaagtaacatattgtgtgccccagaaagaagtgagcattattcccgtggaatgcgctaataaggtcaaccctgtattcacttaaaaccagtcgaatcagctttctcattttctgaatactcttcccacctctgttgtattgttgaaatgtgatgccagaacttcttcctgaaataaaatgttccatggctactcggactgtgagttctaccacactctatttttaggctggaaagatgagatcagtaaggagatacattatggcaagcttgggaggagtacattaaaaatttacattaaaattgtgttatttggatcctccttagtcatatttgtggttgaattgttctaggcgtgggaagaatgtggtgcttaaaaaagcaaggtaatagtaggttggaaggttgttttgaggtagagggtaatctagggatagacatgaccttgagaattcattgtcccctcactgacctgcctaataccgtaaactctccctttttttaagagttagaataacagattctgtaggatccttgagtggctcattgtaccttattatatttcctgttttggagactcttcttataattaacataatcccatctccttcagatttgcctttgtttttccttggtggaaatcttacctgttaagcttgttaattcataaagcatggaaatatgctcatgatgtcttactccttcatttaattgtgtttaatttttttttttaactttaggtccttttttctaactattgagtaattttcctgggtttcctttacattttcgctgagttctatatccttctcaacttttagaatctggaaaagggcaagatactgttgtaagatttgagcagcactgcactagacagtagatcattgtttaaagtcaaatgtatttctgaagtttttctgcttttcacagcatttttctctttggacttctactttttgagtaatttaaaaaatccctttttttcgttgaattaatatataaaattatttttctgctgttgaaagaatattttgctgtcatagaggtaatttcccatttatatatactttttttgtgctattgtattttataaattttatgtcagaatttttgatgagatacctttaaattgagcacttgtatgtctatggtaaattttctgttatttgctttcttctaacgattactgtatgatctagctctggtgtgtctgaagtaaattattatgtgtttgtagcacgattacctagactttgcaagacatgttagggccttctgaatcatgatggacgtagtaaatccaattctatttaggtttgtgtttagtatattgtaattttttcttgataaaccatgttcactcctacagtaaaaattttgattatttggagcatccacacctgaacaccattggttaatggagaattcagtgcatttctgctctgggtgccttaggtgagcactgtgttccagatagatcattttccttttgtatatttgattaacagtggtgtgtgtgttttcgaaggttattgaagaaattgaagaaatgatgcaggaatcaccggacccagaagatgatgaaacccctacacagtcagatcggctttcaatgctttcccaggaaattcaaactctcaagaggtctagtaccggcagttatgaagagagtaagggagcctgctgaaatcaatgatttctgtgctttttgtctgtatcaaatgtatagtatgatcatctccagaaagctttgatttcatcctccttctgtttgtgtttgtgtccaaatttacatttttgttgttgttgttgagacgggatttcactttttggcccaagctggaatgaagtggcatgatttcagctcactgcaacctgtgcctcccgggttcaagcaattctgcctcagcctcccaagtagctaggattacaggtgcccgccaccacgcctggctaatttttacatttttagtagagacggggtttcgtcatgttggccaggctggtctcgaactcctgacctcatgatccgcccgccttagcctcccaaagtgctgcagttacaggcgtgagccaccattgcctggccccaaatttcctcttacaaggacagcaatcatattggattagggtctatcctaatgaccttattttaatgtaattacctctttaaagaccatatactgtaacattctgaggtacttggggttaggacttcaacacatgaattttggggaggacacaattgagtctataagaaaccccatcatatttgaagtgtagaatagatattcagtaattatttgtcaaatgcaattcctgtttgtacaaatagtcttgtgtgttactatgaagaattttgggaaccatggatctgtttgacatatgtgagaataatgaactctagaaactctacagttgattttcatgaaaaatgtctgaataaatataaccagcctgtgaacagcctgaggctggttggaaggtgtgtatctaatcattgccatatgactggtcccttccttgaataggcactgatggggtctgtatctgctcaactcgtgttgtcacctagttttatctttatggcatgcccagtccaaagcttagttacctaaagacctttgggttgtatggcttcaacatacagatggtcagacagaccaaattctttcagatggtctgatttggccatgttcctgtaggtatgggctaaacagtgttaacgtcctgactcccaaatacagtcctgatacctgatacagatactaaaatctgtattggtttgctagggctgccagaacaaagtaccacagagtgggtggcttaaacaacaggaatttatattctatagttctggaggccagaagtctgagatgaaggtgttggcaggtttggtttttttcagaggcctctctccttgacatgcagatggctgccttttccctatgtcttcacgtggtcttcctactgtgtcctgatcaccctattttataagaataccagtcatgttgggttagggcctatcctgatgccctcatttaaccttaatttacctctttaaagaccccctctccacattctgaggccctgtgggttgggactttaacagtgtcctatctgtcacaaggggcagaagtgctgagaaaagactgaaatggggtttcagggaatattgttcccttttgtcttcccagtttttttagtccattcttgcactgctataaaatgcctgaaactgggtaatttatacgaaaagaggtttaattggctaatggttccacaggctatacaggaagcctggtagcatctgcttctgggggggcctcagggagcttttactcatggtgggaggcagagctggagcaggtatcttcacatggctggagcaggaggaagggggctggggggagtgccacacacttttaaacaaccaggtctcataagaactctgtcatgagaacagcaccagggggatggtactaaactgttagaaattgccctcatgatccagtgacctcccaccaagccccacctccagcatcacatttctgtatgagatttgggtggggacacagatacaaaccatatcaccaatttcaacaaaattcacagatcaggacttatgtaattaagtgtatatttagtttaattctttcagatcaactcctttcctgttcagagatatcccagaaccctgctgaacggcttgcagttttttgtcagcaggtggattctgtactttccctcgacttttgtgtttgttcttttccgtgtacaagccttcacagtcttgactgaagtattattcatgcaatgatttatttgcacaagtaaaaacttttgttagactttcttgccagcaagctgagaagtgactcacctgcccacttacctctactcagatctgatctccagaagttgtagaattctgagaagatcacccacagtcaatttaattgcttggaatatgatttttgctctttggcattgattacataggtgtttatttagtcattcctagtgactactctgttttgcttccttgaaatgtttttgtcttaatatctgctgtattttgcttttggtcacaggagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaatgggaagaatgagagaagtcatatgcccggcacagtaagtgatgttttgcaggaggcgtcgaacactggaaacaggttctgtggtagtcccagcctttggggctggtggcaggtgcgacaggttgtacatgggcaggagtgttaacacttctaatcagagcccagtgggattttattccagaataccgctgtgctcagcttcttcagaaagtcgttttcttgactagggtgtactggttatctgaataatactgaaatgtttagcaaggatgtaagtggaaggaagagggggcaaaaaaggagaatgtcttgaagaaaagaagctttagcaagtgaacatttttaccacatcaaaatgtgaagagtggttatgtatatttggctagtagtttttttcttatttttgctgaactcttacgagttgtgtgataagaaattagaaggggtttatttagaggtatcagaactctgctcaaggcacaaattgtttgtaaacaggttcctcctgatttttcagtgaggttggaatacaagaaggtaagtgacatcagccatgtggcctagtatttggcagactagactatttctgactggtgaaaacaagtttagaacatctgaaacgctgaccctttgataagatttttttgtgttgaagtcttgtgtattcccaccttgattttgtttgtgtgtgaagaaatgttggttttatttttagagtatgatggttgggtaaagggatctctttttctaaatgggacatctctttttaatttgtgatatcaataacatggtcttacaaatcacaaactagctattatggcttgcaataatatgagttctgtttttgataaagtctgatttacttatctaaagaatacttagcagagaaatagatctcattaagcagatgctgatggaatcctggaaatacagttctaggatggtgggccaccaatgagcagttaacacaaaaagagtcttaccatatagctcatttattatgctgtaattagcctatgaataaatccatttttttcagtgtaatgttcatttgtatctattttgaaaggacatcgtggctgggcacggtggctcgcgcctgtaatcccagcactttgggaggccgaggtgggctgatcacctgaggtcaggagttcgagaccagcctcaacatggagaaaccccgtctctactaaaaatataaaattagccgggtgtggtgctgcatgcctgtaattccagctactctggaggctgaggcaggagaattgcttgaacccaggaggcggagattgcggtgagccaagatcgtgccattgccctccagcctgggcaacaaaagcgaaactccatctcaaaaaaaaaaaaaggacattgcttatgcactgactttgaaaaaagttctcaggtatctattatttttaagaaatggcagtattgattgaataggtgtttatttagttattcctagtgagtactctgaaaaaaacccaaaaccaacccacatttgtttgaatatacaatcctagaaaatttgctttaaaatattagggacactattttgcatttgcatctcatatttttagaactggcaccctttaaattgccctgttatgcaagtgagattaaataaaatgcttagttaaaaagtcatagcatggttggtaatttctgcctatttgcttttagggattacatgtaaatcctccatttattgctgttaacacttggctgagaaaagtaaatttatccctagaggggtttaaaggcttcgttttgtaactcccatgtaaaaagggttagagtaaatctattgtgtaattttacatggcatttatattgagaaatggatttggcaaggcaacagttaggtcttacttcagccttcattggtcttgaaatagattcatagtaacagtaaatatttttcataatatttgaacttttgaagttgcattttgcctgatttacaatttgtgtcaaaaattttaatcagttcagtaatggcacggctaagcttgcagtactagtttcctgtatccttttaaagcctaaaatgcggccgggcgcggtggctcacgcctgtaatcccagcactttgggaggccaaggtgggcggatcacctgacgtcaggagttcaagaccagcctggccaacatggtgaaactccgtttctactaaaaaatacaaaaattagttgggcgtggtggcgcatgcctgtaatcccagctactcgggaggctgaggcatgagaatcgcttgaacccaggaggcggaggttgcagcgagccaagattgctccactgtactccagcccgggcaacagaacgaggctctgtctcaaaaaaaaaaaataaaaagcctaaaatgccagggaaagaccttcctatctgtgacacaagtaggctggaagggtgattctgaaaatagtggtaggttgctcaaaagaaacccaaagtgaaataggcagttggataaacagattccaggagcttgccaaacattttaccaagcattttatatcacatgcagtcttggcaagacctggtctctatgagtttgctattatcagtgatactaattcctaaaaaatggtgacctccttagaattgtcatatgttacctgtttttccaataacataagtcacttttttttttctcctgcctgagatatttttgttttattagcaggacttgaagtttttcgttaagtatagaatagcttccatttttcttcatgtatgtttcactgaagcagtacatcaatttgtagttggcataccacttaatctaaaattgttaccttgttctctttggtccaaagatactctaatgaaatattggagtgggtatagagcagagttaaacttggagacagattttgttttaaatatttgttgtggtgaaaaaaaaaatagagggcatagggatgctatttagagcattggaaaatttcattagaccatgaaaatatgtgaaatgttacagaaagtattatcttataaaagtgaaatatgattttgattggagttttaggtttaaaataaccataatgctgtatgttgggtaagatgaaacaatattcattcattcagcaaggatttgtggagtgctttcctgtggcaggtgttcttcaagatacagtgggcaggatgactcatgatggtaattctaggactttgagaggctgaggtgggaggattccttgagcccaggagtttgaggccagactgggcaatatagtgagaccttgtctttacaaaataaaaattataaaattagccaggtgtggtggcatgcacctgtagtcccaactacttgggagtctgaggcgagaggattgcttgagcccaggaggttgaggctgcagtgggccatggtcacaccactccacttacagcccgaccttgtctcaaacaaaaaacagaaaaaccacagtggtgaatagaatagaatagatgaggcccatcccatgccttcctggagcttatagtctaatgacggagaaaggcaataaacaaggaaaaaatgaatagatgatggaattttagtagtaaataaaggccatgaagaaaaccaaaggctgggtgaggtggtagatggtgatgctgttgggaagctgttttggagagtgtcactacaccactgcttctcctcattgacaagggagcctgcctagtccctttccaattctccgtttgaagaggaggttaaaggagtggacctctttgggaagtgcaactcaagagagtggcaggctttatatttcctctgtccttttttgcagcatctggaggagcagaggatggggggttagagagtggttaaagggcactgtctgtttatcactatggtgacctacatgtatttctttgtgctgaccatgctgttttgggtgacacttctttatattcaatgctcttcttctggaatcaaattccttacctgctgcttctgtccacttgggggattttttttttttctcactcatcctttaaaatcatggccaagcattgtcttcctttcttagaaccttccttgatgactctgtccgatgcagagttgactactctctctttttagaggggttagtgttactcctctttagtatttctattatcactgttgtatcatactgcaattttttgttttcatgcctatctctgttttatgtccctaatgataagaaatttaactttactttctcggtattcgtagatccaaccttaggtacctaataaatttctgctgaatgaatgagtgaacgaaagataaacttgcaaatatatatttctatattggatctttctgccaggtgtcaaacccatggacagtgaatattgtctaagacaatagaatattgactaagagctttgggttaagagctgtgtttgaatcttcgtcctacatacagacggctttgaattttggagagattaaatgaaataatgtatataagattagcaaacatagcaaacaccatgagtaaatgctaattgttatatatgtccaactgcctactagacaattccctttggatatcttgtaggagtctgaaatttatactattaaaccaaagttaccattttcctaaaattgaattattttcttttggttagcaaaactagtttatccactcactgaaactgatagaatttccaagtcaaagaatatagagttttaaatggctttaaatgaccagcttttcaaattattgtgtagaagtgtagcccagtagagcgtaagagtgaccattttcccacacctcccgccaacaggagatattaagagcttttgaatatacactgcacaggcaaacaatgggtttgatctgttgaccatttgtattcttttatgagttgcctattatgtttatatgcctgttatgaggtgttttcatatttatttgtgagggtacacatacttgtgatattgaagtaccacactgtgttgtaatcattggcttaaacctctcttctaacagagtgcaagctctttaaaggctcattcacactgctttcccagcacctcacctaatttcttgttcttcgcacatcacttaatgcatgtttgttgaattgaaacttcagtgtacaggagattgaatcccggaggatttagatttgtagtatttgaattattattgttctattggggatttttattgggggagccaggcttctgttacatcagacattcacaggtcattgaatttcagtagcagttctcatgaatacaagaataggttgaacaacaccaggttatgttgtaatttagtagttgctgttcatctagtgttatctgcagttgtctgggcattatggcctacctgcttagcatcataacttagtaaacttatatgtatgaaaatggaatagttaccctctgagtatctagtaacaaatctttgaattgaatgtcacatgtaaggttgtttatgctaagtcttgttgagaagataggaatcgatagtcttttctgtttgccataatgacattgaactttgaagagagaatttctactgtgttacactccaccatcaaaaatgcataactgcgtcagtcaaccctgaaaaagtttatacggacaacttttgggatattagcaatcagtgactaacggtagtagagaaaagaaaaaactgtaaaaagaatcacattaccctaatttattgcttttcgggggttagggagagaattgctgaaggatgggggagagctagggcttagatgatatacactctttcttgtatatattttctttcacagctacattgctccgtttctgtgactcagctcatgttataatatgattgatagcctttgtttggggcttctgtttaaaacaacatggacctggctttttccccccttctttttaatttggaatttttttaacagcacatttgctcagatgatttaaaccagggattgtcaaggcagactactgtccaagggctaaatcaactcttcacctgttttatgaatacagttttactggaacacagctatgttcattcatttatatatcatctgtagcagctttggggctatatggacagagttgagtggttgccgtagagactgtgtggcttacaaagcctaaaataattaatgcctggctcttgacagaaaaagtttgccaatctctgatttagacttagtaaaattaaaaagtagaacaaaaagttatgaactccagttaagtgagtttgcatagataaaaagagtactgtaatgtttctaaagtttgtatttaaaaggttactttgttttatcttgagattatgttgaattgttccttttcttggggccccttcagcagcagcctgagtgatagtgacaccttggccagccaatctccaagctacgtgtggcagcttcttgtctaacagcagacctctgtgctgtgtgtgtctgaatcccggtggctaggtaaagagagtgagcaggtagaccagtgttctctaaatatggagacaaacaaaaggaataaaaatgttgtattatacacagtgataaaatgtggttttaaaagaaggttagaggagaagtggaaaaggcatgagtttttttcccctttatctttttttttttttttttttttttttttcctgagacggagtctcactcagccgctcatgctggagtgcaggggcgcgatctcggctcactgcaacctccgcatccccggttccagcgattctcctgcctcagcctcccgagtagctgggattacaagtgtggtccaccccgcccggctaacttttgtatttttttttttttcagtagaggtggggtttcaccatgttggccaggcttgtcttgaactcctgatctcaggtgatccacctgccctggactcccaaagtgctgggattacaggagtgagccacagtgcccagcctttttcccctttatctaagcagtggtgcttgagatactaaattctacctgacatacattctttttttttgagacagggtcttgctctattgcccaggctggagtgcagtggtgccatctgggcccactgcagcctctacctcctgggttcaagcggttctcctgcctcagcctcctgagtagctgggatgacggcgcccgccagcacactcggctaattttttttagtagagatggggtttcaccaagttggccaggatggtcttgaactactggcctcaagcgatccgcccacctcggcctcccaaagtgctgggattacaggcgtgagcaaccgtgcccggctctgatacgcattcttgaatgtaaatattgacacattttaacaataatttgttggtgatatttgatagtatcttgctgcattttctttagtgcaaagcatttactaagaattactattagcatgatagaaggtcattgtagggtggagaaaaacttgactatataatggctattattttaataattcaaacctatgaattatgaattactttagatgtggaacaaatttgttttatgaaaaataatattacctagagaaatatatgtcatcatcagttttcgatatgtttttatcatctacactttgttttctgcaatggtttttggtggtaggctggtaatagtgaactttcatgatccatcagttaatgtagtaaaaatcaggagtccattcttgacttctttatgtgttagagaggtcattgttaatataaacaagttcacataaaagctgtaatgtgccaggaaattgtgttcttcttgtatacagtcttgtgccacatagtgatatttcggtcagtcatggactgcgtatagatagatgatggagtcaggattataatgctgtatttttactgtactttttctatgtttatctatatttagatacacaaatacttaccattgtgttactgttgtctacattattcagtacagtaacaggctatataggtttgtagcctaggagcagtagactataccatgtagcctaagtatggagtagactatacaattatgtaggtttgtgtaagtacactctgtcatggtctatacgacaaagttgcctgactcatttcttagaatgtatcctcatttttaagcagcacatgactgtacttagagtatttatgtttcaggaaggaatttctaaaattgccaagatcaattattatattctagttttagtggttttgaaaatatttggcaataattagtttagtttccacattaatattaagttacataaaaaattttaaaaagatcttcaaagataaaaattaaattatttaatgctaattttgaagatctttgtattatattttttctgccataaaaataaactcatataacagttgtttaatattgaagattttcaagtgtgtatctgctttggtataatgtatattttctaatttacttagatctgtttttttaaaaaaatttttggtagaatttgcttttataactgctttataattcacattaaaattatttgaagtattaaaacaagatattacttttacatcttaaataatatcttaactatttgaatatttttactctaaattttttacacttgtttcctcattttgattattttaatttattaaaaattaaacctactgttttataatgtttgaaaatcatattcaagctattgaaagtgtcgtgatttatcaggaacaataattatgttttcattttgctttcatttgaacctcctgagtataaagaatattaatgaagtaagagtagattagagtaagagtcagaaatagatgaaaagcattccttgagtgctttttcaaaccttttttctgtcattgagctttgatattgagattttaaaatgatttcctggccagttagaaatctgtaccagttggtgtcaggtgaggctgagaaacaagtttgatagcgggaatagtgtaaatttcctgagccctttgttgtcttgcttttccctgtcttggatgttgctttctgtgaagctggttgaactggtgaatatgctgtgtgtagaagaagctgatatatttaagataccacagaagaactaacaaactgcagcactgtatctgattcttgttcacttttatgtagcatagtgttctctagctcttttctttttattgttcagaaagaccgaattatttaagtgttaacttgttttctgtttaagcttttttgctgattctgtgcttagtcatagatagtaatgtctctttatgttgttttcagtcctatcagctaggaactataatcggggatttattttttctcagctgcaattttatttatattagaagaacttgaaatgctgtttttgctgttctggagaaaagtagaaaggtgtggttatttctctttgggagttgtgtctaaaatattattctatcctttttatttttaggaattatagccaatacttttttgaatattgatatttgctgagcactttgctaggtacttgcatggattattccatgtaaccttcacaacaactctataaagaaggtattattgttattatttccatttcataaatgagtaaacaaaagcttaacagggaccttagctcacagaaccagcatgcattggaatgaggatgtggagttatttagaggtggatggaaggatccttggcttgaattttcgttttctgagctttgcaaggatgttgtaaatgggccttggggatcttggcccatttcttcgtctttcagattttggtgaatttttataaatctatatcctgtttatacattgttgctactggttttgtctgagaaaagtttccagataaggactgattttgagactttcaatacatacttatgccagggaaggaaacaaccacgaggcagtggtgagtattctcagcgtaaatactggtgttgaagctgtgtattgaataccctcttcctccgtccttgccacattactttggcatttgtcagtagtgagggcaacaataaagtaaatactgtaatgcttaatcatttccctgctcacaaatgggctcctatcaaaaattccatcctgagagggggcattttatagcactattaactccttcctaaagacgtagtgggaaatggatgaatcaattacaaaataacttcagattcagaattttcaccagttcttcactttgaatttgaacacttggattctttatttcaaacttggaaatggtagattaaatggagggaggattgggttttctgatatactgcgttattgcagttatttaaattaaactgtaacaaattgttttttcttttcttttaaaaaattatttacttatttatttagtaacaaatctttaatgtccttcatttcattcagcattcataaccctgagacttagttctgttggcgctttggtatgtctttggtactttaaccttgagaaatgttatcaaagaaatgcttccctcccttccccctcccactctgtctccctcctcccctaccccttctgtctctccctttccttgtcctcctacttataaaatttaagcatagagaaaatcttccctctggcccagttaagcaccataagcacctaataataccgcatctgctctcaaggttgtaaatgtagtgtttctaaatgaggtgacgtttactaaaaagtatatttaacctgcctctgaggttttatctttttaaaattcattttgccttccaaaagggtgtgttattttttggaatttacagggcagctataaaacagaatgcacagtatgctctacacagctcgtttcctgtttcttcctggtctcactgccctggtctctcttttcctttatccttctagttcactgatctcctacttgctactctttgattatcctagctaggggtttgagatttcttttttttttttttgagacagagtctcgctctattgcccaggctggagtgcaatggtgcgatcttggctcactgcaacctccgcctcccgggttcaagtgattctcctgcctgagcctctcgagtagctgggattacaggcacccgccaccacgtctggctaatttttgtacttttagtagagatgaggtttcaccaggttggccaggctggtctcgaactcctgacgtcaggtgatccacccacctcggcctcccaaagtgctgggattacaggcgtgagcctccgtgcctggccggggtttgagatttcttagtcactccattgttttatgttttataaaccacgccaacaagattatttcattaatctcatcttactttcctagactagattcttcagtggacttttccagaactccgttgttcactcttctgaaaaataacttgatgttctgtcctgtcatctttattctgttcatactccacttattttgggctttttttttttctttctctcctgcaagaagtcaagacacctcatgatatggtgaaacgatcataggctctaaggctcttgggttctggtgttaggagtgtcacagcctcagcttatgagacgtttaaaaatgactgctatggcccaggcactatgcaagctgcggggatggaaagatgcctaagacctgtctctcccttcagaatgtagtcatttcctcataagaaaatgaagccactggactctgaatgtatcatctggctgtgcagttctgccattctggagcactcatttatttagtcctatagagagagagagagagtgtgtgtgtgtctatgcgtatgtgtgtgtttttaatttgcttaataatggatctttttgattgaattaatccatagactcgtaggatttacaaataagaagacgtttaaagttaatatgatttaatcatctgttttacaggtgaggtaacaggccttggcagtaaagtgactgccctcctgtcacacaattagtggcaaagctgggaaagaacccagatcttcgatttctaattcagcacttttctgtccaagttgaccgtttaaaaatttcttgattctaagacttttgcctgagctatgattcctggtttcatacagaaatctggaagtatcccactggtattggtaatgatcgctgtagcgttttgcaggttaagtcactgactatcagtcagatgcctcctacatactggtctggtttttgctttttggagcatatgaaagaagtatctgacatttttttttttctgtccttaaggattttgagaacttgagttgaatttatgaaaaattaacctgaccagaattttcatttttctttctttattgtttctctttagatcttgtgcactctacctccccattaaaaatatcttgattacttttttttttttttgagacggagtctcgctctgtcgtccagggtggagtgcagtggcgcgatctcggctcactgcaagctccgcctcccggattcacgccattctcctgcctcagcctcccgagtagctgggactacaggtgcccgccaccgtgcctggcgaattttttgtatttttagtagagatggtgtttcactgtgttagccaggatggtctccatctcctgaacttttcttatactactattaggcaaacattaattgatccacagttgtgtccctggcatgggtgttaaggatgtagaaccaatttcagttttccaggaatgtgctgcccatgggttgcagattgaatgatgaaccatccaatgtgctttagtgcggtgattctcaaccaggccaattttgccccccatgggacatgagtcaatgtctgaaaacatttgttgttgtcacaactgggcagggtggggaaggatgggggtggtactgctggcatcctggtgaacagagaccggaggtgctagtggagatcccaccccactacactgacccccgtgacaagaatgatctgactggaaatgtcagtagtgtcaacgtggagaaacctaggtacagggtgtgataattgctatattcaaaacaactaccacgtttttagtgttttctgagcctggctctgttctgtggtcaaggtggacatatattactattgcccctagctaggtttaggggtctgggaaggctgagttgcacccggaggtcaggtagaaggaggagggaacaggcacagacagcagagggggtggtgtgtgccaccacttggaggggacagttagggacatctggggaaatgcaggctgctcattatggtgaaagctagaaggtgagggggcaagaaactcaagaagaggctatggaaattgcacagtggaagctggaaaatggatggcgtcgtacgacattctgaggcacctggtttttgtttaaagggtttagagaaccaaaaatggattttaggtcaggtagttacatgtttgggtttgtctgttttggaagagaacttcagtggtttcaaggagaactaattggaaggaggcaactggagataagttaattaggaggctgttgcagcgatttcatgtaagaattgagccagggaagtgaaagtagggatggaaatataaatagttgaatttcagagatattggtgaggttgattgtttcggacaccaaagaagggaggagttagggtcaggtcattgattgttgacgagggcaaacatagataaagcacatgtgccccttccccaaagggaggtatgtaaatcttgtcagcagtacctgcttctagcttcaagtccagcaaatgaggggatgtctctcttttccgtcaacctatggtctgaaagttaagccagccattgcaacacattggcacacaacgggggagagaagacagggttgctgcaataacatcttataaaaaggaggagagaatggacatattccatagatgctgtgttccatcccattgaatgagaattgcaagacctcctgcacactagctgtggcgtgaactcccgagttggcccggttggctgcttttggttttgttctctgagaagatctcccttgtccattgtcctttgtggctcatctaggatgggtgtatacgtcatatttcagctcagatgtcatctcctcaggcagcttttctctggcgtccgagtagaaagtaggcatccagtttttaatcgccttgctggagctagggatagggcatgtgttagttatctgcagcattcgcttcatttacgtgttgtgctttttgtgcccccttatgctggaatgtaaggtcaggagggtgggaggggccttggctgatgtgttcactctgaatctctaatacctggaatggtatctggctcaggatgttttttgaaagaaagaggaaatgaatgaacgaggagaataaaatgctgaaggaggaaccggtttttaaatttttttgtttgtgttttggtggggaagaggacattgaattcagttttggatatgagttttagaaatattgatattaaatatagacaggaacataggcttgtcaataggccattaaacatacaataggtacagatgtccaattggccattaaacatgcagagtgaagctcagggaaattacagtaaagatagctaacatgtactgagctttgccatgtgccagtctctgttcttagcactttactgatcttagtaaagtggagctatcaatttatggaagcagaagatgaagctattgattggtaatacccagagggggtgcatgataattaaatagggacagaatccagaggcacagcagcatctgagaggtgagtcaagaaagaggcacaagatcctagggaacactggcatttaagggatgagtgaagaaagtggcccctcttagaagaagcaactagagagcaggagggttggggtgagggaaatctgggagagtgtggtgtctctgaatccaaggaagcggttcagggaggagggattcctggatgtctcagagatctgaaaagtggccgtggtcttccagatcaaataaatgatgttgggaagagctgtttcaggaaaaccttgggaaaggaaagaggttgagggtttgagaatttcgggatgctgtcaggaaggagctagtagagagggagagtttggaaatgcagtggagggagaatattgatgctgcctgacttctggggaggtaggagttgattgcaactgaagcgtttgataggagcacgttctcagacgtagattttagttttttttttttttcttttttttcctgtagaaccttctgatttccttgttctgtaattttccaatggatcaagaggcgattgaactgtacatgctgcacattgcttccctggttcattgccagtgaaagagctggggacagtagggtcttgtcagctgcagccactgactcagcagccatcagcagcaaggacagaggttctgctgcattccttactttaccttctttcactggcatcagctgttagttttgtttttccaggttaccttggcttcccatggggttgcattttcactaatttcccctaagcctaaaattctggtggcacaaaagccatctttcacaagtagtcaggctgtcagtagttgagatggctcagtaatgtctgcaaccacacatttaataaagaaaacctaaattacatctgcatgttacgaaattgaaactgcatcaacttttgttttttctagtgacaggaattggctttctgattgcgaaaacaaagctagtgtttttggaatgtgctttccaaatagaaagtgtgtcttagtttcctgataggtggattctgaaactttttatctagctttagattttatgaatttgtatctagcttaaacatgctcatagataatggagccaggtaatatagactaagtacttaaaaacaagtactcttctctttgtcacatttgaaagaaaatatattttatgaaaataatttaaaaaataaactgacttggttatttgagaatagtttctcataattgttattatatactctgaagcctaagatgttatctcatttgataatctgcttaaaaaatatgaatgaattatgatagcattggaaaaatttacagaaatagttttctgtaggtttttgttttataactagcctcctccatcaaagctaatagttatgctttcagtgaagtgaagagtagtcagcaaagtatcttgactagacatttgattcttgctgaagcaaaactggcttgcaaatctgggaaaggctaggtagggaagttggatggtttaggaggagaggcatatttgtacagtctcctgtaaggtagtaaaatttggaactcagattttcagtaactccatagagttacatgactgatacagaagcacatagctccctcagtgattcagcctgttggcatttcttagctttttgttatcaagacttctttacgctcttaaaatttatcaaggaccccaagaaacttaatattagccatgttacaaattaaaagtgataaaattaaaaatataaattcatgaaaaataccaaaaataaattcattataaagagcatatatttatgaaaaataatattttacaaaatcatgaaaaaatatcattgctgtgcatttttgtcaatctcattaacatctggcttgattaaagacagctagattcacaaatgtgcttctgcattcagtctgtcatttggaatatttcactgtaagtcatgagagaatgagagtaaaaaagacaacttatattttagtagtattaagaaaacatttttgaactcctgaactcctgagaggatttcagggacctcttggcaggagttgggtgggagggggtccctggactacactttgagaaccactggatgaaactatatgtatttcttgatgaccattcccttggtttcctttcttctgccccttggggcctggtaaaatattctttatgttgactcctcaaatgtgtttactgatttaaatttcctctataaaattccaggggaaggaaccatcaagtgagtcaggccttcacttccttttcacgaagcctttccccttaattagtcatgctgtaagaatccatctcactcctttgactcagccgccatagaggtgccaccagacgctttttactatgcttgatgacattgtagactggttacaaatcaagataagttgtttaggaaaaaaatactcccttttcagtacaaagaattctaggaagtcttggaggttgctgggagaaagaaagtagaattgtttcctagaaacggagtggaaaagtctttggagaagtttttgggggcctggctggcacatgggatccactctgctctccaggaagcgtatgccatcttctagttcgcatttctgcaccaaggcagtggcaggtggcccgaagagtgagtgggaagcaataatcagctctccaagtaacagcattttcatttgctaaatgttatgttaatgttctccaaactgatggtagaattatacaaacttaggctgaaaatacgcatactgttcatcttaagttttcagacttctgataaaatgtaggtaaataatatcaaaaagtatcttaaaaattacacagtaaattttgtatagaacaaatatgtgtacaacttacaacatttacattggaacaattagctacatcagaaaaatgcctgcatgaatatagtagcataaaaacagttgcttttgcatttaacttgcaaagaaatggaagcaacagcattttaaaaagagcatgggtttatgtgctttatctggatgagtagtggcattttctaactgcttgcctcttgggcacataagtcatcatggtacattcttactaatagactttgaacttctttctctgtccttttcttctgggccgtatattgccgcctttagcgcttcagcatggaagggatctcaaatgtcattcagaatggcctccgccacacctttggaaattcaggtggagagaaacaggtgctcggttatccttattttcctcattctctgctttttcattttctgtgtaagtgaagatcctgaaagctggtagtttactaatttactaagaccattgcttaacgagagaaataaaagtttattataaaagttcattatatttatagtcttgataatgaacagaatttccctttgaggaaaaagcatttttcaaattcgacaatagattaaatgcattcttaagacgtgttttatagctccatttttcactcttagttttaaacaaatattaacattttaacataatgtattgcatgtgtagaaaatctgcttgtgaaaataactaaactaaaatatgtgactctaattctaaaagtctaagtcgcaagatgtcatttttgggggaagaaggccagatgtcggtatgtttgagactagagttctaggtcaaaaatatgtatagagtgtatcttacctcctttaaatgaaattcatgtgtttttaaggtgtattgcatagtcagccaactcagttgtctgccaaacgaggcatgcgacattatttatacaaaattatacacagatatgaatatataatcaagtatctagcaatttgctttttattcacatttttgtataatgattgaaggaatatcatgaacatgggaaacattcacattaatgggtatgcttaaaattacctttcactatatgaaattttcaccttgaaaaagaaaagtctttaagttagctcttctgtgcagattaagaaggtgtacaaaatgtagcttgtaggaagtttagcaaaagaacgcctagatcaaatgcctggagtttttactgcaggtagttaagtgtttctccggaagggagatcattcctattaaagagggaagcctcacactgacatttgcagctcatcaatgagctccatgaagggatgtttgagtttttgttttcattccgttgcctctcacctctctcaacctcaaaagaagacaaggaatcttccagactgtcagtggagcagggaggcctgaagatgcagccaggtagccagagagcgggccagggtgcagccgcctggtgcctctccaggttgcctcacacatgcagagtgaagccaggaggacatcatttctggccttttgttgttgttgttctttacaaagaaacattcgattatacaattgggcatcacctgcaagaagtctacgtcaaaaagacggtgggacacttaacgtgtctcagagattgaactatgcagttttaccacttttctggacttagggatccagttactgtaaagcagctttctttatcctgtttttcagttatgggcaggataagatcactcagtgaggattagccacagagctgagatttagggcacgaggttaaataatgggtggagctaagagattccaggtaaaaaccactggctttctatatgagcatatgtgaaatgcacggaactatttttttggtgggatggtaagaacaggaaaatctggacaatcatttatggattatgctttcatgggattagttaaaagacatggcgctgttacttgtgagcctttacaagtagtgaactaggaagtttatctcaatttcagacattaattttcattattcatttccccttaggccattctctactttaacttttctcctttaatgcctaaaaacgtttacaatgacttacccaataatttaaaataatagtaacgcatttctaaaacgatttaagtgtgtctttgttagcttctgaaagaagctagtgtgtgtttttcaaagttgtcatgttatatatgtggaccatttgttcaaccagaataaaaatggtctgaaacagaattattttgctgttggaaattactttattgtgcagaactgttaaaactatgtttttagtttaaattgctatttttaaaatgtgttgaaaaatatgcaagtagaatgtgagataatacttcactttaaaaatgaacaaattgagtaaaccatcctcagacttagtcctatgaaattttcaataactgaaatgcaaaaaggtggttgtttctgttgacattaggtttgtatgaagcaaatagaggtgggcaaaaaaaaatgagctccatctgagatagtaagataactttattcccatacaatacctgtgttttcattaccaaagtagcttgtgttttatattatcagatagaccttctagtaacagtatcaaattttttgcagataaggtaattccgatttaagtgacactttttttttttaaacttggcagtatttgactacagtcattccttatgagaaaaaaaacggaccaccgtctgttgaagatcttcaaatattaacaaaaagtgagcaaagacaaaatgaaactattacctgatttccttttgctgattggtaaacacctgactttagttggctgattttgttgttagtgttttgtcagtttaggatgtaaatgatgcatataattgtttatttttataagaatgaagccaaaaatggctgtgacattaaatacaacagtaactctagtgttgatttgtactttttctgtttttcttaccttgtgaaatatttatgagctaaaattttgggaaaaagcataacctaaatctccatcatctcttacatgtttaagaacatatccatttatcataaataaaattccttatggatcttatatatctatgattgtcagtaactgaataggaaagatttacggtaaacactttttatttcttatgaatgtagaacccgaggtagtagttataggtagaacataaattgacagtgatgttttaagaacatgcattcattcagcaaatatttagtgaaggcctactctgtaccaggccatgatctgggcacttgggatactttagtgaacaaagcagacaaagataatgcaccttcaaggggcttgccttaaaaaaaaaattgttagatttaaatatacatgatattgagtatctcttatgatggccgcaaatgagccttgaattctggttctatccctgttattttcagggatatccttggaagttacttactctcttttgcttacattgaaaaactaggataaaaaatatttgttctatttacctcacagtaaatagattaatatatgtatgattttggctaagttactatcaattagccgttaaaatggagggattgaatttgctgatctgttaggtctttgttatggtaaatatttatgatacttgctaattaggggggaaccaaatgaaagagcatcacatggatgagtatggatgatgatacttattttggaaatttaagaggaatgggcaaggaaaacctaagagtagaagcaagtgtcttatttcttagctccctgcctgctaacttggagcttttattctttcctttggtgaataattctttaaaaattttatatttaaatatggataaatcaagtgatgccagccagtctgaaataaaaaatcaagagattaactgggtagctagccctcttattttcaggaagaacttaagttatatgtgtccaagatcacacagggggatggttagttacagagctggatctcttaattcccaggcaattatacttttaatgatgctggtttttggtatgtgattttatttagaagttagaaaaaattttaaacatgattggaagcagaaatactgaacatggtagccctctaaagaagggaacataaatattgctcataagccaggaattactggcaggcctcagcttctcagatcaagaacaaatacttcattggtcaaactaaagtcatcataattccagcatcgagatgtctttataggttgtcacagtttggaatctctggacatatttgggtccaaagctccttttctttccaaaagaagagccctgtggagacagtcacagtgtttatggatatatagtcttcctgataaaagctattaggggattttgggtgcaataataatagttaataaaaatttaaataatttgagtagtgttagttacagttaatacatagcatgtactatgtgccaggcactatgatatgacctttatatctgaattagtagcttagtcctcataacaaacctttgagattaaatctaattattattctcatttcacagatgaagagcttggtgcaaaagtggttaagtagcttgctcagcgtcacacaattaggaagtggcagagccagggtttaaacccaggaaggctgatttgacagttacactattttgccttgtcgtattggtggggaaaaacagtgaaatatttttaccaggatgctttggagaaaatttgagttggcaatctctgttaaagtataatatttgtgagtttatctcaacctgaatggtctagcttaaaaaagaaaaacgttatactaggtggctgctttttctattttagtttttacttagaagataaatttgtcaaattagaatgaggctaattctcccaggtttctccctagtgcagaggaggcaacagccaggcagatgcccgatgctgcttcatggaagtctgttcttcatttgggtcttttctttgaaagtttctaaggagtctgacaggatacgcttgttggagggtatagctgtccatttctttaagagtttctctagtttgcttgatctgcagcactgaggttttcttgctgcacagagttcattgaggtgcacattatagtaacccactttccggtattattacagagcgaaggctccttgtaaataacccagttcctctttttttgtctccactgtttggaaattttaaatcagggaagcaactctcaggtaagtgggatattcttaccgaaaataaattcttgtggacttactccactaaaataaattattgggcctttattgttgtatccccttatcaggaaaatcacctataatttgtatgagtcagttatatcctataattaaggaagattaaggccacaatgattgaaattaaataatatttttgatctaaatttttaattgttgtcttttttcccctcttctattttgcagttcttcgtgccatgaaggaggacagtgaaaaagttccgagcttgttaactgattatattctgaaaggtgagttttataatggtataggtgcgatggctgggaggtttggattagtcagtaaatacatcgccttgctaatacattagacagtaacttcccaatgcacaactttcattaatcttattatgcagggtgaggattagctacatgactgacttctaccaacattatatatcatggttttatataatttaagttttattggaggttctgggttggaaataatctccacagttaaactataaacatcaagagaggtagtagaagaaaattagtgagatggcaccataatcatgtgggtatcagatgttggcagattggcactgggaaatttgagaagggtggtctctgtcatcttgaggacagtggaaaggaggacagatcattagtgaggacggatgaaggaaggaagagtcacatctgtgaacagtgccaaagggaatacgaaagggactgatgtaagacacagggagggaagcggggaaataaaaagaatggacttgcataaacccaggaaagtgaaaaagcagccacaaatcttagaggcaaggtgaggctcacacagggtgggaatattgatgaggcaaaagaagagtgagaggttgagttgctttgccgagaaaagagcaaagtttggatgataaagaagggacggaagaacttaattagaggcaaaattaatactttacgatgaaatatttttttaaagtagcaggtattcagggaccagattttgaaagcatcacaaaatgcatctttgtagtgtttgatcaaattttgagagcaatcctcttctagtaacagtcttcttctctgggttctctctcttctccattaaagttagctgagcacaaggaagatgaagatttctgagacattagaaacctctgatggtcttttcttaaaccatagtgtcatgaaaggggaacctcagtagtatacacagggtgctcaaagtgaatcacacatttcacttgtaagagtcttgatgcggtgagagtaagaagcatgagctagacactagtgggttgacactggagtagaacagactgagttgacatcattttaaaaaataagctttttttctgatggaggactttttctccctataaaattctgaaaaattttttttttaatacctgacatctttgtttgcttttgtgttgtgctagcattggtatgaaagctggattgttctgaggttcgttcttctagatgtgaaacaggaatgagacgaacataaagaacatgtcttaaattttaattatatcgggttcctaggcctctatgagggccagagatagaatgagcttctgaagcattctctagctattttagcatttaactgcatggaaggatgttatgacccaaagaacagagtcctctggggaaaaatgatttttaattctttactctgaaaacctaggactataattgtgaacctacctataccgcatgccttagggaagcagcacccatctaattctgctcctcatgctcgggccgctggctcctgtctgtaagcccagttctatctatactgtacctgcttctgatgagctgtctgtgtgcatgtgttgtggttttgtcttggctttgtattgtgaggactgggtggaaaagcagcaaggatttagactacagtggagactgtagtcagagaaaatgaagacgggagtgcaatgtggagatgtatttacccaaatgtgtgtgggaaggtggggaagtcgggtcattgaaaatgctcttttccacccatcctgaaagttcacagctggttaactgttcctcttccttggggaccaataatacgacactttgcccgggagggggatattgctcaaggggagaatactccttccccttttttgggtggtttgttgttgttttaacacagatgagagtgtggcttggctgcctaaatacaccacttagttttaatgcaaatgtcagaagtgaaagaaggtagaaaagtggtctcatttggcctgagaaaagggagtagggtgggcactgtatgggctaattgagcttctctttctcgcacctgcctaatgaccccactgcagcctgccgccactgctgccttgacagtagtacccaaggctgattctgaagtaatgtacgcgtggctgctgccgtgctgctagttaggaataaaaatgtgtgcagaaacttgcacccttctttgacttccctagggatcctgtttgttgtgtcacaagcctcatggtatagggcgaatgttaggggcttctatctccaagtggcaccctaagagacatggccttttggtatctcatttctgggaaattctaatgtgtgttgagagaactcatccttgttgggtatagcctcttaaaacctttaaaaaattgctacatagatctttgcattaacatttagttctcattacttaatggtttttaaatgtacatgtaaaatgtatgttttgtgtaaatgtatacaaaatatacatttgtagctaaaagttctctttttcttctagttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaagttttgattttcaaatgttctgcttcatgtgtctgtgaagaattgtactttaagtgtgtgtcctctgaggtgcttgagaaagtgtacactgcagaactgcccattctcattactgtgtcctattttattcatgcctgtgtgtttttcttaagtatgaattctagatacagctacttatggattcatcaatatcatgagcacttttgctggttccagtcaaatcaatggcatttaataaattttttaagaagt

SEQ ID NO: 38062 - DNA, 385670 bp, Homo sapiens; identical to SEQ ID NO: 37662

SEQ ID NO: 38063 - DNA, 41470 bp, Homo sapiens
ccgggtcccgggtcctttgcggcgctagggtgggcgaacccagagcgacgctccgggacgatgtggggcagcgatcgcctggcgggtgctgggggaggcggggcggcagtgactgtggccttcaccaacgctcgcgactgcttcctccacctgccgcggcgtctcgtggcccagctgcatctgctgcaggtaacctgccggccccgagccacctgatcttcagcctggggtcggacgaggccgaagcctctcagggacgcggcgggacaccggctgccacccgggcgccgccgaagcgcgcagagatcagggtccctcgacggcagggcccttctgggtagtctctggatcccacaagtccagtgcagccctgggctcgtcttatcccaggtcttttcacttggtgaaactgaacctagaaacgtcctaatattctaccactgtttttataaatattccttattccaggctggaaaagctcctgagaagtggtttgtttttattattttaaaaggtgttttccttgccagccatttccagttaacctgcgctgctgccgtccgggccgcgagagcgggacgcagagttgttggcggagcccctgtcggttcccggggactaagcaccgcgtcccatgagcgggaaaggttaatacaatgatggttctgccctgcgtcgctgacgcggaacacagctgtagtgtgttaggaacacataacgtagttaagatcacttgaagctctgcgatcagtcgcccttctggacgttgtggttaggatgtttcacagttctaaccactggtggagatacagcgtccatattttcataattaaaaatagaggcacatggtctcacgagtttgagtgtacttatgggggcaaaaggacggcgtatttgaaatcctcataaatcctggatgcatggtacccaccagtggctaatctatgcaatgaatagagtttgcaataatttcaagcatcccttctttccacttgagttacttccccatacctaggggaagatatttttggtccactgaaaacatgagttcagcagaatcctcctatcatcgtcgttattattttttaccactaagtagacaatcttttggtttttgatgggctttatggctagagacaaatcagtcactgtcaccaagttccaggtagaagttggttcagtgctctgtcagcttcgatgggatttttcaacatgttttcaaatctgcacttaatagtaggaatgctttcttacagtaactctaatttgatcctaagatgtagttgttaccttacattcatcactgtttaagaatttagtggtcttgatctttgttttaaattttgagccttcgggaagtacttataagaattaattcatgcatatctttttgaaatgtaaatgtctttagccctggaacaaattgctgtttctgttcagcccatattagcagaataggtcaactttactttctaattatcaatgtaataagtttattactttatagattccataaatctatacatttattcctcgatgaattatataaatttatagaatttatgttttatagaaaatttggaaagcatggaaaattattaacaagaaaataagttacccataatcccagaacttagaggtgactaatgttgacagtttggatcaaatcttccagttttgtttctaatctttatttttaacataaatgaggtcctgtatacacacgtacagttttgtgtcctggtgtttttatttaatgttattatgagtgttttattttgttaaaaggtcatcattttaagttgttaattagtattctagcacaaatttgccataatttatttaattgtttactatgattgaccatttagattgtacttaatttttaggcattagaagtgataaactatattttaatcagacgttgaaaataacacatctttgtttagaaaacatcattttatttctggttgtctaggatagattcccagaattcttgggttagaggccatagataattatgaaagcagaaagattcacaagttgggagttaatacttgaattactttatttggggtgaagcattgagtgcataatacagatcatgcagtaatgggaagaagggttggaacaatggttttctggcctatgtcagacttaccttgaagcttttaagaatacagatgttctgatcaaccctcagacctattaaatcagacctaaaatcttagggaataggctttaggcatctctaattttaaaaaatttattcaggctacttggatgcacaaaagagttgagacctactgtcctagaatcatagaattttaatgacgatagagaccttaagcatctaggtcgtttctgtacttttacatgtaaggaaactggcattcctaggccagtaccattgccatgcagctaatttgccctcttgtctatagctcactctgcatcacccaacctaccgttctcactgtttcttctataaccaatctccttcccacttctgttctcttactcatgccattcttccctcagtcatttttcttccttccatacaaattccatgtctttaaaaaggaataatcctacctcctccacatagctttccaattctctgttgcccacatttgtctccctttcaatacttctctgttgtgttatgtgacacatcacatttgatatactctgtactgtgtttcaagtattgtattctcttgtttactcaagtcattatttcaggactgactacccagtagatgctttaagtcaggatttctcaaccttggcactgttgacattttgagctggataattttttgttttgggggctctcctgtacattttaagatgtttaacagcacccttggcctctatccagtagacgcctgtactgcctccccctatctgtgacaaccaaaaaggtcttcagacattgtcagatgtctactgaaggacaaaatcacctctggttgagaaccaccgcttcaactaagttatcttctctgtactcagaacttgatgtgattgcagcagggggagaggattcatatacacagtgaatgcaaacgaacctaaatcaccattcggatatggccacacaattttcatttcccttgtgttagcaagagataccctaggctttggacctgattattcctaaggcattctgatgtatggttttacctgcagatttcctggtaatactgatacctcagtttgggtcaaagaaggtcaattaattgattgatttgatttgactcctggaaaagacgctcctttctagctgtctctttcttctctttacctgaatagccagggctctgtggttcaagtgaagtattttgacataaaaattaacttagaacattggtctgcagagtttgctcaatataactgagcacatattgtggctttatggagctggttactactttttgaccaaataaataattagaagtatttttcctcctcaataaggttcatttttccttttttcagtgagctggtagagtttccttttttgatatttcagggcatctttcatatttccatctcttaagtttcttcatatgaagtagaatttatctggattatgtattgctgactctgatgaaaacccatagaaagcatctggggcttgatcaccttcattcttgtaatagctcacacggttacagctgatatggtaacttaagacttttgattccaaatctaggcaaaatacactcagttgaaagaatttgtcagccagaacagttggactgttctgtgaaaattgtgagaaaaattacacaactaagtgatacatgatgatggctttcttaaatataaaattgtaataacatggttaatttccagtacgttatattgtcccagaagtggctccaacattgtttgaaatttgtctcatttaaagaaacataagctggctatggtggctcacgcctgtaatcccagcactttgggaggctgaggcaggcagatcacctgaggtcaggagttcgagaccagcctggccaacatggtaaaaccccatctctactaaaaatacaaaaattagccgggcatttggtgggggcctgtaatcccagctacttgggaggctgaggcaggagaattgcttgaatctgggaggtggaggttgcagtgagccgagattgtgccactgccctccagcctgggtgacagagtgagtctccgtctcaagaaaaaaaaaaaaaaaagcaagaaacataaagactgggcatgttggctcatgcctgtaatcccagcactttgagagactgaggtgggaagatcacttgagcccaggaggttaaggctgcagtgagccgtgattttgccactgtactcgagcctgggcaacacagtgagatcctgtctcaggaaaaaaaaaattgcatgtaaatgaatgaatttgatatttaatattttaaattatgaaaactgttctgtagagatgtagatcttgccatgttgcccaggctggctttgaacttctgggctcaaacaatcctcctgtctcagtctcccaaagtataaagattacacatgtgagccactgcacctggcctaatatttttaacttaatgaatttattttgatataaataaattaataacactgaagcttcctgatataataagtctttttgtgtgtgtgacgggttctcactctgttgcccagactggagtgtaatggcactatcatggctcactgtagcctcaacctccctgactcaagtgatcctcccacctcggcttcctgagtagatgggaccacaggcgtatgccaccacacctggctgatttttaaaatttattattgatacatattaataaaattatttttattttaaaaatgatatatgtggctgggcatggtggctcatgcctgtaatcccgacagtttgggaggccgaggtgggaggatcacttgagaccaggagcttaagaccagcctaagcaacatagtgagatcccatctctatagaaaaaaaaaatggctaggtgtggtggtgtatgcctatattcccagctactcaggagactgaggtgagaggattgctagagcccaggagtttcaagttacagtgacctatgattgtgccagtgcactccagcctgggcaacagagcaaaatcctgtctcaaaaaaaaaaaaagttcgaaaatgcttatgatgcaatataagtagtggaaaaggatattaaattgtgcctatatgaacacaactatatgaaaaacttgcacatagagaaaaggattaacaagaaatagaccaaattgttcacatggttgtcttgtttgtggagagaatatcagtagttcatttgtttccttccaagtttatatgttttccgaggtctctataatgagtttgtaattgtttaatcatagaaaacccttttttggtccttggccacaaacttacatgttttaatgtaattgcttttttaatgagaataaatgttatattttgcttttttaaaacctatattcccatagttatatgagcccttacaattattaagaggctgcataatataacgtttctggaagggtacagaagaaacagcagtaattacctctgagaacagagacatggcttcacattttacccttttgtacgttttgtgcttttgccacatgcatttattattcttccaataaataagtaaataaatatggattgtatactccatctggttggtgtttcataattctaaaattatattgctacatttttaaagatgatatgtgtttctacttattaacgtatatgttaaaatagtaaatttatatcttatttaataatttccctattgatagacatttaagacagtctcaagtgttcactatcatagaaaatactgcacagatagcttttgctatagtttcttttttctttgaatcgttaattgggaataaatgctcaaatagttatatgtggctcaactgctatttaagtttattgactgactgctgccattttgaattctgaaggggttgattaaatttataatgctgccataagaatataagggtattggcttcattagcatccaccagcattgggtgttggaaatgattatagatttttaaatgctacaacaaatgtagataacagagaactatctatagaactctttttggacatgtgaattgtaataatagtttattttcatgtgaatccagaaaaatgtatacgaaaaccttttttcctctcatttcttatatgaatagaatcaagctatagaagtggtctggagtcaccagcctgcattcttgagctgggtggaaggcaggcattttagtgatcaaggtgaaaatgtggctgaaattaacagacaagttggtcaaaaacttggactctcaaatgggggacaggtaagcacatgtgatggcaataactttcttctaatatcacataatatagcaatagaaataaaattaaaagtttagattttttgttaaaggaggtgagatgtcacctaatttgtatgctattatgtaactagtctaggatattgaagctgactatactctgtttttaggtcattatcttgtagtttaccatactccctacttgcttcttattctactatttaactcattttccacatcccctaattttggtttcatgaaattatttttccttctgaattactaggttctacttactattattaaactttatttctgacatattttataaccttccatggtctcacttgattaaaaataaaaaattcagctgggtgcggtggctcacacctataatcccagcactttgggaggccaaggtgggcggataatttgaggtcaggagttggagaccagcctgcccaacgtggtgaaaccccccctctctactaaaaattcaaaaattagctgggcatggtggcaggtgcctgtaatcccagctactcaggaggctgaggcaggagaattgcttgaacctgggaggtggaggttgcagtgagctgagattgcactgctgcacttcagctgggtgacaagagcgaaacaatgtcttgaaaaaaaataaaaaataaaaaattctacaacacagggttattatttttccatttttgttttcccttatgagtttaatatgtttagattataaacctgaaagcttgaatacctatgtctatcttttgttttcttatgtttatcaagttattcctttaaacattttctaaactgtaagaataatgtgaggctgggctcaatggcttatgcctgtaatcccagtgctttgggaggccaaggtgggaggaccacttgaggccacgagttcaagattagcctggctaggcaacatagcaagaccctatctctataaaaaaattaaaaaaattagctgggcatggtagcaaatgcttgtagtcccagctactcagcagactgaggtaggaggaatgcttgagaccaggaatttgagtgacctatgattatgcactccagcccgggcaatagcaagaccctatctcttaaaagaagaagatgtagtaataatacatattcattataactattttaccattgaaagtaaaaaatgagtttttaccttttcccagtcccatcctcagaatggggatctcagtagacctttaggattggaagaatgagatcattcatattttctgcaattattaccccacaaaatatttcagatacctttccatgtattacaaacaatgtgcatttaacatgtctctctctttctctctctctctgtgtgcgtcttcatgatcctctgttgcagccctgccagtaagacactatctcctgaagaatcactgataggaacagaaagtggactggctaggccaggagtccttagcttcttagggggcaggagctgctttgtgctttctcagaatcagatatatatgtggactgaaacatttaaaaacagaatagccaagggtgctatacgtttaaaacttatatagatggggctacattgctctctattactaatttcccatgacaatacacgagagtgccatgtctttttaacttgttttgagcacagactaatcttgtttatgcatgttttttgatgagaataggctactcatgagaaatctgtaaacctaacactagtcccttgcatactctaaattgttgctagaatcttaaaattttagcaccagacggaccttagaaatcattaactttggtgctttgttctacaatacaaggagatggaatattttacccaggattgcttagcaggttacagttctgccctctgagtacccagcacttccctgtgggcaacatcaacttcctgattttcaagtcttaattagtactctgaagaatcctacttgtttttaactcccatttgctttgaagtgactttacctgatttttttagatcccttattgcagcaatgccactaagaaactgagtctctagcttcttggtgggcaggagctgctttgtgcttgctcagaatcatccttttcagtaagggagatattgaagagaaatctactgaggagtctgggggtgaggcactcagggaaatcctgctccagtccacaaaagcagagaggaagggttggttacctagagtatttaacatgcagaggctttggattttactcctttaatccttggaaatgcctatggaaggggaaaggaagtaagatggtgactccagcttatagacatactagtgttacatatatttaaactataataggagggtattattagttttacttaactttcaactgtgaaggattatacttctcaatatttgtctccagtgtctatttcagtgtatttttcacttttcttgaagcagcatgtctgttgcaaaacttctagaaataatgagaatatttatatattagatcaagccataacttgatgatatagtcatttcttcttatattttttacttacatttttacattttaatgattactttcatttttgaaaaacatgtcatgctgagatgtatttttcttcattctgtaattagttatgaaacagtttttcctaaaatgctgagtatatcaagtcttggctaagaataagtaataaatatttgccacatgaaagactacacatatagccaggtgcagtggcttgcacctgttttcccagctacccaggaggctgaggcaggaggattgcttgagcccagggtttccaggctgcagtgaactatgattgtaccactctactccagaatgggtgacagagccaggccccatctctcaaaacagaaaagaaagattacatagactacatatacacccccatccaaaacatacacacacatctacttaacctaaaatggtaagaagataacttcttattttctaatatatgacacagaaaagtttttttaaagtagttttaaatttttaattttttctaggtatttctcaagccatgttcccatgtggtatcttgtcaacaagttgaggtggaacccctctcagcagatgattgggagatactggtaaagaaaaccaaataagaactatctcatttaaggttaaattacttcacaatatcaatgtctttagctttctctaagctttattatatattctgagttggttttgaattataagaatgaattggggccaggcacagtagctcatgcctatagtcccagcactttgggaggccaaggcaggtggattgcttgagtccaggagttcaagaccaggctgggcaacatggtgaaaccccgtatctactaaaaatacaaaaattagccaggcatggtagtgcatgccattagtcccagtcacttgggaggctgaggcaggagaatcgcttgagcccgtaaagtcaaggctgcagtgagtcaggatcttgccattgtactccagtctggaaaacagagtgagaccttgtctcaaataaaaaaagaatgaattgatagagatctaatgtacaacctgacaactataggtaataaaattgtattggggattcatgttaaatgagtagattttaactactcttaccacaaaaacacaaaagtgggtaactgtgagatgatgtatatgttaatttacttcactatagtaaccattatactatctatatgtagctcataacaccatgtcgtgtatattaaatatgcacattaaaatttgttttttaaaaaaagaattgagattttttttaactagatatggagtggacaaaatgtaaagtgaattgatcttttcgtctgttggttctaggagctgcatgctgtttcccttgaacaacatcttctagatcaaattcgaatagtttttccaaaagccatttttcctgtttgggttgatcaacaaacgtacatatttatccaaattggtaggtgctattgtaatatttgctgtcatattctacactatagcattgagtccaaagtagaaatgaatgtgcactaatgagctttattttctacacagttgcactaataccagctgcctcttatggaaggctggaaactgacaccaaactccttattcagccaaagacacgccgagccaaagagaatacattttcaaaagctgatgctgaatataaaaaacttcatagttatggaagagaccagaaaggaatgatgaaagaacttcaaaccaagcaacttcagtcaaatactgtgggaatcactgaatctaatgaaaacgagtcagagattccagttgactcatcatcagtagcaagtttatggactatgataggaagcattttttcctttcaatctgagaagaaacaagagacatcttggggtttaactgaaatcaatgcattcaaaaatatgcagtcaaaggttgttcctctagacaatattttcagagtatgcaaatctcaacctcctagtatatataacgcgtcagcaacctctgtttttcataaacactgtgccattcatgtatttccatgggaccaggaatattttgatgtagagcccagctttactgtgacatatggaaagctagttaagctactttctccaaagcaacagcaaagtaaaacaaaacaaaatgtgttatcacctgaaaaagagaagcagatgtcagagccactagatcaaaaaaaaattaggtcagatcataatgaagaagatgagaaggcctgtgtgctacaagtagtctggaatggacttgaagaattgaacaatgccatcaaatataccaaaaatgtagaagttctccatcttgggaaagtctgggttagtataaattttataacttgggagaaattttatgtggcttaaacatccccaaattatgaattagaatagtatttcatatataaattgaaaatcaattaaaaagaaacacagtgcctaaaggcacttgggggacacatttacgctttgcagtaaagtccttgtttggataaagattgtatgttttctggccaagtaagcttgaataggtacaagcttagataggttcaggccagagaggtcaaaattacttgcctgagattgcatagctagtgttacaactaggattcaaacccaggcagattgacttgggggttcatcaggatggagtgccctacaaagcctcccatctttaatgcttgcagatttgttccccagttaccgaaagcaacttgttaatattagggaaaagggccagtgtagggagagatccatggcatgaggtaaccttcctgctgcatgtggtggcacctggattggaatgcatccaggagctgcttaccctgccggtgtctgctctttaatttgtgtataacggagaggaagtagacagggcaactagtgctccagcccctcatcctggccacaaatattaatgctacctttatatgacataagtcactagtccatttattggaacctaaatttgaaccactgtaaagtaagacttcatagtgataaagagaggaacttgttaggaaagagaataaaatagaaagagaaggttgtctccttttgtagattttttttttttctccaacagttttacctgtgacctttatacaaataactgacaaagcattaatctctttggcctacatcattttcttttctattttttttttccacaagatggagtttcactcttcttgcccaagctggagtgcagtggcatgatctggctcactgcaacctccgcctcccacgttcaagtggttctcctgcctcagcctcctgagtagctgggactacaggcatgcaccaccacgcctggctaattttttgtatttttagtagaaactgggtttcaccatgttagccagcctggtctggaactcctgacctcaggtgatctgcctgcctcggcctcccaaagtgctgggattacaggcatgagccactgctcctggccggcctacatcattttctaaagctccagaccattcttttcttttcttttcttttcttttcttttcttttcttttcttttcttttcttttttctcttctcttctcttctcttctcttctcttctcttctcttctcttttcttttctttttttgagttagaagcttgctttgttgcccaggctggagtgcagtggcaccacctccactcactacaacctccacctcccaggttcaaatgattctcctgcctcagccttcagagtagctgggactacaagtgtgcgccaccactcctggctaatttttgtatttttagtagggacgaggtttcaccatgttggccaggctagtcttgaactcctggtctcaagtgatccgcctgcctcagtctcccaaggtgctgggattacaggcgtgagccactgtgcctggcctcagatcattattttctgttagctttaaactgtccgttcaggagatcccactgcatcctcaaattcaaaatatctaacactgagcttatgatttagctggttctgtcattagatgggaatatccttttatttccttgaaattatatggtgagaacagggagaagtgctgatggtaaagtcctgtgattaagatagcaataaggactccgcccttcccactccactgaaggttgaagagccatggacaatgagaagtcacagtaggtgaaatcaggtactaaaatggacttggcttgagagatcaaaattgatcacttggtgatacaactaacaaattcatgttaacttgaacctttattaccctgtgaagcatggtgattaaaaaaaaacaacaaacaaacaggaaacttgattgttaaattctctttaagtcagaatatgtaccttagagtttttatttatgcttttgtctaccattaatatgtctgcacctgctctttagaagttaatagagagtaaagtcgtctttatgtctttcagtgcttacttatatttgggaagttgagaaaaatttttaacatcattattgatatatatatatatatatatatatatatatatatatatatatatatatatatatagataatttttttttttttcttgagacggagtctcactctgtcgcccaggccggagtgtggtggcgatctccactcaatgcaagctctgcctcccaggttcaagcgattctcttgcctcagcctcccgagtagctaggatacaggctcccaccaccacgcctggctaatttttgtagttttagtagagacgaggtttcaccatattggccacgctggtctcaaactcctgaccttgtgatccgcccacctcggcctcccaaagtgctgggattacaggcgtgagccactgcgcccggctgaggtaaaatttaaagtgtacaattcagtcatttttagtatatttatactagttgtacagccatcaccacaatctaagtttagaacattttcattagggggtgggagaaattttactctgctttttagattaagtttctgtctggatctaatcatttaatcagacaatcaggcagattgtctgtgattagttttggccattccagcttcttcattggttgttaactttcacaaataaaggctgctcaaagattagaaataacatttaatttgaatgtaaatgtgccatagtttaaaagatgggtttggtgaatacagtcaaatacatacatttaaagctctaattctgaagattatgtaaagaaaaggaaagaaatgtagggagaggattgaaatgttcatggtataacaatatctgaacatccatctggtcacaccgttggtatttgaatgttttgtcctcctcaaattcatatgtcgaaatcccaactcccaaggtgatcgtattaggaggtgtggtctttgggaagtgattaggtcatgaaggtgaagccttcatgaatgggattcgtgctcttataaaagagaactgtgagaaataagtttctgtcgtttgttagccacccagtttaggatattttgatatagcagcctgcatggactgagacaactatgagttattatgatagcttctgttatttcacctaaattcatagaagctaatatatcaatatttatgctatgaaatatttcttaaccaagctttgaatatatttatatttttgtttatttttaaatttcagattccagatgacctgaggaagagactaaatatagaaatgcatgccgtagtcaggataactccagtggaagttacccctaaaattccaagatctctaaagttacaacctagagagaatttagtgagttcaaatatatatgttacatcaaaattcttttacacgttttgtaagatttctagttgctttagctaagtaataagaatgttgtattcctttttgatacaaatctttttttattgtgttaaactatatataacataaaatatgccatgttcgccatttttaagtgtataattcaaaggcattaattacattcataatattgtacaaccatcaccactatctatatccagaacttttccatcaccccaaagagaaacttggtacccattaaacaataattccccgtccactcctttccccagtccctggtaatctctaatgtatattgtgtctctatgaatttacttattctagatatttcatatataagtagaagtatgcatttgtcttatgtatctgacttatttcatttaacataatgttttcaaggctcatctgtgttgtatgtatcagaatgttattccttttcatggctgaatactattccattgactgcatataccacatttgtttatccattcatctgttgatggacacttgggttgtttccacatttttggctgctgtgaataatgctacagtgaacattggtgtacaagtatctgtttgagttcctcttttcagctcctttgggatatacctaggaattatgtttaactttttgagaagctgagaaatctttaataaatgataacacaaatacttatatttgccaatgcaaatatgaatatttttggcttttaagagattgatcattttgccacgtggttgtaattaaaaaaaattgtcccatgttgtttcagtattaatattgtagcctaaaagagtgctagactgttttactttttactcagttaattctttggatactggtagagtcaggaaatgagatattgaacttaaagatctttgcaggtggggtccagtggctcacacctgtaatcctagcactttgggaagctgaggtgggaggattgcttgaggccaagagtttgagaatagcctgggcaacatagcaagaccccatctctacaaaaaaattaaaaaaaaaattaagccaggcgtggtagctcacgcctgttatcccaacacttcgggaggctgagatgggtggatcacttgaggtcaggagttggagaccagcctggccaacatggtgaaaccccatctctactaaaaataccaaaattatcggggcgtggtgctaatcctgtaatctcagctactcaggaggctgaggcaggagaaccacttgaactgaggaggtggaagttgcagtgagcctagatctcaccactgcactccagcctgggtaacagagcgagactctatttcaaaaaaagtaaaaataaaaattagacacatgtggtggcacatgcctgtagtcctagctactcaggaggctgactgaagtgggaggatctcttgagcccaggagttccacactgcagtgagctatgattgtgccactgcactccagcctaggcaatatctcaaaaaaaatttttttaaatagattattaggccagacgtggtggctcatgccagtaatcccagcactttggaaggccaaggcaggcggatcacctgaggccaggagtttgagaccagcctggccaacatggtgaaaccccatgtctaccaaaaatacaaaaattagctgcaatgtctataatcccagctacttgggagcctgaggcaagcgaatcgcttgaacccgggaggcagaggttgcagtgagtggagactgcgccactgcactccagcctgggcgatacagcgagattctgtctcaaagaaaaaggaatttgttttcctgtctttatcgtagagggaggaaagggagaatggggttggaatggttattgagtgagccacattatggtagatgtatcactgggcatagagaaaaggagcatttaaaacttttccgcctaacagatgtttcttcaggctacactgcactcattgtgctaactgtaatgtcaaatcccagacctgtgcctatagaacatgaacatccttcattggatttgtttggtcaggcttacactttattaggaagatcagatgttaaaataagggtgttaaagttaagttcagatatgaggataattcattactattcctttttctggcagcctaaagacataagtgaagaagacataaaaactgtattttattcatggctacagcagtctactaccaccatgcttcctttggtaatatcagaggaagaatttattaagctggaaactaaagatggtgagtacatttgttattttgacttttttttctatttaaatagttgtacatttttaattgttcttgcaacctgtcatacctgtgaacagtatgtgaatagtgaaatataattatgataattaaacagtagtttttatgtattgaaaaatatctttggccgggtgcagtggctcatgcctgtaatcccagcactttgggaggccgaggcaggcggatcacttgaggccaggagttcgagagcagcctgccaacatggcgcaaccctatctatacaaaaaaatacaaaaattagcctgacatagtggtgtatgcctgtagtcccagctacttgggaggctgaggcagaaggatcacttgagcccaggaggtctgtgttcctgccactgcactccagcctgggcagcagagtgagaccctgttggggggaaaaaaaaaaaagtctttaacttaaataaatttgacatttaaaatcttaaattatttcatctctgtttcagtactaactctgcatttattactttctttttaataggactgaaggaattttctctgagtatagttcattcttgggaaaaagaaaaagataaaaatatttttctgttgagtcccaatttgctgcagaagactacaatacaagtaatagcatgttattgaatatttaataaaatactatttgttacatatgattgataataaagtatgaagttccttgtaacaccttgcattgtgaagtgtattaaaaacctgctaagagtaaggaataacttgatttaaaatattttattctgtaatctctttaaattatctgtacaaattattgacttaacctaaatttaaaaatgaatgccttagcacaattaagttccaagaatagagttgatcatgttaactggtaaatggatcatgatttaaaattcttctaggattgaaacaaatgaaaacgtagttttaagggtttgattttttaaattcctatttttacatgcaattttactgcacaacccatcttattttgacagttcttaaattcgcaactcttcagaaatattatcagatcacttttctttgcttccataagtttttttattattatattattattttttttttttaaaagacggtgtctcactttgtcgcccaggctggagtgcagtggcatgatcatggctcactgcagcctcgacctcccaggctcaggtgattctcccacctcagcctcccaagtagctgggaccacaggcgaatgccatgatgcctggctaatttttgtatgttttgtagagatagggtttcaccatgttgcccagaattgtcttgaactcctgggttcaagcagttgttctgccttgcccacccaaagttgtgggattacaagtgtgagccactgcgcccagctattctagaagtattttaagagtcatcttttttttttttttgagatggagtctcactctgtcacccaggctggagtgcagtggcacactctcggctcactgcaacctccacctcctgggttcaagtgattctcctgcctcagcttccctagtagctaggattacaggcgcatgccaccatgccctgctattttttgtagttttagtagagacgagatttcaccatgttggccaggctgctcttgaactcctgacctcaagtgatctgccctcctcagcctcccaaagtgctgggattctaagtgtaaaccaccacacccagccaagagtggtctttttacaatattattttttgattaggacattcattcttgtcataaaattgaagatactctagtcatttagaatttcattgttttggaactagacattgtttctttatttttgaaatgttattgaaggaataccatttggagaagatacaaatgtaagaattgtgaaaaggataattgtgacacaaatcaaaattatagataaaaatatacctgtaaaatgtattaaggcaataacattctttctgcttgttgaccataaatatttatattccctggatgggtacattgttattgtcaagggtgtttaaataatgatcttgcatgcataatttattctctctggtataacagaatcagcaatttagttttctgggacccgagaaaaacatgcaaaagacatactttgaaatgtaaaactgatttttccttgcaactgtaggtccttctagatcctatggtaaaagaagaaaacagtgaggaaattgactttattcttccttttttaaagctgagctctttggggtaagaagttatggccaaactagcatgttagacatgtttttaacactatatctggcagagttttcaatgtaaatattaaagtagatgttaatgtcaataagtgatcttaataatgcatcagtagatattttttcaaggattgtctctatcttcacgcctagcttataatttgccttgtcgtctttttttttttctctttatttttatgtttttatccatccctggtggtaggggataaccttgtcttcttcgataacaagaagtctgaagcttattagaaattttactttgagaattgatcgatgagaagaaagcaactagatatcacgtggatcatatatgcttgaataaaacaataattcttagaacaaataaatacattttaaaagttaaagccaaaaacattagttgaatgtttaaaaatatttcaaattaagttattccttcactgtcttgtattactgtaataatttggattatttgtgtttttctcaacttttaaaacaaatatttaaaaaattcctcttttgattaagtagggctagataaaatataaaaaatattttttaaactcctcttaatttccatatttcttatataatatgagaatctcttataaacactacctcttagaagtctccacagaagctttggtagatgtagtagtagggatttgatttcttagaatggtataatctgtaaatgttttagtaaaaggattaaacgataaagtcaaaatgtttatagcacagtgtttattaatataaaataaaatctctttttttttttttgagatggactctcactttgtcactcaggctggagtgcagtgttgcaatctcagctcattgcaacctccgcctcctgggttcaagcaatccttccgcatcagcctcctaagtagctgggattacaagcatgcaccaccacacctgcctaattttttgtatttttagtagagatggggtttcaccatgttggccaggctggtctcaagtgatccgcctgcctcagcctcccaaagtgctgggattacaggcgtgaaccactgtgcccagcataaagtaaaatctcttcagactctcatgtgatcatgtaaagtggcaggcagtcacagtcaagaagtagtttaaagttcatgtttgtaaaatataatctacagattgatactggatttcataggtaatgtttaagagaaaataagtttttagttatcctcagtacttcaaaagcacccatttatgattatgttgattactaaactaaatcatttgggggctagaggtgtttttttatgtgttaagattccttaaggagttctattagggcaaaacttttagtaactgcatattttaaaagtaataaaactaattttaaaagcttggaggctgggcgcggtggctcacacctgtaattccagcactttgggaggccaaggcgggtggatcacttgaggtcaggagtttgagacgagcctgagcaacatggtgaaaccttgtctctactaaaaatacagaaattagccaggtgtggtggtgggcacctgtaatcccagctactcgggaggctaaggcaggagaattgctcgaacttgggaggcagaggttgcagtgagccgagatcatgccactgcactccagcctgggtgacagagcaagactccgtctcaaaaaaaaaaaaaaaaaaaagcttgaagtcagattcgacattaatcagtatactttctctcaagtaggggacaatttctaagattttagtcttttaaaatttattaactagtctgagcatggtggcttgtgtctataatcccagcactttgtggggccgaggcagatggatcacttgagcccaggagttggagactagcctgggcaacatggcaaaaccccgtctctacaacaaatgcacacacaaaaaacccaatcagctgggtgtggtgttacactcctgaagtcccagctactcgggaggctgaggcaggaggatcacctttgccagggcgtttgaggctgcagggagctgggttcacaccactgcgctccagcctggatgacacagcaagcccctttctcaaaaaaaaaaagataaaaaattaaattaaattaattaactacactgggaaggcaaaattcagcatttttttatagctaaattttatcctgcttcagtcttttatcatgtaactatgtatattttttacagaggagtgaattccttaggcgtatcctccttggagcacatcactcacagcctcctgggacgccctttgtctcggcagctgatgtctcttgttgcaggacttaggaatggagctcttttactcacaggaggaaaggtaagtggttaaggtgtgttcatttttctgtaacatttaataacttttcatttatctttctttgggttttgaccatctattatatagggtgggttttgaccatctattatatagggtttatacgacatatggaaagcattcatttattcactaatatttctgtgtgtctgcttttaggtgttgggggagtgatgacgaataagactgatgttctccatgccctttttctgtgtcagttgatacaattatatggtttttcttttttaggctattaggtgttgatagggttgagtaacttacaaatgttgaaccagccttgcatacctgtgataaataccacgtagttgtggtgtatcattctttctacattgctgagttttatctgctaatgttctgttgagcttttgtccatttaagtttgaaagtgattagtttgcagttttctgtttttgtgttgtctttgtctggttttgctatccgtgtaaatctggcctcataaaatgagatgggaagtattctctcctcttcttttgtttttttggaagaggttgtataaaattgaggctgaatcttggtggttgccacaatgacaggaactatttctgtgactgaatatattgggaattcctataaagcaattattttctagggaagtggaaaatcaactttagccaaagcaatctgtaaagaagcatttgacaaactggatgcccatgtggagagagttgactgtaaagctttacgaggtatgagtatggtaacactctatataaatccctttttcattagaaagacaggaatgttatacataatgctgtcaatctaataaatacacatatcatctagtctttaacttttctgtttatcatttagtcattaaaatttctttggctttctaatgtttttgataaaatttctaaaactctccatatttaatggaggcctatttttttttctagccagaactttttgtagactacatttctggaagtgctcactgacaccactctgaaaaattagtacttagaatatactctaattggtataaatgatctctgaattgctatggaaaactgggagaatggttgcttcaggggagagaaagtaggaggctgtggacagcaatgaggagaattacagttcaccatataacacttttgtacttttaaagtccttaacatttacattattatctattcaattaaaaaatattgggaagattttactttgaacagttaatttttcccccatgggtaccgctgtcatatagttccaactaatcatgaacttgtgtatttcctgttctttgtaaatttaaactttgtaactcaccaggaagtttgaagccaaatttgtgtttcaaatatagcaactccaggatctctaggcagatgcatttgcatttgattttaaatgaatcttgatcccttactctcacttatgttttcccacatcctactttttttattttgttgtaagccatctaaaattctcaatgggatgaaactgggtataaatgaatacatgcatacaggaattatagtagcatattccttttcttttttctttttttttttttttgagacagagtcttgctctgtagcccaggctggagtgcagtggtgcgatctcggctcactatagcctccacctcccaggttcaagcaattctcgtgcctcaacctcccgagtaattgggactacaggtgcatgccaccacacctggctaatttttgtattttttagtagagatggggtttcaccatgttggccaggctgatctcaaactcctgacctcaaagtgatctgcctgccttggtttcccaaagtgctgggattactagcataagccactgcacctggcctccttttctgagttttataaaatttgatactttactgcacgctttgagactgtattaattgaaccatgttgatgaacaagtttttgtgatgggtatattaataaaatatagatcaaatttttatagttaaatcaatatcgagcttttctagtgctttcaaaaggacaacctgaattttcccagcactgaaatgatactgaaaccatttcatatcttctgtattaaggaaaaaggcttgaaaacatacaaaaaaccctagaggtggctttctcagaggcagtgtggatgcagccatctgttgtcctgctggatgaccttgacctcattgctggactgcctgctgtcccggaacatgagcacagtcctgatgcggtgcagagccagcggcttgctcatggtaaatgcatccaccactggcttaaggtcttgttcttttgtcagtcagcatttttagtcttaacaataaatctactctcttcagagaataatatatgtgttatgttaagtgttgtgtttgaggcccctgatggcattctacagttgtcctatagactgtaatagcaaaattggtagagtaaaaacagtgtgaaaattctgcaacttcatggttagtcctttagggtttttcattctcccttacttattgtttaatttacagatttactcttttgttcatttgacaaatatttgtcaaatgcttgtgcacagtctgtattctcaaattctaggagaaaaagaagggtgaacagtattagcgcagaacgatactaataatgatggctactgtgtatgagtagccagccctttcttggctttcttggattgctttgtattctacatgaagatattccctgggctttacaggtcaataaatggaaattcagagagattaatttgaccagggtgaccaacaaggagatgacagcatacactatgcgagaagtatacacagagtagtgtaggagcatataacctaaactgggggtgaggtgggataaggagttatcagggaaggctttttggaggagttgacaactgagccgagttttgatggaagagtagaaattagcatgaaccaatttcatgctaataaagaagcaaaggaagcgtggtctacaggcaaaagcacagaggtacaggaagtaatgatatgttggggaataccctgttgactggagcttagagtgcaaggagaggagtgctagggaggtgaggttggagggtttggcagcattgacttgcttcaaggttcttaagagctgaaatagatataaaatgcaactaagagtggcttggattattattacctagtgtgttaatctcaaattttgaaatctatagcatctataggactggtgttactaatcttacactcgatctgttactgttcttatactagatctattagtccagtgtttaagggagtggtgcagatttctaggtcaggacaggactcagatgtacattattaatgcctatttcagttctgaccttctcatatgaaaccttataagacctggggtaggaagagattgttctggaagtcataggaatatgaactgtattttgtttaacaaacaatacagtatggaaatttatcacccttccagaatatttatttcagagacaaatttttatcattcgttcatttatttcataagatccacgagtagggaacctcactagacattgctctgagtatatggtctgagtttgcagtacctcttgtgtctccattagatttattaggtcctcaatagataaatcagggaataactagatggattcattttttaaagacatgaaagagcgataccatacatactgcaccttaaaggtcaaccttagagtatcattatttttaatgaatgtataatttttaaatttcatgtttacttttcctaagcttttgcactatattgcttaattccagctttgaatgatatgataaaagagtttatctccatgggaagtttggttgcactgattgccacaagtcagtctcagcaatctctacatcctttacttgtttctgctcaaggagttcacatatttcagtgcgtccaacacattcagcctcctaatcaggtaatacactacttgtaaggattattgaattatgtcccttttatagaaattatttttcaattttattagtaattcgtggctttaaatttatgcttctcttaatgattttaaggatatgtaagtcaacatttggtgcatattgtgctagaggcataaattataatttatagccacctgaaatgttagtatgcgctttccaagaaaatgacttttttgaaaatggtatttctttgaatgagaaagaacagagagaaatagatagatggcttttaaacacttcattaattaaactttttttttccaccatcacataatggcacttagtcccctttgggaactcatgagggttttagtggtagtgagctgaaagaaatatgttccaggactggcaaacatattctaaattctttaaaattttcacctagcatctaccctaaatattcagaccctgtgctagttaactgctattgaagaacaaaggtattatatctattattaaggataatagaatggtatttgagatattggtcattgaatatgaatatgttttgagaaataagttttataggaaccaaaaaaaaattcttaaaggaaccatatattactaaaaatgcttcttattggagaaagaaatgacaatcatttattaatgtgattttttcacaactttattaagatataatttaagtacaacaaactcacataaagtgtacaatttgatcagttttaacatatgtagatgccatgaaaccatcaccacaattaaggaaacaaacattttcatcactccagaagtctcctagcccttttactacccattcctcccctgctccatccccagacaactaccaatttgctttctgtcactatagatttgtcaacctgattttctccaaatatacattcaaaaatatacagttgaatacaattggaaattcgaattttgtgtttttttctttaggaacaaagatgtgaaattctgtgtaatgtaataaaaaataaattggactgtgatataaacaagttcaccgatcttgacctgcagcatgtagctaaagaaactggcgggtttgtggctagagattttacagtacttgtggatcgagccatacattctcgactctctcgtcagagtatatccaccagagaaagtatgttttactattaaaacctgaacttggaatcttctttctattgtggagaaatgtaattgtagtaagacaagaattaaatatattccattgtagtatttgaataagcagttatttgagtagaaaattagtgtttccagctaagatgatggcatattttgaaaattcatatagtgaatataactagtaaaagaagttttgtttatttttaaacagaattagttttaacaacattggacttccaaaaggctctccgcggatttcttcctgcgtctttgcgaagtgtcaacctgcataaacctagagacctgggttgggacaagattggtgggttacatgaagttaggcagatactcatggatactatccagttacctgccaaggtatgtttaaaaaaagaaaaagtgaatacttactcccagaagaaccactgtattattggctttggctttatgtgtcagcttgcccaatctccgtgtgagtcaacaagtgtttactgagttaccaaataaatgtcttaacactattttaggtactttaacaaattttaattttattaattaattttttattagaattgagacctcactctgtcatctaggctggagtacactcacagctcactgcaacctcaaactcctgggctcaagcaatcctcctgcctcagcctccccagtagctagaactacaggcatgaaccaccatgcccggccaactctttaattttcttagagacggagtcttgctatgttgcccaggcagacagattttaatgtgtatgatgcagtctttgatgataagaaacttataatggaaagctgaggtgatagttacagtaaatacattttgatgtataattctgtttgctttaatcattcaaattgtagtaaagcaagatgaactgtctgctgggatttgagcagaaatggataggaataaactaggaggtagaagagttatcaaggttcacaggactgatgggtgaagctagatttccagacccgggatgtcagtccttgaaaagcagacttggcaggcatagacgaggcagatagcaggataaaggagacaaatgtagattgttcttcagaagatcagatggtagagtctaggaggtagtgtgttttaatcagagatctgagaggcaaagatcattgcatgagatcagggacccatgcaaaggagtgagaaaaaaaactgggttaaggagcctgctgcatggcaactcctgggaacagtggccactggggcctgggacatgttgattgcagcccaggactgttaaaaccagtgtgagagaacatgggtatggaagtactagctagcaggatcatgaccccgatgctgggatggggcatcaagcattagtacatggagattcagtacatccagatgcagtacatggagactatatgcgtaactgctgactttgggcttctttcagattggagcagaggtagaggtgagtgggaatattctcaatagagggaactaaataggcatacctaataaaggagaccaggatattgcagacagtagcctcatgtttggctcacctgttcaaaaagttctcttgttcttgagcagtggtgccttaaaaggtaacttgagaagcagtcgattatttgttcagcctggagactcttgggatattttactatctttgattgaatagatttaaatgtacacagctctcataacttgccccatgaagcatatccatgaaaggcactatacttgttaaaagattggtttgtactttttaaatgtagtacttttaataaaacaggaaaaatagaagttctgatgcagttatatgcattttatatagaatgtgttcttaattggaaaaaatttgtcgtagttcctttgagttcatttacagtttttagtaggaattgtattttctactgttgtacttgctgttactaaagaaagatggtcgtgattaccatctgaattttttttctatacattgatctttagctgctacttagtcatttctgtttagacttgagctctttttcatattttttttttttgtttctcagtatccagaattatttgcaaacttgcccatacgacaaagaacaggaatactgttgtatggtccgcctggaacaggaaaaaccttactagctggggtaattgcacgagagagtagaatgaattttataagtgtcaaggtatgttgtctacttatcttctttttttatttaggtaaaattaacataaatgcagttagccatttcaaagtgtaaattcactggcatttagtgcattcacaatgctatgcaaccaccacctctctctaatttcaaaactttttcattccactcctcctcttgcttatcccctggcaaccattcatctgctttttgtctctatggatttgccttttctgtatatttcatataaaacaaatcatgcaatatgtgaccttttttgtctggcttctttcacttatgtaatgttttcatggttcatccaggtagtagcatgtatcagtacttcattcctttgcatgactgaataatgttaccatactttgtttatccacttatcagtggtgaacatttgaattgtttctaccttttgactattatgaataatgttgctgtaaatattcatgcacaaatttctccacggatatgttttcatttctcttgggtataaactgaggagtagaattcttgggtcttagggtaattctctaacttttcaaagaaccaccaaactgtctttcacaccaactgcaccattcccactagcagtgtggggggttcctgattctccacatctttaccaacaccattatgtttctcaattgtgggctagtctcacatttggaaagctagtgggagcagcgatccatctattaaaagttgtatgaaattgagtaatgagccacctctctcttgtagggcttattatgttcttgcttaaggcaatcttcatgcattgtgaacagaattatacataaatgctcagataaaagggcaaaccattcttaaagggagtagacaactagaggcaggagaccatactgaggcaggaagctggggtttttatggttctgttacttttgactatatctcaccattgcttttgtcaaagtgagactaggtctaagtttttttcaggtataaggtgagtgtggtaattaaggggcatgctagcagatcattttgggtaatgcttcacagtccaccactggtgtgtcattgtggtcgcagatccagtatcttagctgtgtaatttcagacatcagcaatattagtttaacaaagggcaattagattccaagacaaaggaatcgtgtattattctagccttattcaaacttgatttataaatcagtttagtaatttatttatttgtttctgtatttatttttatttctttgagatggagtctcactctattggccaggctggagtgtagtgatgcaatcttggcttactgcaacctctgcctcctgggttcaagctattctcctgcctcagcctcccgagtagctgggattacaggctaatttttgtatttttagtagagatggggtttcaccatgttggccaggctggtcttgaactcctgacctcgagtgatctgcccgccttggcctcccaaagttctgggattacagacgtgagctaccgtgcccagctcagtttagtaatgtataactgggttttacccagttgtaaattactcttttgtcgtgtttttttgagaactggcaatgacggagaaactaaaagtgccaggctgttgccttgttcctgttattttgccttagttttttttttttttttttttttctctgagactgagtcttgttgtgttaccaggctagagtggagtggcatgatctcggctcactgcaacctctgcctcctgggttcaagtgattcctgcctcagcctcccgagtagctgggattacaggcgcctgccaccgcacccggtgaatttttgtatttttagtagagacgggattttaccatgttggccaggctggcctcgacctcctgacctcatgatccaccagcttcggcctcccaaagtgctgggattacaggcgagaaccaccgtgcccggtcttgccttagttatttcttgttccctcctctagtcctatagttctctgactgtattgaggaaatgtaattaaatattattatgttaatagatatttatgtggttgaatattagaaattccttattttggtcacatatcctgatcagtagttggtcttctggagatagtgatttttcactagagatgactttaggacctattcaggttttttttaagatcccaatttaaggaaagactattctcattattgattttgctatatgcagggaaatttatttcgaaaggtttttcagttggcttttagggaagattatatattctctttttttttttttggccttttcccacatgttctaaaaatgatatattctttaactcctatgaaaatacattgtttcagtaattgaagatgctgattaaagtcatatctctacacattttttaaaatttgagatagatgggactttgtcccttcttacaccattcacttattcacttggaaaaactattatccaatacttatgtggcagacactgtttctggcacaagggattcagcagtgaacaaaactgcctttttggagtttacattctactagtggaaagcgacaacaagcagatagacacattcagtatataattcactgtcagatggtggtggtaagtcctatgtaggaagaaaagcagggtaaggaggcttggagtaactggagtgagtcatagatggacttgtcaggaaagggtttctgaagaggtggtatttgggcagagatctaaataaaatgaagcaacaagccatgagaatatccgggggaaaatgttctgggcagaagcatcaagcatagaacttgtggtatgatatttattctagcacacattaattttaaaaatgtataaaagacatccatttaatcatattaaagatttccatgattcatttagacttagtcagaaaccaaatttatattttctttttaaataattttatctcaactcttattttacccaataggggccagagttactcagcaaatacattggagcaagtgaacaagctgttcgggatatttttattaggttggtagcctatgaatgtttttaaagtaactgactctgttattatttatcaatcagtgctttttttggtcttgttttttgaagaactgatatttgaaacctgtggtttatgtgaattattaataagctagaggacgtggattctctatttcatcaaataatacaaaacattttagatattaaattttggaaattatttggttttgttttacaatagaaatactcctcaaagtggaatcgaagtggttattcaaagaaatctcagagtagattcttatatgaagcaaataattgcccctaatttatctctaaattttgtaagttctaaattcttttttcccccagtttctaatttatctcttataagtcaagagtccatctggccaatttaatttcagtgagtgtaactattttgcatatattaaaaaactgtatatgaatacagaagatggtatttaaggatgaaaataattattcaaatgtgatagcattatggggagttttaaaataaaagttactgttttattcttccaaaaattttattataaagtatacagttaagagaatatacataaaatacatatgcagcttaaggaagaataataaaatgaatacttcatgtattcaccaccgagtttaccaggaaaaagcataaacaaaataaacctcttccacgtaattcctgggttaaagagaagttatagtggaaaatatttgggagcaaacgataatgaaaatactatccattaaaattgttagatgttgcaaaactgatttcaaggaaaatttatagtgttaaatgtttagaaaagaaaaaaggttagaagttaaccacttatgtatctatctcatgaaattaggaaaattatagatataaactaaaaaatatgttaaaagggaaataataaagataagaatgaagtttaatgaaacacaaaacagagaagctcacaaagccaagatttattttttgaacaccgagtacaattgacaaatctctaacaagtttgattaagaaaaaagaaagcatgaataaacaattttagggataaaaagggaaacatcgctaaagatatcccagaaatgtaaaagataataagggaatattatgaaaatattcatgccaatacatttgaaaacttaggtgacatagacaaaaacaaaattgaccaaaattgagcaaaaaagaaacaaaatctgagtagtcctgtaacttagtaaaaattgagttagaaaagttaaagaagtctttacacaaatcaaacatcagactcagttttctaggagagttttgccaaacattcaagtagcagataattctggtctatttttggccccagaagatatattttacttgccatgcatttaatgagatagctgttgatttttttcaatcaccgtgacaggtgttttatattaggtgttattcgccagacatctagtccacctgttgccagatatggaattaatattcacttattttgaattaaaatttgttaataaattaataaaacaaagtcaaagttcaaattattaaaaaagtaaaagaaataaaatatattttatagagagcccttacaaaacagtaccaacataatgagctttccaaattttgaatgggcaaaataaatgaataggcatttcacaaaagaaggaagggtggccaataagtatatattaatataaaaatggttacttgtaataggaatcaaaagtgtttgacttattgactaagagtcagtttttgttttgatccctgttagtctatccagaaggcatgggtcttaataaacaccttgacctcaacagtttactgaatacaagggtaatttcatatgccttgccttctttaagggtttgttgtaaagattaaaataaatacataaatatatataaatacatttatatgtatttatatgtaattacatacaacttgccttctttaagggtttgttgtaaaaattaaaagaagtatataaatatatataaatacataaaataaatacattcatatatgtatatgaaatcactttgccaactatgaagcctgattcaaatatgaaatgttgtttgtttttcccagagcacaggctgcaaagccctgcattcttttctttgatgaatttgaatccattgctcctcggcggggtcatgataatacaggagttacagaccgagtagttaaccagttgctgactcagttggatggagtagaaggcttacagggtaataattataaatacagaaatagaatgttataacaaaatgtcatcatgtcatcagattttggtaaaaaaatgttcttttttcctctaggtgtttatgtattggctgctactagtcgccctgacttgattgaccctgccctgcttaggcctggtcgactagataaatgtgtatactgtcctcctcctgatcaggtgacaatttcatatttagagtccaaaacccaacaaatgctacactctttccttgtgagctttacttctgccaggtaatggcaattgtccttagaagaccagctttcttagggaaaagctttagccactgtttgctcaaagcataaaaagattctgaattagatgcaaagcctttttttggcccagtgcaagtctgaaaactttgtaatccttctgtgttggctgattggggaaaaaaaaatgcaagaaacctaatgtattatattttcacattatcttctgttcaaagattacatacttccattatcctgtcaaaaaaaaaactctgatacagaatcaagcatgtgaatcgtaagcatgtaagcaggtttcatagagataatttttcaactcttccttgtcctgtgttgttccaactcttattctccaatttagaagcaaacaaataaatgaatgaaagaacagatagacaaatgaatagtcaaaggtataaagtatctgtatatatgttacatgtagctattatttaaattatttagattttccttttgaaataccttcttggcacacttgcctaaatctagaaaataagcactgtgtgaataagaaattatttacactgaatattttgtaggtttttgggtttttgtttttcagacaaggtctcactttgtcacccaggctggagtacactggtacgatcacaactcactgcagcctctatggcccaggctcaagcaatctccccacctcagcctcccgagtagctgggaccacaggcacacgctaccatgcccagataattttattattaatttttgtatagagatggggtctccctgtgttgcccaggctttcttgaactccagggctcaagtgatcctcccacctcaacctcccaaagtgttgggattacaggcgtgagccaccatgcccagccttaagagtgtttgattttcattcattttcctatatatattatttctgttggggaaaaaattccaaggaagataaatagtaggctgttggtacatttctcaacttacttataaagctttttagatatataaggttaatttatgaagaaaatcataagatacacaatttaagataatatttttaattttattttttatttgttaaataaatttttctcctttcaggtgtcacgtcttgaaattttaaatgtcctcagtgactctctacctctggcagatgatgttgaccttcagcatgtagcatcagtaactgactcctttactggagctgatctgaaagctttactttacaatgcccaattggaggccttacatggaatgctgctctcgagtggactccaggcaagttatatgaggaagttgttatgacattttatgagtgataaaagaagtacaatgtcaaaatttccaccttaaaaaatgctattttttaaacaactttggtaaaactgtatagaaacataaatttacctttagttgaatgttccatagttggaatatgggttttgcagagaatttataattatgaagtttgatgtctgtttctttaacattaccttaatattggcaaaaacatgttggtgtttgcaaggatattatttaaattgggataccatgaattaaatactacaaacaaaaataattagagttttttgtttgtttgtactttaacttttaaaaaataatcagttaaagttgttgttttgaagctcacattgttccaatctggccaataggagccccttttgtatggctcctgtatctttatgacatgtcctcatcattcttgaatcacttcctcacttccagatacagtaagttattcttggccaggtgcagtggttcacgcctgtaatcccagcactttggcaggccaaggcaggaggatcatttgggcctagtttgagaccaaatcatggttgcacaaactgtacccactatggacaacagagtgggatcttgtctctgtgaaaaatttaaaaattagctgggcatggtggcacatacctgtagtcctagcttcttgggagaggctgtggcaggaggatcgcttgagtaaatccaggatgcagtgagccatgcttgtgccactgcactccagcatggatgacagaatgagaccctgcccccaaaaaagaaaaatattcttggtttatcttgtactttctgtatcccagccctagcatcagccttttctctaaagacagtattatgattttaatatttacagtagatatttgaactgttacattatagactttaccatatattttctaggaaggattattctattactcttctttaccacatttgtttggaatgtctacagaacctacagtttctaaatcagaaactccctaggtttttgctattttggcaagccattgaagttcttccctctccctttactaccagaaaggtgtgtatttgtagagctctctataatgagaaagcactctataacatggttgattcatcattttggagtagaaaagtatgaatggaaagtcagagacataaaaataaagcccagaggtctgagtcttagcttcattacagactttcttgggggatggttggtaaattatctacacattctatcttgtctttataattttaatagttaaatttttaccatgtgcctcaaaaccgttagagaattaatgagctctttgaaaaatgcttctaagtttcttgtattgctctaatagaatgctatctatgttattatttatttctgagactaaaattgtttacatctttaaactggttgtccttttgtgtattttaggatggaagttccagctctgatagtgacctaagtctgtcttcaatggtctttcttaaccatagcagtggctctgacgattcagctggagatggagaatgtggcttagatcagtcccttgtttctttagagatgtccgagatccttccagatgaatcaaaattcaatatgtaccggctctactttggaagctcttatgaatcagaacttggaaatggaacctcttctgatttggtatcttgtgcagtcatcattatacagttctgaaatataaagctatatgttggtgtaaagttgcagtgatttctctcctaaccagccccacatattcttcctggttggttggttcttcagtaaaatagtcttgtttcttgcttacactaattggtaatttgcattccttgttaagattttcaagacagggctgggagcaaggaaccaaagtagcgcgtggttgtgattacctttggtttctttgaggtttctcttacctagtggctttaaaacatctttaggagcagttccattttatagtaaacttaaattctgttatcatgaacagttgaggataatgaataatttgatacaataatgtaagaaattcctgaaaacaaagtgttatctgtgatacttttgctgcatagtaagcacaatgaagtgtactgataatgtttcaacaggaaagtgttttgattaaatgtgggcagtatcactgttctactagcattcaacatctcttctaaaaattaatagtggttcactgtaattttattggtacatgtaacatctgtacatgtgtttggttatctatatgtttcctggttttttgtacatttgctttattaatttaggcttttttttttttttttttttgagacagtctcactctatcatccagactagagtgcagtggcacaattatggctcactgcagccttgacctcctgggcttaggtgattcttccacctcagcctcctgagtagctgggactacaggcacatgccaccatgcccagctaatttttgtatgttttgtagagacgaggtttcaccatattgcccaggctggtctcaaactcctgggctcaagctatctgcgtgccttgacctcccaaagtgctaggattacaggtgtgagccactatgcctagcctaactcagactttaaaaatataaaagcaattcatttttattcccaagaacagtaaggtggtggtttaattttagtctttaattctgtttttaatttattctatttagaaatgtcccagaaacttagtataactttactttctgaaaatgaagaaacctgtccttgggcattagtgtgttggatttaagcaacaaagttaaaaaaacctaccctgtgttatggcaattttcacttgatggtggttctataacacaggtatcagtgaacctttataaaagatgaacaacttttcagcttgcttaatttcagttaattaacatgtatacttatctatgttaatgttttattgcttaaaatgtttaatttttatatttggtaaacagatagttttttctctccccctcttccttccatctttcattactacaatttaccatgcagagctcacaatgtctctctgcaccaagctccatgactcaggatttgcctggagttcctgggaaagaccagttgttttcacagcctccagtgttaaggacagcttcacaagagggttgccaagaacttacacaagaacaaagagatcaactgagggcagatatcagtattatcaaaggcagataccggagccaaagtggagtatggctttttccccctcattataattgttaaaacttcttaaaaattgtttcacccttttgatatatatttctttgacttataaacgagctatatttataaacaagggaccagaacacattaactcagtcatggttatgtgcttccttgctttcaatgtttcattatcttataaggaagagaacgtatggtctcttgaaaaaactgacaataagaagtaacaactggactaccacatttttttttacatccttaatttaactcttcgtcaatttctttttttacttaaggaggacgaatccatgaaccaaccaggaccaatcaaaaccagactggctattagtcagtcacatttaatgactgcacttggtcacacaagaccatccattagtgaagatgactggaagaattttgctgagctgtaagtaacagattctgttttggaagtacagctactattacaagtgacatagtattacacttaaacctttaaagttcgtgtttaaaataaaaatattttgaatatttaaaagctaattcaaaaaatatgtgtcgtagctatgcattaaaaaaccccaaaatgtcagaagtacagaagtcaaaattgagttttcattaaccagttcatttgattatatttgaattattcataatggactcatttaattttagtaactttgggctgggtgctgtggctcatgcctgtaatcccagctctttgggaggccaaggcaggtggatcacctgaggtcaggagttcgaggcaagcctaaccaacacggggaaaccccatctctactaaaaatacaaaaattagccaggtgtggtggcatgtgcctgtagtcccagctacttgggaggctgagacaggagaattgcttgaacccaggaggtggaggttgcagtgagccgagattgcaccactgcactccatccagcctgggccacagagcgagactgtgtctcaaaaaaaaaaaaaaaaaatttagtaacttcgaagaaataagaaggaaaattaaaagttgaaagtgattctaatgtatagtttataaaattttgttataaaaatacctgttttgccttcaaaataatttatattaatattttattgacctcaagaacatttaaatacattcagatttattcatttgtggaccacatttgttatacattggatttaaaggatccttgcaattgagtttatggccacctatgcatctgagacccatggactgggaaccattctaggtcaatgattcagtgtgattcaatttaagagatgtttattcctggtctttagaagctgctaccttttgttatctaattttgcagtactttgaagtatgtatgtatgtgtacatacgttagtgctatgtatttattaaagaagaatcagaaaacagaggtaaggaaaaataaggaaacaaatttctgttaagcccaccacctcccaaagcatatttgtttatatgcttatatatgttttcctattatggtaagaacagtctgtacatattgctatatagcagtccccctttatccacatacatcctgaaaattgttttacattttaaatgttaactactttattgtttttaaatgtcattttatagtgtagctatgccacaatatccaatttttagacatttaaattgctcccaggcaatgtggtaatgaacattcttgcagctgaatatatgcacatatctaattgtttcactaggatagaggtggaattgtataacagggagctcacattttttaaggcttttgaaatgtattgccaaattgcctgccagatatactgcaccatcactaacattgtgtgttgcagtatttttctaaacttggcccttttgattttagaaaaatgatatcaataatttacatttctttgattaaagtgtagaagttataatttttcatattattcattgtcatttgtattttatcttttctaacttgtctcttcatcccctttgctccgttttctattggagtgcaactttatttgtaagaattctttttaatttctgtgactggaatttttttttctagtttgttatttcccgttcatttcttaaaatataattgtgtttgccaacaatccattatcttttgttttgtaatggtagtatttatacatattaaattatctctttcttttttcagatatgaaagctttcaaaatccaaagaggagaaaaaatcaaagtggaacaatgtttcgacctggacagaaagtaactttagcataaaatatacttctttttgatttggttctgttaagttttttgatggcttttccatatgttgtaacaggaaaaaaatggtgtctatgaatttcttcttaatttaacaaatttggttaatttataaaatcacagattggtaaatgctataattatgtaatgatcaggattgagattaatactgtagtataaattgggacattataacagattccatattttatttcctaaaatctaaattcagtctttaatgaaataatattagccaaatggtggaactaatttatttcttttgaggaaaagataataaagaatgtaattaaatttaaatttcttggaattcccagttgtatattcatcacctttgtagcatttgacaaattttatgcttagcagcttcttcactgttttgaaataaaatatcctattacctactg

SEQ ID NO: 38064 - DNA, 1791 bp, Homo sapiens
ggaaggcttctgagaagactggtgggagagaaggagagcctgcagacagaggcctccagcttggtctgtctccccacctctaccagcatctgctgagctatgagccaaaccagggatttacagggtagggagggtgggataggcagcggcattagatcggaggaatgagatggacagacctgggctgtgggctaggagggcagtcagctggcctagggtagcccgggctggtgtcagggtaaggagaggaagggagggatgagggctgattaatttttttcaccccacaggaggaaaagctttcggactgctgaaggcccagcaggaagagaggctggatgagatcaacaaggtagaaggaagaactaagggggcagagccagggggatggggcgtggatggggagggcctaccctggctcttattttcccctccatagcaattcctagacgatcccaaatatagcagtgatgaggatctgccctccaaactggaaggcttcaaaggtgagggggaaactgtaggcggtggagacagggctgggggtaggagggttaggatttccacaagaacaaggcaggaacagcagagataaaaagtttacttttgtggtagcaaaaggggaacctgcctttattgccctcctgccacactgcggtccctttcccgggcctgcctctctcagcatcccctctagctccttacaccctagcggggcccctcaactccccaaccccacttcctctgcctgcccctcctcctccttccacgttgtctcctccacctagcagttggttggcaaccccttcctcagtcccctgctgaaaaccctccagtcagcgcttatcccttctgctctctcccctcacccagagaaatacatggagtttgaccttaatggaaatggcgatattggtgagaaacgggtgatttgcgggggcagggtggtgtgcaggcctaagaagacagaggtctctcctacatgctccattcctcatgatttgggagggggcccacctaccacagtgggaggaaggagaatggggatgcggaagtgggagaggagagagagggtctccccaccttctccccatccccatcctctgcccccagatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgtgagtgtcaatttccaacctcccctgtacttacctgttttctcctcccccatccctacccttgtccacaggctcaacatttctacacgttgcccatcatcccttcttccatccttagagggacccttccaaggtcccgaccccatccctatccatagtcctggtccccagaaactccaacccctgcccttcctcttcccccttccaccctcacatccccatccccttctagcctttcctagcaccctatgatttattcccttgagaggagtgttccctgatccctgtgcctcttcccatctcaaccaggatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccagatcaa

SEQ ID NO: 38065 - DNA, 14964 bp, Homo sapiens
aaagcggccatgttttacatatttcttgattttgtttgttttctcgtgagcttaggccgctggttttggtgatttttgtctgattgcaatgtctggacgtggtaagcaaggaggcaaagctcgcgccaaagcgaaatcccgctcttctcgcgctggtctccagttcccggtgggccgagtgcaccgcctgctccgtaaaggcaactacgcagagcgggttggggcaggcgcgccggtgtacctggcggcggtgttagagtacctgaccgccgagatcctggagctggccggcaacgcggctcgcgacaacaagaagactcgcatcatcccgcgccacttgcagctggccatccgcaacgacgaggagctcaacaaactgctaggccgggtgaccattgctcagggcggcgtccttcctaacatccaggccgtgcttctgcctaagaagaccgagagtcaccacaaggccaagggcaagtgatttgacaggtatctgagctcccggaaacgctatcaaacccaaaggctcttttcagagcccccctaccgtttcaaaggaagagctaacctcactgcttgtaggtagaaggaaaaaaggcactaaggtaagttaattttatgccaaccttgagcaaagcgtattactgcttttcggtttttggggagcgctgttactaaaggttggtctgtttgtatgtaatagtaggtcagttacgtactatcatactctaaagaaatattctagttaatgctttgtaagatcgaccatagttagtgcctaacagtttacatgcagggatgcctcgtgatctaaacacttcgttgtgattactttaaaaatgtaaattgaaggcaaaactctaacgtgttggtaaccttgtttggtcctccgactagtcccccgtctatttttttctcaatttaggctgtaggcagcctcactttcctaattctgtgagagttataggtcccattcctgctaaagtgcagagtatattacctaaaagttaaccagggagttgaaaggtgtctgtaaaacagactaatgtccctaatgtagaacggtgcctgacatgcaacttactcttgtattttaagaagctcaagcgtctaggttgccattacaggcagaaaaggaaatagagtggggcctgtggccactcaaaaacctttgctttctgctcacccctctaatcctaccactttgggaggccgagggggctgatcacctgaggtcacgacttcgacactaacctggccaacatggtgaaacacctctctactaaataaaaataataaataaaaaaataagttgggcgtggtggcacataccttgtaatcccagctactcttgaagctgacgcaggagagtcgcttgagcctgggaggcggaggttgtagtaagccgagatcgtgccactgccctccagcctgggcaacagtgagacacggtcccccaaaaaaacctttgcttctagggatctggtaacagctgccccacccacaagaaatggagatctgggaccatggacaaatttctagagacctattttcctggattctgtgaatctcgccgaggttttcttccggatctcggtttctgcatttttttgtttgtttgcttgcttttttgaaacggagttttgctcctgttgcccaagctggaatgcagtggcgcgatctcggctcactgcatacaaactccgcctcccgggttcagacgactctccggcctcagcctccctagtagatgggattacaagcgcccgccaccagtagaaacggagtttcaccaggttagccgggctggtctcgaactcctgacctcaggtgatccgccagcctctgcctaccaaagtgctgggattacaggcgtgagccaccgcgcccggccggtttctgctttgatcggaattaagtgggcagaaaagtctaggcgggctaagtcttgcctatgcatctgcgcccagctgctcagactggccaaacagacccagtcgtttagtctaacgcttctggaactccactgaagcgttttgcattgtttcgtttggagccttcaaatccgagtgtgtggcaggagataataatcctagcagaagctgtttactgctgacgcgcctcccacttcccagatactgacaccggctcagggcggatccagccttttccgctcttccctccctccaccccctcctttccctacaactactctcaaaggaaaagggttggatgtcccatttgggtgaaaacaaagtggcataaaagcaaatgatcacctttgatagccacatattagaattttccgagggtatttttaaattacaacgattctaatgggcagctgggctgagaatcatcagatttgaaggtctggtttcacatggctcttgggctgagaagaccggattttccccccccagcatttcctgtatgtccgagaatttcgatcctaaggttagaattgccttatgggccttggaatcctttttattcactgaccaaattgcctttgattccagctcccaatcggtgtgtgaccttggcctagggcttaatctcttcctacctccatctcttccttgtatgcttttgctcaccttgaaatgaaaagaacctggctcagcaagtgtagattctgaaatcagaaaacaggctgaataagagagatggtttattaggcactactgtgtgccaggcacatttcatgagcttccagtatgttaattcatttaatccaacaatctaagagataggttttatccttattccgaattttgagatgagcaaactaagaaacagcttaaagaacttaagttgtaaggccaggaaaacagtacttataacagctgactattctataaccacacctccttaagagattattgtcagaaaaatagaaagagtaaaacatccatacataatgggtaaactttgtccacataccagaatgttactaatggctttctaacctctgaagaatttaagggaaggaggaaaggtaattttccccagggaatctacacgaagaggtaaatcttgacaatgtattaatactgtaaacccagggaaaaaaagccagtacaatttttatttagggtgtggcaaataaaacaaagggacacgtgaaaacatggctcagtaaagagctacaagacttggtgcaactgacttattgtggtgagtgagaaaaggagagagagaaaacttgaatttcaattcttctctctgggctccaataacaagattttgtattcggtctatttagtagtgaatgatacattgtgttaagtttgttaacctagaggctttcatcttaagcagtacttaagatgtagaccccctcttattcaaatactgataatcagcatagaacttggcatacaagagacacttggctgttgggcattgagaaaatgttgaactgaatgaatcaatgacttaggcagccaggaagcactttgttgtagagagttggtttattactaaggaagacattaagtattaaatattagactaataggttgctaatagtgttttctctttccaatagaaaatgtcttctgaggctgatctggtgtctcacatctgtaatcccagcacttggggaggctgaggtgggtagatcacctgaggtcaggagtttgagaccagcctggccaacatggcgaaaccccatctctaataaaactacacaaattagtcaggtgtggcggtgttcacctgtaggcgcctgtagtcccagctactcaggagactgaggcagaagaatcacttgaaccccgggaggtggaggttgtagtgagccaagatcgtgccactgcactccagcctgggcgacaaagtgaaactccgtctcaaaaaaaaaccaaccccatctctactaaaaaatacaaaaattagctgggcatgctagtgcacgcctgtagtcccagctactcgggaggctgaggcaagagaatcacttgaatataggagggggaggttgcagtgagagtgagactctcaaaaaaaaacaacaaaacaaaaagtaacaagaaaaaagaaactatattccaaaaatccaaatttcactggcagtttgttctgggagcttcagacacatagaaggtgtcagttaaccagttcttacctaagaggtactgctaagagcctagtccctaagcaaagggagcttcagagaaacacagaaggtgccagttaaccagttcttacctaagaggtactgctaagagcctagtccctaagcaaaggacattcctcgtagctctgtcctgtctcctcatctccaaaatactttaccttctactttgaaatgcccactattatattcaaaagccctagttacttccagggaaaattatctattgagcaatgaatttcggtagcttcagttggattccaactcttgagcaagttttcatctcccttgcctgaatggccctggggaggactatttaaattggggcgagtggatgaggatgctaaacctagaggtctcccaattaccaaaggcacctgggcaccagggactaaagtttgtctcaggaatttactgagatatgaggctgagataaaatcattttttggtacataaggtatcttgaacaaagcagatcagtttaacacaaaatcaacaatcgtaatttccctttttaaatttccaaatctatgtagcaatatcctttcctttaattcattcatcatctctattcactttttgtattctgtaaatcatttgaacttttataagaattatattttccccttgaggtcacaaaaaagaaagtattagaaattttataaccaatttttaaaaaattatattttaaggttaaatacaaaccttctaaaggtttgtcatctgttgatcctaaattataattataaatttatatattcctgttgaatataatgcatgtgtgttacaagattattagcaatttgagaatttcccgtgcatattggagatgagcaaatggaataagtgctcatgtgtagcgacaggattctctattttatttcaatacttaatattgtaccaaaccaagtaagaggagcatcatgagaaaatgtactaaaggacagtcattacctatatttacacctagaaaagaaaactatattattgataaactgataaatctattttatgtatttatttattattttgctctgtcatccaggctggagtgtactggtgcgatttccactcattgcaacctcctgctcccaggttcaagcaattctacctcagcctccctagtaactgggactacaggcatgcaccaccacacccagctaatttttatatttatagtagagacagggtttcaccatgttggccagcctggtctcaaactcctgacctcaggtgatatgcccacctcagcctctcaaatgctaggattacaggtatgagccaccgcgcccagtctgataaatctatattaaaaagaataaatataaccattgcatcttcaacagaaattggaatatggcatgtagatttcaaaataaaatgaattctctggcattgaattactgtactcatgttgaagaaatgtcagaacttcattggatgttattatattacagttgtttgtttgagttgtagtttgggcagagtaaaggagccaacatgtcttaggatttagaacttgtgcacattgcctacagttgaaagaagaaagcatgctaaattccagcctctttggtatgtggttgggacgtaaagttttaccacatccttcattgtcttagcctactcaggctgccataacaaaataccagagactggatggcttaaacaacagaatctttttttccatatctaagaggcttggaacagaaattcattttctcacagttttggagcctggaagtttaagatcaaggtgccaacatagtttatggtgagaatctgttcctggctaacagatggctgccatctcactgtgtgtttgtatggtgtttccttggtgcctgcgtggagagagagctctaagtgtctcatcttctgtaaggacaccagccccaatgggattagggccctatcctgtgatctttagttttatgtaccccctaaaggctctatgtccaaatgcagtcacactggggtttagggttttaataaatgaattttgggggacacagtttagtccataacattctgtccttgacctgccaaaatgtatgtccttctcccatacaagataaatttattccatcccagccgggcatggtggctcacacgtgtaatcccagcactttgggaagccaaggcaggcggatcagaaggtcaagagatcgagaccattctggctaacacggtgaaaccccatctctactaaaataaaaaaaaaattagccaggcgtggtggcgggcgcctgtagtcccagctactctggaggctgagacatgagaatggcataaacccgggaggcagagcttgcagtgagccaagatggtgccactgcactccagcctgggcgacagagctagactccgtctcaaaaaaaaaaaaaaaattattccatcccaacagccccctgaaagtcttaactcattctagcatcaattctaaagttcaaagtgtcatctaaaaaatcatctaaatcaggttacgggtgaggctcaatgtgtgattcatccagagacaaaattcctttccagctttgaacgtgtgaaaccagaaatgttacatgcttctaaggtacaatggtgaaacaggcataatagacattcccattagaaaatggagaaataggaaagaaggaaggtgtaatgtgtcctaatcaagtccaaaacctggcaaggcaaattctgttaggtcttaagaaaaaccctctttggcttgatgccctgatttccaggcccagtggtgtctcagtgtcacctctggctctgtagttggcctactccatctgccctgcctgaagtctcggtctttcagtttggtggggtcccacccaggcagccatctgtgagagactcccacacagttctgcagggcatctttgaaacaggtagagtcagccttgactacatgttcccacccccaccctatcccatctgtactctctgagtctgacatcaaagtggcagccctggcggctcctgcctgtaatcccagcactttgggaggccaatgagaatggatcactggaggtcaggagttccaaactagcctggccaacatagtgaaaccccatctctactaaaaatacaaaaattagctgggcaagtggtggcaggagcgctactcgggagggtacagatttagagcctgtaatcccagctacttgggagtctaaggcaagagaatcccttgaacctgggaggtggagattgcagtgagctgagatcacaccattgccctacagcctgggtgacagtgagactgcctcaagaaaaaacaaaagagtcagccctagtgatcttgtaagttgcctttggtgggtcagtctttccttttcttaaagaatagtacacattgacagccaggtagctctatgatcctgttctatagaattcaaaaagtcgacaaccttcctttgttcctttctgttttctctgcctacgttagtttaaattggcagtgtctctgctggaataatcccatctctcttcctggcttctgctgagatggctgattaaatccttgggtcacacccattatctctttatcaaatggttgttcaggctaggctcagtgtttcacgcctgtaatcccaacactttgggagactgaggagggcagatcacttgagctcaggagttagagaccagcctaggcaacatgtcaaaaccccatctctataaacaacaacaaaaaattagccagggtgtggtggtgcatacatgtagtcccagctacttaggaggctgaggtgggaggattgcttgagcctgaaggcaaaggttgcactgaactgagattgtgccactgcactccagcctggatgacatagccagaccctgtctcaaaaaacataaaaataaaaataaaaccaagaaaaaaaaagaaaaagaaaacattgttcaaccatacctcttcaagaaaaactttctcaatttttacaatatagattgagaaatctatcccaaatctccaagttctgattgtgttttgcttaaaaattccttctttatttcggctctttcctctcacatttcactttaagcagtaaggaggacctaaatcacaccttcaatactttgcttagacatctcttctggtaaatatccagttttactgcttataagttctttccagtaaacactacagcgtaattcagccaagttcttgacacattgtaacaagaacagtgatttctacagtttccaataacctgtccctcattttcatctgagacctcacaagagttgactttaatgtccatatatatatattttttgtgtgtgtgtggcggggggagtggagtcctgctctgtatcccaggctggagtgcagtggtgtgatcttgggtcactgcaacctccaccccccgggtttaagcgattcttcagcctcagcctcccgagtagctgggaccacagaagcacatcaccatgcccagctaatttttgtatttttagtagagacagggtttcgccatattggccaggctggtctcaaactcccgacctcgtgatctgtgccctcagcctcccaaagtgctgagattacaggcgtgagccaccacgcctggcctaaagtccatattttaaccagcatatttaatattctatccatgatcgttataaatctaagtttctatgaaaatggaagctttctgtccagctctcttcctttctgagcctttgccagaattgcctttaatgtccatatttctttcaatagtcccttcacaattggctttttctagtatgaacctcaaactcttccagcctttacccatcaccaatttccaaagccacttccccatgtttaggtatttgttgttgcagcatcccacgcctgggtaccaaaacttagtcagcttggactgccataacaaaatactacagactggtggcttaaacgatagacatttattttctaacaattctgcaggctggaaatctaagatccaagttgccagcatagtcagtttctggtgaggatctcttcctggcttaaattatttcacagacaccaggcagataaccatatccattctttcctgtattcgttaatagtcagagctaaaagtgtagggctctaaatttacacttcaacaaattgttctgttattaagtattcacctcaaaatgaccagactatactatcctctaaattttagaaacttggagcttggctctggtccctagtctttgttctgtctcattaatggcttcatcaatactacggttccaaagactatctatatgcagtaaacttccaattttacatctccagcctgaccttttttctgaaatgcaaatgtgtgtagccacattttcacttgacatctccatttagaactctaataggtctttcaccctaaacacttccaagacacaggaataaacgtgctccttaagcctgttatcccttccagttctccccagttcaataactgacactaccatttactcaaatcaacattctaagagtgtcacttgctacatttccttcatctctacaaatccaaagtatctgtgagtcacgtcacctacatattcaatacatgcaataattcattctccatactccttaccatgacttaagggcccactcagtgaccatctctggcctctgttcacctcttctgctgttctcctttgctgttccagccacgctggtctcttttcacatcaagcagctaagctctgcccatttaagacatttaacttcttggcctcaatctctgaaatgcctgtttgatttttcttctggtgagctcattttcactcatcaggtcccagctctgtttcagacaaggctatctaaaatagacctacctaaatggattaaaaatctgagaatatgaaataacaaatatcagatgacattttaggagaccctttatatacctcatttgtgtgtgtgtgtgtgtgtgtgtgtgtgtgtgtgtgtttggaaatggtgatggagggtgtcattgctaagtgaggaggaaacacaaaagccatctaggaaaggacacagactagataggtccaaaagtggtttaagacagaatatatgtaaagagagttatagaaagagcaataagttgggataaaggatttccaaaacatatacggggttagtaacctcaatttacagggacaaactgcaaaacgttagtgaaaaggcaaacaacataatataaaagatgattaaacggtattttatatcatgtattaaattcatatggccaatacatatgaaaaacaagaaacaaaaaaccttcctagtaattcaaaattatgcatattaatacaacaaagggataccacttcttttttttttttttttttgagacagagtcttgctcaggtacccaggctggagtgtagtggcatgatctcaactcactgcaacttccaccccctgggttcaagcgattctcctgcctcagcctcccgagtagctgggactacaggcgcctgctaccacgctcagctaacttttgtatttttattagagatggggttttaccatgttggttggccaggatggtctcggtctcttgacctcgtgatctgacggcctcagcctcccaaagtgctgtgattacaggcgtgaaccactgcacctggcctaatttttgtattattagtagagatggggtttcaccatattggccaggctggtgtcgaactcctcctgacctcagatgatccacccacttcaggctcccaaagtgctgggattacaggcatgagccactgtgcccagcctgggataccatttcttacctatgaatagacaaccactaaagccagtatactcaggactgcaaaggatgaggaagaattgccattgtcatatagtttttcataacttttcctgacaatgtctattaaattgtattaatagacatttggaaagggagagtgtcaacaatctagaataaaggccccactaggtaaggttacatatgtaaggactctttcaaaactgtcacaagaattcaggtacggtggctcatgcctgtaatcctagcattttgggaggctgaggcgggtggatcacttgaggtcaggggtttgagacccgcctggccaacatggttaaaacctatctctactaaaaatacaacgattagccatgcatggtggcacatgcctgtaatcccagctactcggtagcctgaggcaggagaatagcttgaacccaagaggcagaggttacagtgagccgagatcgcaccactccagcctgggcaacagagtgagactccatctcaaaacaaaacaaaaaaactactcaaaactgtaataagaaaaaaaaaaacctaattatacatgtaaaacatttaaataactaaaataagaatactgttgacatagtgagacatccatttatactatggaatgttatgcagctacctgaaacaataatccggtgaaacaaaatcacacacacaactgatgagagtaaatagagaaccgtatggaagaaaacataccacagtaattatctcagatagctgaaactaagttggtgcaaaagtaattgtggttcttaccattactttcactggcaaaagctgcaattacttttgtaccaacctaatagaatggggtgaggagaggtaaacctttataaacatctctgtgtgaactgttaaaatgagcaagtatattttttttaaagtataaagagagaaaaaagtaaactttctccatttcccacctcaaattatgttctgtcactcatcctgtttagattctttcaaatgcagtttgaagttttatttatgagattccttgttgtttgcctctttccattaaacctagctccacaaagtagggacctgatgtattcattcactgttatatcccagcatctagcagagggcctgacacttagtgggaacgcaagtatctggtatataaaccagagaatagatatttttttagcccagaaagctgtttcactgcacagagtgtaattatctgaatttctataaaaatgtctatctataaatcattgtcaatacattacctactcaccttacccagctaccaggaacactatgaagttttgaattacaccccatttgttttccacactcttaccattttcccagtttctgcactgacctctccagacatcatgtgtactgataattctaagttgtctagattgttaattcttttaagggcctgttctctgctagctggcatcatgcataaaataattctctttaatatgctctgggtctagggttaatagatgtttgcttaaaatcatggaaagaaaatggtcacacagctggtatgtgtgatcaaatttgtgctgtttcatccacttaatgtttactttgtggtaatggaacctcccagcttttattttccttccttccttccttccttccttccttccttccttccttccttcctccctccctccctccctccctcccttcctttctttcttcacagagtctagctctgttgcccaggctggaatgcagtggtgcgatctcagctcactgcaacctctgcctcccgggttcaagcgattctcctgcctcagcctcccaagtatctaggattacaggtgcatgctgccacacctggctagtttttgtatttttagtaaagatggagtttcagatgttggccaggctggtctccaacaccaggcctcaagtgatccgcctgccttggcctcccaaattgctgggattaacaggcctcagccactgtgcccgaccccagcttttatattctaatgctgagattattcagttaacactcttacctgctaggataagtttgttggagaattttaccttaccttgtaccctttaccttcacatctacctgtaccctggcccttcacatcctttccatataatatatcttcagtaaatacagggaaaaaaacccagaatgattatgttgacagcaaaacatgtttgtgcagaaacggagtagtcactatctaagccacagagacttaggagtgtattcctgagttatgtatcattttaaccatcactggatcttaaatcccagttgctaaattgaagggagatacatgactctttttagggctttgctctctgatacagtagccattagccacatgtgatattttaaatttaaataattaagtcaaaaattcagtttcctcagtctcaccacatttcaggttgctggtgtctactgtattggatacacagacatagaacatgtctatcatcacagaaaattctattgcattgcactgggataggtactttttgtgcccttgggctgataagttcaagtgcacttaactagcttcctccaagtggaatcagaggataaatttaccatacaaaatacaggatacccaattatatttgaatttcaaacaggcaacaaataattgcttaagtatgcccctcactgcacacccaaatattacatgagacattctatacatatatatatatatatatatatatatatatatatatatatatatatatatatatttgaaattcagatttaactggacatttggtatttttaatgtgccaaatctagcaaccctatctgaagagcaaaactggagtgtctagtctggataggtccttttacaccacagggagttatttgaggaattgagaagggctgtggtacctgtaaagaactaactcattatgaagaaaaggatctgtaagtttttctgtatgtgtaaggaaggccaagaaggtggtttccagatatatttactttttcttctctctctcttaggttgcaaaagcttctcatttcagagagatgccaggatcctaagtgcctgccaaacttaccaattctaaggaataagtggatggatggcattactgattcctacattactgattgattctgcatccgcaaattgttttattaaaaacattctacatcatgtgtggggagataaggaggataaaatgaagagaaagaatattattgaggggaagttcttctgaatacaaaatgtgtttaattttttaaataagtattacattcacagggttcaaactatttgaagtaaagagattatatataaagaatccatccctcaacttacccaggtggtcacttttctttttcttgtgtatctgcccagtattcattcctgctgatatcagtcaataatgaatgatacgtgttttcttcacttttttcattcttgtcaggtagcagactgtgtagacttttctgcacttgcccttttcataacaatctatcttggagaactttccctatgagaacatacagagcttcctgtacacagttgcatgtactgcattatgcaaatgcattatattttatgtaacctgtccactgttggtaggcacttgagttgttttagtcttttgctatcaaacagttctgggatgattaaccctgatttactgcaaaattgaaattgctctgctattctgctggaatggtggtaagtgaactgaaaattccagtcactcttgggctagactcaacgttcttaaaaactatgtggccatcaccaaattagttattttgaaccttaatttcttcacctctaaaatggaggtaatacttaccttaagtggctatgagaatgaagatcatgtgtatgaattgttggtgctctaaagaacagcacaaataaaattattttcaaatttaattttaattgaactatgtgtaatttcttaattttgaaataattttatttgtaatgtgcataatcttatttaatgtataatgtatacattgtaatagaaacagatttcccaaattccagcctggcatgaggtaataaaaggtaatgcaaaggg

SEQ ID NO: 38066 - DNA, 69751 bp, Homo sapiens; identical to SEQ ID NO: 37974

SEQ ID NO: 38067 - DNA, 11143 bp, Homo sapiens; identical to SEQ ID NO: 35837

SEQ ID NO: 38068 - DNA, 30557 bp, Homo sapiens; identical to SEQ ID NO: 38043

SEQ ID NO: 38069 - DNA, 143041 bp, Homo sapiens
ccgggggtggcgaggggaaggcgacatttgcttggcgctgcctccgtgcagagcggccgggagggctttgcagcggccgccgacgcggcgggaggagggggctgaggcggcttcggagttggccggagaaggtgggcatttctcgcttttcctccccttcctgcgctctccccctccctcctgccccgcaccccacgtgaagcagaatataaaggggggtgtgaggctagaggggaaagtgaatggcgaaggactgaagggatccccccttcgggtccccggccgccctgttcaccctcgttcatcctcctttccgaagctcgctctcgaaggcaggagcgaccggcgcctttggctgaggaggaggagaaggaggaatcgcgccaggcggagcgtcaggtcccgttttcctctccggcgtctccaatacaaagattacggtgcagaaggaaattgcactcgtctcctccgcgcccccggtacccaacacaatgcaccagccgcctgagtccaccgccgcggccgccgccgctgcagacattagcgctaggaagatggcgcacccggcaatgttccctcgaaggggcagcggtagtggcagcgcctctgctctcaatgcagcaggtaccggcgtcggtagtaatgccacatcttccgaggattttccgcctccgtcgctgcttcagccgccgccccctgcagcatcttctacgtcgggaccacagcctccgcctccacaaagcctgaacctcctttcgcaggctcagctgcaggcacagcctcttgcgccaggcggaactcaaatgaaaaagaaaagtggcttccagataactagcgttactcctgctcagatctccgctagtatcagctctaacaacagtatagcagaggacactgagagctatgatgatctggatgaatctcacacggaagatctctcttcttcggagatccttgatgtgtcactttccagggctactgacttaggggagcccgaacgcagctcctcagaagagaccctaaataacttccaggaagccgagacacctggggcagtctctcccaaccagccccaccttcctcagcctcatttgcctcaccttccacaacagaatgttgtgatcaatgggaatgctcatccacaccacctccatcaccaccatcagattcatcatgggcaccacctccaacatggtcaccaccatccatctcatgttgctgtggccagtgcatccattactggtgggccaccctcaagcccagtatctagaaaactctctacaactggaagctctgacagtatcacaccagttgcaccaacttctgctgtatcatccagtggttcacctgcatctgtaatgactaatatgcgtgctccaagtactacaggtggaataggtataaattctgttactggcactagtacagtaaataatgttaacattactgctgtgggtagttttaatcctaatgtgacaagcagcatgcttggtaatgttaatataagtacaagcaatattcctagtgctgctggtgtgagtgttgggcctggagttaccagtggtgttaatgtgaatatcttgagtggcatgggcaatggtactatttcttcctctgctgctgttagcagtgttcctaatgcagctgcagggatgactgggggatcggtttcaagtcagcagcaacaaccaacagttaacacttcgaggttcagagttgtgaagttagattctagttctgagccctttaaaaaaggtagatggacttgcactgagttctatgaaaaagaaaatgctgtacctgctacagaaggtgtgctgataaataaagtggtggagactgtaaagcaaaatccgatagaagtgacttctgaaagggagagcactagtgggagttcagtgagcagtagtgtcagcacactgagtcactatacagagagtgtgggaagtggagagatgggagcccctactgtggtggtgcagcagcagcagcagcaacaacaacaacaacagcaacaaccagctctccaaggtgtgaccctccaacagatggattttggtagcactggtccacagagtattccagcagttagtataccacagagtatttctcagtcacagatctcacaagtacaattacagtctcaagaactgagctatcagcaaaagcaaggtcttcagccagtacctctgcaagccactatgagtgctgcaactggtatccagccatcgcctgtaaatgtggttggtgtaacttcagctttaggtcagcagccttccatttccagtttggctcaaccccagctaccatattctcaggcggctcctccagtgcaaactccccttccaggggcaccaccaccccaacagttacagtatggacaacagcaaccaatggtttctacacagatggccccaggccatgtcaaatcagtgactcaaaatcctgcttcagagtatgtacaacagcagccaattcttcaaacagcaatgtcctccggacagcccagttctgcaggagtaggagcaggaacaacagtgattcctgtggctcagccacagggtatccagctgccagtgcagcccacagcagtcccagcacaacctgcaggggcatctgtccagcctgttggccaggctccggcagcagtgtctgctgtacctactggcagtcagattgcaaatattggtcagcaagcaaacatacctactgcagtgcagcagccctctacccaggttccaccttcagttattcagcagggtgctcctccatcttcgcaagtggttccacctgctcaaactgggattattcatcagggagttcaaactagtgctccaagccttcctcaacaattggttattgcatcccaaagttccttgttaactgtgcctccccagccacaaggagtagaaccagtagctcaaggaattgtttcacagcagttgcctgcagttagttctttgccctctgctagtagtatttctgttacaagtcaggttagttcaactggtccttctggaatgccttctgccccaacaaacttggttccaccacaaaatatagcacaaacccctgctacccaaaatggtaatttggttcaaagtgttagtcaacctcccttgatagcaactaatacaaatttgcctttggcacaacagataccactaagttctacccagttctccgcacaatcattagctcaggcaattggaagccaaattgaagatgccaggcgtgcagcggagccctccttagttggcttacctcagactatcagtggtgacagtgggggaatgtcagcagtttcagatgggagtagcagcagcctagcagcctctgcttctcttttcccgttgaaggtgctaccgctgacgacacccctggtggatggcgaggatgagaggtaagatcatgtcatatttctggagacattcaacagatttgaagttaatctatttagtagctatatgtatgcacaaaatgactctaaaacattgtatattgtgttttgtatgtgaaaaatgcatttttatgggaagttttatagagcaagagttatggaatggtttcagagggagtaggaaataatagtaatatgtaaacaatattttcagaatagttgttgagcatgtgttcacattaaaaacaggtttgggggcgccaagtggttttattatctctaaaatgctttttagaaatattatggaaagcttaatttttgctaacccacataatagttaatctattttgagctgctaaaataatctcttggggggttgtggttcccacgtttgttctcctttactagacatccctttttcatttctactgtgtttgatcttagtctgtgaaagatattgttgcctacttttcctagtcagatatggtaggaaagatgacttaatctgggttatataggttgccctcatactccaactgaccaacttttgcgtacttatttaatggtcattttatctgaacagtaaaggaatgggaatcttattttgtgggaaaggaggacataaactatcaaaataaccagacttatcttgatagtatgctgaacattttttcttttgcatggtagatcaaggtggtagccattttaaagaacagagaaagtaagtcttggaggattgaatttatagaggcgtgaaaataagaccttggtctctggctaatctactccacctgttcctttctttccttaccaaaaagatacagaaagcctaaagtacattattaaaccaagcgttttttcacgtagattggaaataatatgccagtaacgcttattgaatcaaattgtgtctttgaagctgactggctaaaaaagttgtgaaatctttcatgttgatttttaaagtaatgttcttttcacaaattttccagtctgttactaaccttgattaaaatgctattataggagttatgaaaagacatcattttcacggtggaatttggagtaagcgtgcaagatatttaattattttagtattagttggagggttttgtgattgaactttcatcaagcgaatttaagcatttatattctatatgtatgtttgtgggttttgctttggaaaaattgagcatattgcaaaatagttgtaattttagaaaaagaaaacaggtcaaatgtttcagtgaggtttgtgttatttagttgtttaaaaggtaagataaagacatggttaaattgataaaatcttatctttcaagatttttattatttttctaatagtcaggtaattaaaaccttgttacctaaccaaatgtattctgtattatttgtacaaaactgtactctaaaagataaacttttaggaggtagtttccttaattgttccattattattgttaaacctttaattttatcatgctaatactcaactaattttaaaagaattaccacaaatattaatgttttttaagtcaaaaggttatgatttgagtgaagcctctataaaaacagctatattatgtggatgctaagtttagagaaacaaaagacgggtaaaatacacaaacaaaaacactcattttgaattcaaacttgccatgattttgtaattgccatttgtggtctcctggcttgactttcacctctttttcctcctattggtaggacatgataggattttccacagcttgcccttccaggcaattaaagtcagatgatgctactttcaactagagttttaactataggaatagggtcccagtttaagatattaatataaaattaatttttccagataataattgagaaaaggaataataaggtggaaattatggaattctagaaagggacaaaaagacatactgagaaataaggaaatatagctctaatacaagttgtcttcagacactgtacacattcaattataattatgtttagcagtctctcccacaagaccaggagttcctcaagagcagggactgttttgaatttactacctatttgggccttggttagttaacatcaaagtttcgtgattaaaaaccagaaaatttttgttttagcggtatcttaaattctgtgaaatcggaatgtagccctaaaacaccttgtaagatcagaaaagatatatattatattctttattgtgttttactgaagattatttatcactacagtttggaaaaaagttaattttcatttaaatttgcccttggaagataatttaagaataactacaagagaaaacagtgatatgattaaaaaacaaacttttaaaacctttcttcccatggtagcttctgttgtcacttgcatcttctgggcttggtcaccattagtctcaggagagagggaatacatatataatttcaatattatgaatcaggaaatgtgttaacaatataatttgggcagtaggacagatgaggatggttatcttttaatcatcttttgaaataatactcttaacactttagattataaaatgtttagacatgtggaaagtgccttcagttgatcactgggagagactataaacatggatcaggatgctaagattatgtatcttgttttaaaaaaaatcattcttatttaaaaggtcttaatgtcaggccgtgtgcggtggctcacacctgtaatcccagcactttgggaggctgaggtgggcagattgcttgagcccagaaatttgagaccagcctgggcaacatggcaaaaccctgtctctacaaaaaaatacaaaaattagccaggcatggtggcgcatgcctgtagttccagctacctggaaggctgaggtggtaggatcccctgagccctggaggtcaaggctgcagtgagctgggatcatgccactgcactccagcctgggtggcagaccaggaccctgtctctaaaaaaaaaaaaaaaaaaagtcttaatgtcttagactgtaacatgaactgtgaattcacctttacaagaatgggaaaatacaggtattgcatcttttatgttttgtgattgttattagcacagcctcttaacgtgaaatgggtcaaacttctattcatccttcaagactcagctcagatgttctctttaaagcattcttttcactcaggggacattgtttccttagcactttttaatattcctctatttaagcactgtacacattcaattataattatgtttaccaatctttcccacaagactagatgttcctcaagggcagggatgaattatttttttgaattaattagcaggcatttctcctgattttttttttgtcatgatttaaagtttatattgtccctcatcttaagcacaattgtgagagatgcaggatcatataatttatgcaacaaatggaaaagaactgaataaaaagacttgcttttttgtatctctcatcaacatttttaggtgaattgatgtatgtctgcaaagtacattgcctgttttatagtaggtcctcaaatatttaagacgcatgtgtgttacctataaaataggagtaatactcattttgcctgcttctcaggatagcagtagtatcagttaaaatactttgttaactaaaatacgaaattataatttttaaagtttttttttcaagatgtacatgcacagtttaaagatagtttaaatggttttccaagaaataaatggaagagcttcctgcacccttactttccagttttcctttcctagaaacaatcactttcacctcttttagatgattattgtggtatttacctcccagtctctaaataacttgcttgtcttaccactagatatgtaatatagcctgctcgttaggagcatggactgtggagttagattgcctagatttgatctttcttgtcatttactagttttatgtaacatcgggctatttatcctctttatggttcaatcttctcattaaaaaaatgatgacaatagtagttacctcattgggttgatataagaattaaatgaatttggaaattccctagaactttgtctaactcacatgccctatgtaggtatttgttaaataaaatacacctttcatttctttttgtctgtattaacttcctggatagaaaatgaagatttaattttgttgttaccatatacctacctggtctccttttttcccagtacccttcctcccagtagttatcaatattgattattcagtattcttgtcaaatattacttttcctatcctgtacagtgttttgtggctgcttccctgctccatccccacctgtctattatagaaatgggttttcctccactcccaggttttcatctgtcagcgctgtctgttttctccaagttgcccctcctttccccaccctcttcccatttttgtatgttttgggctctacctttcctgtagaacctttccttagatgtctggtaagtcttgattgtctgcttgcaaataagtgttaaaggattaaagagctgattagagatttgcagtgtggggctggccatggtggctcacgcctataattccagcactttgggaggccaaggtgagaggattgcttgaggccaggagtttgagattaatttgggcaatatagcaagatcctgtctctactatatatatataattatttttaaaaattctttttccgtgtggcttgttgactgttaactttaccgcagagtaatctggctggagttcattgtctttttttacctctttgcctagttttctctatatttatcactaaatccacttttcatcagatgcctcttaggatgttccaatatcagatattgttaacaattttatctttctcaggaagtgttatatcccactgacctccattcttgactggttgccttcttggcttggtacacaactattattctgggattcctttcactttgtcttgtgttggatctttattttccagagactagtgtctttattcttagtttgcttgttttaaaatggctttagtttactctgacactttcttaggtaaagaataccaggtggggaagttatgttctcttatattttgtgccattgccttctaacatccatattgcttttgagaaatctgaagccattctgatatcttatatattgtatgtgacctgtgtattttgtttttccttcccttccttttccttcttccttttcttcctctcatttttaaaacctctaaaacctttataagattttatgtttccagtgttctgaagttttgccatgatggatttttgtgtgggtctgttttcattcactgtgctgagtacttggtgaaccctttcagtttggaaacatcttttcattctgggactttttcttgagtcaggttgttgattatgtctttctattttttctctcttaaactcctcttatttggataacggaccttcttgactggtcttctaattttcttgtgttttctcaactacttttcatctgtttttctttttgctctattgagtttccatttcccttatcacatatttaaattccaagaactttttttttgctcctttttaatagtatactattctattttaataatgatagtattttttcttagctatctgaatatataaaatgttagcttttttaaaaagttttttttttctttctatgtggtgtttcctctaggttttattttcttactttttatttgctttggtctttatctttcatcttatagcctttcctcagatagttggtagtcatgtgtaagagtaaggaattaaaatgctaattagaaattctgagcgtggcttgtcaattgttagctttcctgtatggtaacctggctgtggtgtttggttggaggacttctagtgtcggtttcttcttgtatatcctcctagctggttagatccctataagaaggctcttctgatttcttgcttggaattgaaggcctttctacaagcattctgtggggtgggcagtgagggggatgtggaatgaaaggttttgggggatccccagatacgtttcttcactcaaccctgttttcagtatgttctgcattttgctgtgcctgatttccttagtcctgtgatcctatgttttaccttcttcagacaatattcctttttttttcttgggattagggagggacagttgggaatctgtaggactggttgcttcttaaactgacttctaaacaatctttttaattttagcaccttctccccccacatcccacttatatagatgtggtactgccaattcctgagtcttttggggattttgcagtttaaattgggtttgtttttggcattctccattgtttgctaaagctttgattttctagtgtttgctaagtcatttgtcactcaactgtctgctttccagctttcaaatttttttgctattgtcttttcatctgcctcagtttttgtgggcttatgtctttgtatcttaacaaattgcttttctgtcattttagtggggttttagggaaggagtgaaaaaatagatgtgtgtgtttagtatcattacacatctatttcaatggtagaatactgtactattaaatgtaatgaatgatgctaattttaattaagtcatagctccaagttagttctctaatgaatacataaattttaagagtggaattacttagtttatatttgttagaaataagaatagtatgtaattcagaatttcagttcatagaagtgatgaaaaatgttagtattagattcagttaatgtctaccatatttaaccactcagtaatcttgtgaattaagtttttttctattttattggtgaataaactgaaacttgctgagtatttagagagggcaagttgtctaaggttacatacatagcagtaaagcagagctaggattcaaggctgtttttccaattcgaaatctagtgccgtttttacttcttataaagctaataagaggtaaggccagtgcccataaggaatttttaagagtgtctgaaaacctaaaaaataggcaggcttcattgctttgtgtattcgtataactgatggaattgccatagaacataacatttccctgcaagtccttggtgagaaaaaagtgggtaaagtcatcacagtggtgtgcctggaatgcattagacattcaaatgttaaatgttaaggtggacatgttttatttatttattttttcttttgaaacttatgtggaaattttaggaaaaccattttaattttttaataatttagatcagcttttgcagcattagcttcagaaatacaaaacatgtaaattttatttcttgtttagaaagtttaatttcacacctgtaatcgcatcactttgggaggccaagataggaggatcacttgagctcaggagttcaagaccaacctaggcaacatagtccccatctcgatttaaaaaattcgataaaagagaaagtttaatttaaaaatatgaagctgttaagcatgacctgttctgatgctgcagtattagaactttggtggttggtttttgccgtctcacttttgttaaggttgaaaatgtcatggtaagaacatgctttattggctcattaagagaaactacacaaggttgaaaaattttaaagtatctttatactgatttttaaaaaattataacaactttttagattctaggttaacttttttcctagtctcacatatattcaaaagctgccctccaccactccatttcttctttaccagtcaatttgaccaggaaatcttgacctttcagcacgattaggcctagttgacctttgtttgccctccttgaaacactctattttgcgttttgtgataatcttccattttcttcccactcttctggccattccttttcagtctgtctttcaggtttctctcttctgtcagactctgtttcctaggttttctgagtcttctttatacttactaccttttccctaggtaatcattggttcccatggctgtaaagacagtttgtatgctattggcttctgaaagcctatcactagtccagacttctcttcttagccttagacgggtaaagtcatctgctttcataacatttccgcttgcattctcataggcttatcagtctcaacaggtcataaatgtaactcttgattacctagcccctcaaatttccttctttagttgtctttattttgataaatataatttcttaatgcagttcttcactttagaaacctgagagtcattcttgatagtttcttttccttgctctctacatcttgatcattactttaaaatatatcttcatcttttttttccatccttattgccattgctctaacataacatcagctctcatttaatgcactgcatgtagtagcttcctcacagagcctcctgcatatgtcttgtctttttctaatattgtatcttacagtcagaatcatattcttaaaatggaaatctgttcaggtaacttacttggccagaaccccttttaagcctttccatttattttaaggtaatttctttctgtctttgcttactgatggcttcatcatgcttctttctcccaactttcttcattccagttgtacttgacctttcagaaagtttttcagttttcatccattcttcttctaggcctttgcacatgctgttattttagcctgaatatcccctatgccatctcactttcattccactttaaagctaaactcactttttgagaggctgcctctgacgtaccaatctaaacttaggttgtttgttaataactgtttaatagcaccttgttcttttcttttataatgcttattacagttcgtaattagattttgttttcatgattatctgatgattttaagcttcttgaataggaatggggatgtttgatgtgctgcatatattcaaagcctatttcaatgcctattagataaaatctgcttaatcaagaaaatatactgttaatattgtcataagaaatctgcttaatcaagaaaatatactattaatattgtcataagaaaaaccaaggagaacttctatttttaaaaacagaaagataaagttctttatgatcatgtgataacactattttctcctttaagagagaattaactgatttactttttgctgtgtttgtgagccaaaaaaaccaatgcttaggtataatcaaatatggttcttgtccccaaggagtgtataatattataagaagatatgtatgcatgtggcagttatttggcaatataagggctaagtaatagttttaagcaacatgaaatattaaataaaataatcagaaacttaagagttggaaatcttgatctcattcaacctatgaaggaacaagttttggttaagtgaattcgccgagacagttttacaaattgtttcttagactgtacctggaacttgggttttcaaaatgacataagcaaagttcacagatggtgtagatttgacctttggtaggtcagaaaagcagtgttacttgaagtgacttttcacaagttttagggtgaaggaaaatgtgtcaggtgggagaatattaataaaaatggggggaaataagaaaaacacctgggcagcagtaaggcaacagttggattaagtgataggaaatgactgaaggttgaattggggagttaatgattggccctcaacacttgttgactaaatggtgttcagggaagattagtgtaaaaggaatctgtagtttggattgaagtgggaagcaggaagaaccatgttggatgttatgcatttctataatttgttaatgaatgaaggaaataaatgatggggatagggattttcattgtaaaatgttcagtacagggtttctttgctgagcagattccacaatttgacaaagcactgtattcactttcctgtcttctctctcaaagcaatatgttaattcttctcattttgaaaaagggggtaacaaccccaaaacccaatttccccaaaaattcatgacccagcctcagttttaaaggtttgaaggataagcagttataaccttaagacagggtttttggcaatttaatttttttttttttttgagatggagttttgttctcgttgcccaggctggagtgcaatgatgcaatcttggctcattgcaaccttcccctcgcgggttcatcgattctcctgccttagcctcccaagtagctgggattacaggaatgcaccaccatgatcggctaattttttgtatttagtagagttggggtttcaccatgttggtcaggctggtctcgaactcctgacctcaggtgatccacccacctgggcccccaaagtgttgggattacgggcatgagccacggctcccggctcaatttagcgtttttatagagtttatccatatctgaaattcaaagcagatgtgtcccaaatatgtttggtagtgaaaagaagtccaggtaaatgcgaactaatatgaatattttaggattggttccttatattagtgattgtagagacgtttgccagcttccttttcatactaaacagatttccattgtcagtctcttccaggcagtagagaggaggaattatttttttcctgtctactggggactcctaggtctctaccaaaaaggaagtggtgtacatcttaaattatttaaaatgtgaaaaacattaatgctactgttgatactaaatgtgagcattttggttattttgctgatatttaaagagccacaatactaatgtttattcggttctttgttggtgcccttttgcacgttgtcattttcaaagtataaggatatatacatgtttgtagatacatatataaagaaatataattttttggtctggacttggtggctcatgcctgtagtcccagcagtttgggaggctgaggcaggttgattgctggagtccaggagtttgagaccagtctgggcaacatggtaccctatctctacaaaaaaaatacagaaattagctgggcatggtggcgtgcacgcctgttgtcccagctccctgggaggttgaggtgggaggatcgattgagcctgggaggtggaggttgcagtgaggtgagatggcgccactgcactccagcctgagtgacagagtgagaccttgtctcaaaaatatatatatataattttttaaaggtcattttgaaattgtccttagatgattataaaatctcttaggtatctgaaagaatgtaatttatttaataagtatgtgcatagctcgctctctctccttaaggagagccagcagttgaattcaagaataaacgtgtgtttgtatttaagaaaaatgacaaaagattccttctattactcctgtaatttttggtcctttacttcaactttttttcacctattttaaatttattttgtttcaaaacatttctgtctttgtaagctgctttaaatattttaaggaatggcttgggatggaaatctaatcgcatttgggaaaagtataacaaggtagaaaattatgtttaggagaggtactaataaaggagtattgggagtcagagaagttaagatcacatgcttgaggaggagtttgatagctactgggtttagtaagtcattttagtagagaaaacattaagcaaagaggttcaaagtacaccgatgtttatagaaaagaatataagacatagtccaagttggtatcagatgggctttgtatacataaggctaactttgaaaagccttaaatgtaagattgagaagtctggatttgattggacatggaatggagggctcttttttgtttttgtaccatgcagtggcctgatcagtactatgttttaggagggtactggctttacttgggatgtctagttgcttccttccttaattgagtatgagaaactcaataattcctttttcctcagtggtagaaatggaggcatattctctgtcattgtctgagataatggtttgaatcagtccctttggcctaattaggaaaagtaaggaggttaggacccagtccacatatggtaacactccacttaatccagaggttaaaccagctgtggaatgtaaggagcccaaaaactgcttgaaattgctatcaaagccatgtcccctcctctccctggtcccccgacgccccggggggtatttttgcatagcatttctgatccttttttggacttccattaagtctccttatgtttactagctttgttatcttaaagcagatgagactagggagggaaaagaaatgggattctgaggcatgtaagttgacgtcaggaaagttagcaatttatagcctgacatgaaggtaggagttagaaattttaagaaaaccccaaagaactgtgataggatattgaatatttgctagttgaaagttagattatgttcgttatattgttttaaggaatcatgggtgtaagaataaattccaaatgatgttaatgactgagctatggacaagtataaaccatgttttagtcgtattgcctccactgtatcatttaagcatagacaaatccttttactcctctatattgcttttttcctgttctaaaataagacaagttgtttcatacttttttaccttttagggcagcaaggttattctctaagacattcttaacatatgttctaaatatgttacaaaaataaaagctagacctttacatacagaaattacgaagaatatttgtagtaatattcagaagtaaaattaaaagttcctaataggtgctaagatttaagtaattggtagtgataatttttatttttagttaaattagtgaatgacatattaggtactaagtctgcataaggtattttgtagacatttaatgatttagatgtttaggtataatgaagatccccccccaatttttctctttgaaatatttttattaattacctttttatttttttaaaaagagacgaggtttcaccatgttgcccagggtgggctcaaactcctgagctcaagtgatcttcccacctcagcctctcaaagtgctgggattacaggcgtgagccactgtgcctggcctgattaccacagtaaatcaaatactatatcaaggaaaactgacttttctcattgtatatgtttttatttccttttttagaaattgacaaccaagccaacttggtttctttcataaggaagcttttgtttgtgcctaatattaaactaatttttagagactgggtgtggtggctcacacctgtaatcccagcactttgggaggccaaggcgggcggatcacttgaggtcaggagttcaagaccagcctggccaacatggtgaaaccacatctctactaaaaatacaaaaatgaggcagtcatggtggcacacacctgcagtcccagcttcttgaggaggctgaggtatgagaatcgtttggacctggaaggcagaggttgcagtgagctgagatcacgccactgtactccagcctgggcagcagagcaagactgtgtctcaaaaaaaaaaaaaaagaaatttttgggctgggcacagtggcttacaccagtaatcccagcatttagggaggctggacaattgcttgggcccaggagttcgaggctgcagtgagctgtgatggcacaactgtactctagactgggtgaccaagtgagaccctgtctcaagaaaaaaaaagttaattttttttcttggttgtgtcctctaaacaaatttgttgtggtacttttgacaatgaccagtacatcttcctgttgaggaaatacactcccatgttttaaaaattactttttaaaaaaggtggtacttagtgaaatttgtcttagtgaatttaatttaggaaaaaatgctgctttataagttatgttttttgctttatttttggttaaggttgttcctttgggtacaaggtgtggtgtgagatgtgtgaattgagaaaatccctggtttgggctatagactgtccactgcttaggtgctcagatatctgagtctttccttttcttcctcttttaaaaggtttttattgctgtagttcacctaaacttttctttgagagtcaaacatggagccaagtcttgtctttggttgatggttcattttactgtagaatttggaataagagttttaaactgttcttcattttcaatgtgttattttcctctatggagatccaccaaacattcatcagttattctctgaaataatggatagcaggatttatacatttgtacaattggttatgttttattattaggaattttacctattttgaggttccaggcaggaagggtggtacagaaagaggagatggaaatgagaatttcaccctagataacttagcggtttcctacctccatctctgaatcccataataacgatcatgatatcacaccctaatccttttaggaacaagtatatttaatacttggtgaaggtacataatgtttattttattttatttttttgagatggagtcttgctctgtcacccaggctggagtgcagtggcacaatctcggctcactgcagcctctgcctcctgggttcaagtgattcttctgcctcagcctcctaagtagctgggattacaggcatgtggcaccatgcccggctaatttttgtatttttagtagagatggggtttcgtcatcttggccaggctggtcttgaacttctgagctcagactgtccatccgcctcagcctcccaaagtgctgggattacaggcatgagccaccacgcccagcctgaaggtacataacatttaaattggcaactgtttagctcctcttttttgtaagcttgtataagattgataataaattcatgggagacctgaggattatatgacagggaaatgattcaaaaattttttttactgtattattggttgatatgttactacaaataaaatattgtgaagttaaggaccttggtcacattaactactaagtgatggagctagtcagtattccattaggtgatttcattccaaaacttgcactcaaccacattctggaggtttcttttgtccattgagaagaacaaaaggtgacagctgacaactataaaaagcagtcgttagcctattgagtatagaggcatttgacactatagactttcctggttatttcggtcactattttatggagttgtccagtaatgagtgtacctaataattccttcaatctttattattattttctcttagtacatttaaaaagtatagtttctaccccagtggttaaattctccaaatttattgctaaaaagtaaactttaaatttggaaaatttgctgaagtaaattgcaatttcagaaaaataagtgaatatggagacacccagtttcatgacataaatatttcaataaattattagattactggccttctagtggtctcagattctataagctgttgatacttaggatattttttataagcttaatgcaatcaaattaaaattctattaaaatacttttaaagtagaaacctaattttaatcagttgaataatagcacattttatgaatcagatttttaattttgagtggttacaacttatcttcacatcatatttattattggaacaagaaagtgataattttcctgtgaactcacttggggaagtataaaaaaaatgatagtttatatgaatgctttaatattcatttgaaaaataggatttagcttgtccttttgcttattctagaaggtagaattaactttttgttttgttttgttttgagacggagtctcgctctgtcgccagactggagtgcagtgacgtgatctcagctcaccgcaacctccacctcgcaggttcaagcaattctcctgcctcagcctcccaagtagctgggattacaggtgtgcaccaccatgcccagctaatttttgtatttttagtagagacagggttttaccacattggccaggatggtctctatctcttgaccttgtgatccgcccaccttggcctcccaaagtgctgggattacaggtgtgtgccactgcgcccggccactttttctttttttgtaatttttttttttttcctttgagactgagtttctaccttgttgcccaggctggagtgcaatggtgcgatctcggctcaccacaacctctgactcccgggttcaagccattctcctgcctcagcctcccaagtagctgggattacaggcatgcaccaccatgcctggctaattttgtatttttagtacagatggggtttctccatgttggtcaagctggtctcgaactcccgacctcaggtgatccgcccgcctcggcctcccaaagtgctgggattacaggtgtgagacaccatgctcggccttgaatcttagacatctgcattaggtcttcagaggtggcatgatctcggctcactgcaacctccgccttgtgggtttaaaggattctcctgcctcagcctcctgagtagctgggattacaggtgtgcgtcaccacgtccaactagtttttgtatttttagtagagacggggttttgccatgttggctagactggtcatgaactcctgaccctaagtgatctgctcgtcttggcctcccaaaatgctgggattacaggcatgagccactgcacctggctacaaaaattttttaaagtattcagatttttttttttttttgagatggcgtctcattctcacccagactggagtgcatttgcacgatctcggttcactgcaacctccgcttcctgggttcaagtgattctcctgcatcagcctccctagtagctggaagtacaggcgtgcaccactgcgcccagctaatttttgtattttttttaagagacggggtttcaccatgttggtcaggctggtcttgaactcctgaccttgtgatccatctgccttggcctcccaaagtacaaggattacaggtgttgagtcaccgtgcacggccccaagagatggtggtggtggtggtttgttttttttttttaacagtagaactgtttttttcgtttccattatttatttcctgattcacttataaatgttggagctattgaagcaattggaatttttttgaattatagttaacaatagtaaagatgtatcttaaaagatatagtagctttatttatcatttaatagtaatgtaatataagccttacttgtgtgttccataatttttactttctgccagtatgaaatagccaaaagtgactgaaagccagtaattttcacatcccgtgcaagtcgattgcatttctagatattttacttatttagtatgctcttgacagcctaaaattgccattctccccagtgtcagcattcatggagaaaagagaattttttttcattttgttagatattattttaataccatatcaaaacaccttgactaatgaaaaaagcttttctctcaagctttgaacatttttgaaggcatttcatacttttttttttttggtattttaatgtataaatacagaaacctatcttgcatgggtgggtgccacatgtaaacatcaatggctaaaatgttctcaaagtgcttgaagacaaggatggctgtacatatttgtttatttatttatttatttatttatttttagacagggtcttttgctgtcgcccaagttggagtgcagtggcacaatctcggatcactgcaacctccacctcgtgggttcaagtggttctcccgcctcagcctcctgagtagctgggatgacaggctcgcgccacgacacccagcttatttttgtatttttagtagagacagagttcactgttggccagtctggtctcaaattcctgaggtcaggtgatccatcctccttggcctcccaaagtgctgagattacaggcatgacgcaccacgcccgacctacgtatttcttattagtcttttgttgttgttgtttgcttacgttttctggaaaaaaaaaaattcacaagggcctaagaataacattctggcatttttgcaagacacttgtgattattgaatcttcttaagagataatattttaaaactggattaccttttataaaatggacaggctaagatcaactttggattttttttttttttttaatttagaggtctagttatctttccagttgtattcagactcttagcccttagggatctacaagtggcttattaggaaattgatccaatatgtagaaacaaaagcttctaacaagtggacacattggcctaacaaaaaccaagttatactatatttgagttcatgaatgtctgacttaaatgccattagtaccattcattcagtaatctgaattaggcttaacacatgagaaggggagaggagacaagagaaatagggagttgaagaccattagaaggagtggaagagaaggaggggatttggtgataataatttggtaaacatttggtgcagtttgcggtcagggtcactgtgtcctcattgcctgcatcagcgaatttatctatataaaaattattttagaaaaattacctaaggtagtttaagcaattgtcttttagcctagaaggtttttaacagtacctcttttttttttttttttttttttttgttcctggtattgggatgatttatttacttcaaaaatactcattcaatatttattgaatgcttgttacatacctagcactgaacaaagatactaagggtatgaagaaaaaaaaagacatggttttggtctgcaacagtttcgtctagtacactcaagcatcataagatcttgatttatcttctcaattatccaaataagtttatattgtgctcaattgttattctgtatatggtatacatgacagtttttctattcaaatgaattgatgcatctggactatcgatgaataagcataatgaggtagagtttaatgaacgttagtcttggcatcagccctggcatctcatcttatttctgctacctcttcattgtatgacctttgtaaatgagttaacttttttaagcctgatttccatagctgttatgtgcaggtaatagctacccgtgctgttgttgtgaggataaaaggagaaaggcatataatgcacctggctcagttcttgatagttctgtaaatcgatggctgtttttattactgtgctaagtaagagtgattcctttcttaagcactgtaagttaaaatggaaagcttgtttacttgttcagaggcgttatacataattttctaaagcagcggttctgtacctttgtgacatttttggtgcagtctttctcacctggggtccataagacaatccctacaggaaaagagtgcctactctcttagttctaagaatggcatatatctagcaccatcattctaaatgcataagaaaatagcgaattcattacatacagtggagcgatcagggattaattctttcgctgactctcatgctgccaggacagtattatatgtgattattgagcagttctttgaaattcctaaattcacaaaaacataagttgttgtaaaagcaacctttccctttttttaaatgggggtggggaatacttggaagaaatacagcgtcatgtagcagtttgttaatactctaaaatagaaccattaccccaattaagtgattctcaactttttcattctgaaagattgttttagatgggcattatgccctgaagaccatctcttccatgctcagtcccatatgggcccgaaaactatctccttagaatgaatgggattaagctgtttgttttaagtaagattataagtcaatatctggttttttaagtttcaaacattcattgaactggattttgaaatctataaagtttcaaaactagtttttttctaatactgattctaaaagtgaaaaaaaaaaatagtattagagcccagaaatttgggggaatgctttttgtctgtatattttggaagttgacattacattttagtttattgaagaccgatacattttgaagaagaaagacggttttattgaaatccaactctttcatcatataatacctgttactgacctggagaaccagtgttccttgaaacacagattgagaaatgttcgtttgcttcattttatatatgagaaatgtcgttggtcatgtatagtcaagtgacggcaggcctcaactgcagcccatctctacatttattattctgctgtaacagttccctttctgtttaccaccttattttcgttttgtttgtttgtttgtttgttttgagatggagtcgcgctatgtcgcccaggctggagtgcagtggcacgatcgcggctcactgcaagcttcgccttccgggttcacgccattctcctgcctcagcctccggagtagatgggactaaaggcgcctgccaccacacccggctaattttttgcatttttagtagagacagggtttcaccatgttagccaggatggtctcgatctcctaaccttgtgatccgcctgcctcggcctcccaaagtgctgggattacaggcgtgagccaccacgcccggcctaccaccttattttctattagtattcaattcatattagaaataaaagtataattattgtcatgtgagagtgtttgtaacaagtagagatctggcagatgttaaagaacacattttgagaagtgcggcactgacatatttgcaggctcttttaattggccctgtctttgtaaatggtttgcagaccttagtgggggaatagactttctatgtggtagcatattcctgacggaaatcttgtacataagttagaaagaactagttaacttcataaatgtagggaaatgatcagtttgttacgtgcttcaattgccatcagtatgggatattttactagctttatgttctctgttcctcatgttggagagttaacccttgatggtgttcgtgaagtaaaggagccaattgaacattcttgtctattatttatccatttcctaggttatgcttatcagaaaaatgaaatatgaagtacagaaagggttgtcaaaaatggagaaaccttgaagtcattttgagaataagatttgctaaaagatttggggctaaaagatggttattgggagacatttctgaagatatacaggtaaattagggaatgaattcatggttcttttgggaattcctttacgatggccagcataaacttcatgtggggataacagctacccttgtaaaggagagaggtgtataatgcacctagtgaagttcttggtcgttcgtaaatggtgtctgctcttactactgtgccaaataagagtgattgaaagtgttggtcttttttttgtttttttacttttaatttttagacacagggccttgccctgttgcccaggctagagtgtagtggcacaatcatagctcactgcagcctcgaacacctgacctcaagcattcctcccaactcagtctcccaaagtgttgggattacaggtctgaaccactgtacccagcctatgtcaaaatctttaaaataccagctgatggcggccgggcacgatggctcacacctgtaatcccaccactttgggaggccaaggcaggtggatcgcttgagcctaggagttcaagaccagcctgcccaacatggtgaaacctcgtctctactaagaacacaaaaattagccaggcgtggtggcacgcttatgtaatcccagctacttgggaggctgaggcacgagaattgcttgaacctgggaggcagagtttgcagtgagctaagattgtgccactgcattccagcctgggcaacaacagagtgagactctgtctcagacacacacacacacacacacacacacacacacacacacacacacccatctgattggggttttgggtttttgttttagtttttgagacagggtcacacacacacacacacacacacacacacacccccagctgattggggttttgggtttttgttttagtttttgagacagggtcttgctctgtcacccaggctggagtgtagtggtgagatcttggatcactgccacttctgcccccaggctcaagcgattctcccacctcagtttccctgagtaaccaggactgcaggtacatgtcaccatgcctaattcttgcttttgttttttgagatgggattccattctgttgcccaggctggagtacagtggtgcaatcacagctcactgcagcctcaatttccccaagctcaggtgatcctcccacctcagcctcttgagtagctgagactacaggtgggcgccaccatgcccggtttatttttattttttttttttgagactggatctcactttgtcacccaggctggagtacagtggcagtcatagctcattgcagcctcaacctccagggctcaagtgattctcccacgttggcctcccgaatagctgggaccacagatgtgtgccaccacacttggctaatattaaatttttgtagagatggagtctcactatgttgcccaggctgggctgattggttttgaaggaagtagggaaataaacttttcttctatttagaaatactataatctggtattctgaataatattttaagaagtggcttattaaaaactgaagggaatgtacactagcttcacttcttttctttttttcttttttttttttttccccgagacagagtttcactcttgttgcccaggctggagtgcaatggtgcaatctcggctcactgcagcctctgtctcccaggttcaggcaattctccttcctcagcccctcaagtagctgggattacaggcatgcgccaccacacctggctaatttttgtatttttagtagagatgggatttcaccatgttagtcaggctggtctcgaactcctgacctcaggtgatccacccacccggcctcccaaagtgctgggattacagacatgagccaccgtgcccggctgctttatttcttaatggagcttgccaaataaagaacttgagttctagtaatattagcactttcaaagacataaactaagatccgttgtggcttttgtgaagttttactgatagttattacaatgttaactagactccacatactttttaaatcaaagcatatttttaaaattgttaatttaatggtgggttgatgttctttcttaataccttttcattttctttttggcaacattttactttccagacgtggattagtcgctatcaaaattttattcctaaaatgtttggaaagtggaaatagctgtggaaactgtgaatagtcagtaaggtagcaggattcaaattattttttccagtattgacatttagaatgtcatgttggacatttaaaatttttctggtttgtagcctcattactgtatagaaatcaactaccagatgagtagttgacagacacagctagcttggttgcttgcttgctgttcttgccgccgccgccttcttctttttttttttttttttctttttttttgaggcagggtttggccctgttccccaggctggaatgcaatggtgtgatctcagctcactgcaacctctgcctccttgggctcaagccaccctcccacctcagcctctccaagtagctgggactacaggtgtgcgcaaccatgcctggctaattttttgtagagataggatttcaccatgttgcttaggctggtcttgaactcctgagctcaagagatcctctctcctcagcctcctaatgtgttgggattacaggcctgatccactgtgcccagcccaggctttcttaatttctgagtttgctgaaatgggccctaaggctgaggatgccttctgagattggtggaagctactgatatttccttgtcactttaggctcaattgctgtataagttataataagatagagtagattaaaggatttatttgtaagtagatgtgttctgtcttttacaaaacctaccccactttattgataaagaattggaaagcgccctgttttaactaaaatgttgattgcttctgcagatgtctaatatcatatttatattttttattaaattcaagttgagataaggcaatgaccttttcatcttattatatacggaggaacttgaatagatatattgtaagctatcataagtaatacttaaaatatattaaaattcaggtcagccacagcattcatacagattattatctattctgtaataaactaaagactgtttctctgggtctttaagcagaattgagctctgaatctagtttattattgtcagattattattttaatcatgcttataacaaatggtgacttaaactgttgctataatgtttacattatgttaggataataaaacttattaaattatgaagttcttgtacatttaaaagtctatcttatatatttgttatgcaaatcaatagatatgtatcaggtaaactagaaattctagttagaaaaaatcctttttgtgtcttggtttttgaagatacttaaaaggtgaaaggaatttctgattaccattttaacatgtttagatatgggctttttagtttcaatagaaacatcttttcctagattatcttgctggtattaagttgttaaattttgctacgctttattttgaagttttactgtcttgtaaaactccatatttttacatagttttactgtcttgtaaaattccctatttcttaggttgatagaaatggcaaaacaagttaacttgcttaagcttagcttgcttaactgtcaattgatgtatgtttaaatgaatttgaagttgtttcagaattctacttaaaacagtatgtttattctagcttttatcatacactaagtatttatttatttgagatggagtctcactctgtcacccaggctggagtgcagtgacgtgtctctattttagtagagacggggtttcgccatgttggccaggctggtctctaactcctgacctcaagtgatcggcctgcctcagcctcccaaagtgctgggattacaggcatgcgccaccgcgcccagccccagtctatatactaagtatttaaaaagaagtactcagttgttaatcaaaataatatgatttggaaaaatgtaaattaaacctcagagtcctagagtcaaactggttttgaatttcctgttctttactagacatgtgatcttaggtgagttagttcaccactttgtgctttagtttccttatcaagtaaagttgtgataataatattccatatatgatagggttatgctaaagattgaatgaggcaatatatataaaatgcataatacagtgcataataataatgcacacagtggcaagttcctgtagttccagctacttgggtagctgagacaggaggattgcttgagcccaggagttcgaggctgtagtgtgccgtgattgtacccgtaactagccactgcattccagcctgggcatcataggaagaccttgtttctctttttttaaaagcataatacattacctaccatatactaagctctcagtaagttaaaaattaaaacaaaaagttatgaatatttacctgtaaccaactttgtaagtgaaggtattaatacattggagtttatctcttgaattttaatttaaaaaaaggaaggaggatatttatggcactaaactctatttcctgcgaaaatttttgaagaaacaaatgaggagaaggtcttcagttttaataatgcaggaataaacatacatgataatgtaaattggaaagaacttttgcttttttgttcacctgttctatgatatgcttgctgtagtctggagttaatttccacacttgctatttaatgtaaacattgtttttctatttgtaggaaagattttcccttttgatctctcacatattatcttctgaattaaagttctctagagaactgtttaccaaagggaaagaaaaagactattaacatctggttacttttctgatattagtacagaacatgacataatgctatcatttccattaggattagcttttaaagaaagattggactaaatttttcatctgaatgaaaaatcggagatttatgtttcttaatttctcagtggatattccataggcgtgtcgagtatggaaccatattcaggatgttttgttctatatttttaattttctattgaaataattttagacttaccaaaagttgcaaaaatttagtacacaggcttggtgtggtggctcatgcctgtaatctcaccattttgggagactgaggcaggcacattacttaagcccaggagttcaagaccagcctgggcaacatgatgaaactctgtctctacaaaaattagccaagcatggtggtgtgtccctgtagtcccaggtactagtgaggctgaggtgggaggttcgctcgtcagggaagtggacattgcagtgagccacgattgtttcagcgcatcctagcctgggcgacagagccacaccctaagtacatacatacatacctacacacacacacacacacacacacacgtatttcacacagaattcccatatacctgtcacccagctttccttaatgtttgtatcatgtataaccatagtacagaagtcaggaaattaataccaactactctaggcatttttgaattttgaccttgtctactaaatgatctttttctggtccaggatccagtttaggaattcatattgtacttggttgtcatatctccttaatctcctttaatctaggcctgctcttcattctttctttcctttcatgactttgacacttttgaagaatactaggtagtttcattggtccttaatctgtgcgtttttggcaaggatatgacagaagtgatggtatattcttattagtagataaggaggtacatgattgtgatccatcccattattggtgatgtcatcttgatcatttggttaaggaggtgcctgccaggtttctaaactatcaagttactgtttttcactttgtaattaacacatgtcttgggaatattttgagactgtgtaaataatcttatttctcatcatacttccattaattttagtatccattgatgattcttgcttgatcagaatcttttacatttaattatttaacatctttttttgtttcattgactgatacattattttccttgtcataaatggataaagacccaaaggaattaatgtaaaggcagcctaattcgcaaaacgtaagtggttttgttgctatggtctttcttttcttttttatctatttgtatttgtatttttatttatttatttttttttttgagacggagtctcgctctgtcacccaggctgtagtgcagtggcgcgatcttggctcactgcaacctttgcctgctggattcaagtgattcttgtgcttcagcctcccaagtagctgggattacaggcatgcaccatcacacctggctaatttttgtatttttagtagagacggggtttcaccatgttggccaggctggtcttgaactcctggcctcaagtgatccacccgccttggcctcccagaatgctgagattacaggtgtgagccagcacgcctggcctggtctttcatgttttctgagttttctaagtgcactcttatgaacgtaacgcaacccaagatcctagaatgaaaaaatacagtaggaagattatccttttttttttttttttcagtaccttataggtccaaaatgtgctgctggccattataagaataaagctaaatatttcatgctagcaagacgaagaagacactagcgaggtaaaagtaatggataggttaattatgaaaaaagtatttgttagagcaatttagagatcttcttaaaattactaaggtttttttaatgacatatactagcctttttcactttaaggagtcagtggcaaatttaagctttatttatttatttattttttgagacagaatctcgcttgttgcccaggctagagtgcagtggtgtgatctcggctcattgcaacctccacctcccgggttcaagcgattctcttgcctcagcctcccacgtagctgggactacaggcgtgtgccaccacacccggctgatttttgtattttttattagagatgggttttaccatgttggccaggctggtcttgaactcctgacttcaggtgatccgcctaccttggcctcccaagtgctgagatttcaggcgtgagccactgtgccctgccaaatttaatcatttttatatttagttttcttgacccttaggttgccttatccttttttatagtcaatatagtttatgcaactgtgtttctatgattgccttttatcttttattctatagtgaattaactactctaaaatatatatattgtagattgtttctttttcatctgttttacttcatcttctacctcagtggagcatgaacacatttgggttatctgttggttgtcttttaacaaatacttgatatttatatctagtggactaacttgaataccggtaacattttcagatggtatattttccaaaaggttgaagagaaaatatacagataatggaatttggctagatgttgagctctaaaaatgctttaatagttaggtttttctgttttcattacagctttcttctcttttaggaaattactgtccatgattaagcacatatcctcttgatggtattcagccccttaagttcagacttccttcccgttggttttttttttttttaattaaaaaaaaaattctttttaacacacaactttgctcagagtcttccctattttttttcaaaaaatgtgtattccatttgataatacacacaagatttatggtttagaaataatctttacctccagtgtcagtacaataccttagttaactaattccgaagaacttgggtgggttttttttttttgcctttttgttttgttatcgggtaagatctctccctttttgaaattggatattctggcagtatctggtttttgtactacttttaaatctctgaaaaagaatattagaaatctgtaattgttgcaatttggctaacatttgtatcatctctcaggataatacctttgaaatttctgctaactatactaaaaaattaatccttagaagttgacgaccccaaaaagagatggatacatgaaagtttattttttattttttattttttgagacggagtcttgctgtgtcacccatgctggagtgcaatggcacagtctcagctcactgcaacctctgcctcccaggctcaggcggttctcctccttcagcctcccgagtaggtgggactacaggtgagcgccaccatgcccagctaattttttgtatttttagtagagacaaggtttcaccatgttggccagtctggtcttgaactcctgaccccaggtgatcggcccacctcagcttcacaaagtgctgggattacaggcgtgagccatggtgcctggccgaaagttatacttttgataaattttttgttttctttaggattagaaagttgaactttttagtgtctactttagatatcggccacttgacaaaattctcctttgttttttgatcagtaacttatttgtaaagcatttactgagttacctattccgtgtgccaagcacttttctagggtctagagataaaagacacactgcttctgttaagcatgttctttccttttcttcttactgccagctaggactgttttggatacttagaggaatttgtgaagaatttgttttctttgtagaagtgccttagaaccagtatgaatgggtgataataggtaaagaataaaaagatacttccaatgtatgtagaatgtccaggttaatgaataatcggtaaatttataaaccattaagttcaactttagatcagtcagttgtagcacatttgagtagaaatcagtctttgtagaaacatagtgccttctatttcatagcttaaataggtgtagccttcccttatgcttagatattagaaatgcttaaaactaataagctgtgtatgctcatttcataatttaatattgagaacaaatattgcaaacagcctaatttgatgtacttctcataaaattttctcagtggtatttatatataaaatactgcttctgatttgaatatacatggattttcagtaagaatctttaaaaatttcattatttacagaaaatgttaaaatgatttcattgatgtactggtaggttaatagatctataacagccatttgaggtagcagcttagcattgctgattttgttagctttggtttgaaattttttctctagtggttgaaatgtaagtcttgcagtgtaataaatatttctccctcttaaaatatcacatagaagaatgttgtccactaaaatagaattaggtaagggcttcctgtatcatttttaggagcttccatcaataatattctcacaaaggctgcactttctttttcaaataatgaccccattttgaaagcatctttacattttttatataaatgatacattatcaaattcagagtcttcataaattattaactcttaaagcaagctctctttaccagctctcctcagtgatttcaaaataatttctacttagagaaatctgcttattcatttctgagtatgagtgttgaattattatgttttggtacttcaggcaaaataaagaagttatattctgaaagcgttctgacttaggggaagtttgtaaagattcattttctccagtgagctctcatatttaacttgttgtgtaacttaaccttcggacatttggttttttaaatctaagtttgttgtactttttatctatattatactgtggtgtgtgataaataaagatttggatgcatttaacgtaaagttcctgttgtaggagaaattctaaatttagaccaatattaatctgagcaagatctggttttttgtgagttgtttttcattttcaaagtgaagtaggcctgtaaacttaaaaatgaaaattacgaggtgtatttcctatatcaaaatgtacctctttctttttgcctgtattttcactcacctatatattattatggattagtattcaagaactgaaggaaaactattggaaagttaactattgaaaacgactggaaaggaaactaaaggaaatttggaaaatcgtatcttaattataatttctgaataggttttaaactattttaaagtagttaagttttacttagatttcattaatttagaaatcttagataattttcatggttgatattgagctattactatatgaaaaagaataatttgtcaaggaaattgattagaaaaggctagaggatgattgtttaataaataatttttaaagcacttttatagcacctatttgcaccatataggtactgtgaaaatgtatgtagatagctccaacgtactgattttaagcctttttcctctgttaaagagccactccttaacaactccagctgtggaatgctttgttaatctactagggtgttttagactcttgaaactacttaattagattgcatttgttaagattcagcattcagatcctttttctaatctgtgctcctttcttcttatcatccatcatatacctcctcattgtgattatactgtaaaatactttttaaagcctactgatctaaagatacagtcttttaaatactaaaaggcttttggacttaaaatctgttggaagcttaaattgaaaaaatagctgccactttaggtgcataaagtactttcataattatttgatacctcttgttagatggcagtttcaccttcttctttccagtttcttttttcttttctttaatatttggtaattgcagatttgatggttaaattcataggttttctttacttaggccaaactgtcatttctcatttgtacagaattggatatgtccctgtgcagaagggttagctcattcttttcatctttaagcttttaaaattacttagtctaaatgttgttaggtaatggaataaccattccttttcagcttttggtacatttccaaactggctggcagagccaggaggaagtgaaggcattagaaacactaactttggttggttgctaccgtcttagtgctgagactataacctttgttggttgattgatagagaacaagagaacacaatcctcgttccactaacaggtaaggaacccttgtgataactagttggtatgagagggagattacttgatagcatttcataaaaactttatcccaaaatataacatgtcctagaaataggatactgtgactgactgtactccgtagaacaaggatacgcagcacctttatatttagaataagatctgaaatttaatagggatgtattactctgtaccacaaagcataattgatctgttttccaaaggcaacactgttaaaatttatcctgcagtccctgtaactttaaatatgtatctgcctatcttattctcctttcagcttttccttgatcagatgctatgtgctttgaacttccttctcttatttattcctataataaagctaactattttctagtatctttgccatcatctataatttgggtatatcttactgctttaatttctatgttatagccattaatgattattcctggttcttcttgacccaaaagaaaatgattatgcattttaaaaaggattttgagtctgtattgcctatatccactattctgccttcccagttttaaagctgagtgcttgaagaataaatcttttcagtgacagtagtcataagctttcataaaatataggcttagctttgtattgctataatatgggcctatagtgtgattaattctttaagttaatgaagacttgaactcagagaagaaattcagcttcttagactttcccaaagtttagtagtattcctgttaatatacttggttttttctgtttctacttttcagtccatcttcttttctttgacagaagaattaactgggactcctcctttgatatatctgaggttgtgtgccttttccctgtcccttaaagacaactatgatcttgtttccagtcataatttatcatttttgatttggtcttccactcagagttgagtggtttatcacagagtgtgttatggcttagaccaatacaggtcccttcttaatagttactgaggaattaatcatttgtggtgacagacttctaaaattcaaattaagaaggcactaaagaaagtatgcccaaaggtagctcctttttatcctgaggattaagccattacaaactcaaatgaccagagaatgtaatttcttaataagaatttttccttaaatctatattcagctctctatttcagtgcttctctcctaccagaggtgcaaggagtgatcctagaaccacagatacagccaagaccacggagagcttttgacgtcaggggtccactttctccactgaacccttggagacagaatatccagcttctggagagagtgggaaaggataataaacaagtgggtgctttccattatttacttgggttaatttatagattggagtgtccttccattgcccatttaattctgtggtaaactccttgggttcatttaagaaccaggtgggactgcaatctgttttgtttttctgagaatgctaactagtactcattcaaaaatgagacctaaaatttaattttctctccagataattaaagcagtggatgatttggggcacatgatttgacgaatgcctatgtagtccacaggaattttaaaacgggaatatctacccattttggcctttgtggtattagtggacttctaagtgctcttttatattcaagtaatttaaaaggttctgtatttcatctttgggcaaactggacatttgaagtctaatttatacagtcacatgtccaagtgttatcctacactgttagtgagaaccttttggtcttcttcctacctcaaatgttaggacttcatattagatcttttaaaagatgcaatgatagtactattatggttttactgtcaattctaggctccattctttaataaaacataagtatgaatgaatgtaagtttcaggatacagtatccctgaaagctatgtttaatatactcaaaagtcattttctagtccctaggaataaatatttatggtaaaagaaccctttcctagatttcccccatggcattaagatggttttctcttagtttctttgatgccaagggtaggatttgattccaggaagttcttatcacctacaatgggtagaatgtgaacttgttacctttggcaagttttcatttttccttggtggattccttctgtgactccaggtatcttgataatgggagactggtttatttgttctttaattgcccagatttctttcaactggtaaaacatcatacttcttcagcaaaaggaattcttctagcagagccttcatggatgatatctgtcacacatgccagcacctgcagtttggaaggcagtggtgaatggatccatgcaatatgtctagaagacacaaggatgagccagccacctgatcttgtcatttataaacttttaagaattactctggtttacttttggtctgaaaatggaaaggcccaaataatgaaataatcttttcagattggaattttacatggccatgaaaatatttctttctattcagaagactgaaatagaggaagcttgagagactcctttcttttaaaagcggctctctgtatctgtttcatttaaaacatttgtgggattgaaaatcaccttaatgaagtaggcaaacatttttttaagtagtagaggaagtccagaaaacttaatgaaatggttttttttgttgcctgacactgaaagtaactagtaaataaagggtgaacttcttaattattcgaaaactgcttttaatattaggatatactcttttagctcatcttcgctggtcttgaggcttattataattgtcaaatcaacaaagtttctaatagagaagtagaagaaatatcttttgagatgtaagtagcttggtctgtcttctaaagtaatacatacctgttaaacttgaggtatttttttcatactgaaggcattctaaagtttggtactgtcacaaaacagtagtttacagagcagaagcacttagtattagaataagcctgtaggtgtgaaggaataagtgttgcaaaatagttatttatccaagctgtcaattaattgattgaagtagttatcaaaatgtttctgtttctttctttggtatctattaactggtcagtcaaaagctattaaagaatgtttttaaagtcacctaatgctgccagtttgttaaatttggtatacattttaagaatagacattctagagttattaatatggaagcagctaaaatgttttaggaaatctcaaaagttttagaagccacatttgctaaagcataacctgcacttagtctttcttggctatctgtatttttttctcattaattataaataaatttttgttaagtatagtatttaaaagtaagtttaaaggttcaatttgaactgaaatttccccagagagctttgaattcccataagtgattacagcttttactcccgacttgtttttagtaaatgttaataagacaattggtttacaaacacatataaattaaaaaaaacaactgtccatcgttttaggaagaactgaaggaactaaaaatgatatttgcttggaaattaagttagttgaactctttgaaccacagtagaaaccgctttgtgtggcctgtgagattataagctttttgtttcagctttgaagatgaaaagtgatttaatctcttaatctcatgctttgattgaattttagctctgttccttaaaatatgcaaaaggaaatgtaagtgcatttctagtcacctcatgccactacaagctatttatttaaaagtgaaactttttgtatattattgtgaactgatttgtttatttaaacttttattttggtgaatttacctttgagtttttttatattttatgtcacaaaatgaagtcctatatttttcagtgtttatgaatattaatataaactatttttttctagaatgactaattgtgtaatatctgtattatgtgataatttgaaatctaataaatattttctccatgaaaaaaatgcacttactgataatggcttatttctgtttcaggagtagaaagtgaaaactgcaacagtatttttaaatgtattttaattttctgtgtctttctctaaatatttctgaatatgtattctttctgtgtgttagttttttttgtttttttttttttttttttttttttttttttttcagaaaaatacttttttgaactgttaaggtgattcttcgtgggggtcaccagtgaatgtatgaaataggtgatctgttttgtatgtttttgcattttcctgattagcatcatctttcctgattagtttccagaattggacttttttagatgcaatttttgtacctcaattttgcaaaccattaaaactctcttgagttaatactgtaaatatcaagagtaatttgaccaagtcttttaatgctagattgatcaaaatataactcttacagaatagcatccaaaaacagttcctttacccagaagaacatttgaaaataatggctgattagagaactatgcaattcataagaactgttgaaatgaaaaatgttttgtattttagtgttctacttgcgcaaataattgtagtgggagaaatcttggcctcatagtctcttgtttttaaatcttatcaagacagcatggagaagggtaatatttagttttattgattcttgtttttatagctacataattttacttaattgaagccacaggaacaatttaccttttctatgcaggatttgcttagaagcaagaggatttcctttcagatttgaagaaaagttattgaagaaatggacccccaaaattaaaaataacattaagatggggtcctaggcaagaagtaaaaattgaattaatgacaattggtggattaaaatgtaataatttggctccccaaagaaattaatactctgaaagaaatcaaatttctaaaaggcagttatgatttagaatagctgttgtattgggggtgggggaaaggaagctaacattcttggctttattaacctggtaagtttggaaaaaaagtaaagattctgtgcacaaaattttgtttttagaattaaagctattaaaaggtttacagacacagtatatttcaatgaaaggctgtattttatttgaatataaaaaaaatctataagcttttcctatatgtgtatgaaagggtaggttgggcatggaagttaaaatacaccctgcattggaaacctgaaaaatattgcaaagataatggtgacatgagtttttaaaaagtaatttttaaaacatagactctcctctacatcatcagtaaccttcaaaataaaaatactacagaatgttgaatttggcttaccattgtatttttgaggtataggaacataggcttatggtttcaccatcactgacgaggttaactatagtataaaaatctgttttgattgttctttagtaaggaaacaaatggttttttttgtttgtttgtttgtttgttttttgtagcttctgtttaaaaaaacatgacaagcagtgtgactgcaaagtcctgactttataggttattgtaaatatgtacacagatcttattttctttgccatattgaaatactctgacaaatgtcagtgcttagatgtcctaagcaatttttttactttatttttatccaggtatttttgtttccctttaaaaatatttcatagtaatttagtcctaaaatgtgaaagacttgtttcaaaattcagcacttaggtactctggagtgttttttccactaatatgtacatctaaggtaattagattactgcattaaaaatgttagtgaactttgaagtattcatcggagttttcaggaattatgatcaaagggatctctgctgaagaggtaaggtatggcataggtagaaaaatattcaaaatatgtttaatgtttggattataatgtaaactacaacaggtatccttgggttttcagatagatggagaattaggaaaataatttttcttaaaactctcagagaagtgaaattgataaaccacaaatttgtttttgtgtggctttggagtgcatttagaaacatgtccacagacattgtactctgtgtatatgtagcctccaatattccaaggcatttcctacccctgctctcagcatttatgattcatatttaatttctcaagcctgagcactgtaaaaatactgtactttggtaagttgagtatatatttcatgagattattgcctggaatatttttggcaaaatttttgcagattttggcaaagcaaaaggaaagtacaatctccttttggctgtttgtattaaaatctagaacttagaaaacaattgcttgacttagaacttttattttggtttgagaaattaaggaattctgtaaatgtttacttagcactgtaactcggaagtcttgtactgaggatcaagaaataatattgttgcctggtatataaaataattgacaggagaaagtgatatactattattctctagggaatattaagtaggttcaaagggttgtgttaggataatagcatatctagaaacaaagaaaaatgcaatattgaatatggacaagataggaaaatagattaggacttttccccctagaattaaattactagtgtaatttactcaataaaggataacatcgaaaaatgcagtaatcctgcatcatgtttttgagttctttaaaaagaactgctagtggacatttttggcttttttttttttttttttttaagacggggtctcacagtgtcacctaggctggagtgcagtagcaccattatagttcaccaagtgatcctctcgcctcagttttttctgctacaggcgtgcactgccatgtctgcttttttttttttttttctccttgagacagggtcttactctgtcgctcaggctgcagtgcagtggctcaatcctggcttactgcagcctcgaactccccaggttcaggtgatcctcctacctcagcctctcaagctgggactataggtatgcaccaccatacccagctaatttttgtatgtttttgcagagatggagtttatgtcgcccaggctgagaagtgatcctccctcctcagtctcctaaaatgttgagattacgggcatgggctactgctcctggcctggcttttcttaaaataatttgctatttattccaccttaccttttgatgtagaaaaagtgataatgtgaatcaacatgccatcattacctttgctaagtcctttgtgatagaacttggcatttcatagctgattccatgtacattcaggatactatttttgtttgtttgtttgtttgttctggagacaagagtctcgctctattgcccaggctggagtgccatggggcaacctcagctcactgcaaccaccacctcctgggttcaagtgattctcccacctcagcctcccgagtacctgggattacaggcacctgccatcatgctcagctaatttatgtatttttgtagagatggggcttcaccatggtggccaggcaggtcttgaactcctgacctcaggtgatccacccgcctcagcctcccagagtgctgggaaaggatactctttgctaagaagttgattcagaatttgcttccatgcctttttttttttttttaattttatttgatacagagtcttactcttacctaagctggagtgcagtggcaagatctcagctcactgcaacatctgcctcctgggttcaagtggttctcgcctcagcctcgtgagtagctgggattacaggcacggaccaccatgcccagctaattttttgtacttctagtagagatgaggtttcaccatgttggccaggctggtctcgaactcctgacctcaagtgatccatccacctcagcctcccaaagtattgggattacaggcagcggccatcatgcctggctaatcatgccctcaagtgaaccaccatgcctggcccccgctcccatgccatttttacttgaaaattactttagaattctctagtttagcacccttattttacatgcaagataattggtatccaaaaataccacatacgtttctaataccacactcttttaaacaaattgtctgtagtactcaagtctcttcactaccagatgtaccactttactacttactgctgcttgttgatcctagtttgagacgacagagcaagtctgatccctttcaaatgtgacagccttcaagatagctattaatttcccatcaattccaagcccaagtcttctacatattaagtatccccatattcttacctcttattcatgtagcatgcttttgagatccttaaagattttgtagatcgactgggtgtggtggctcacgcctgtaatcccagcacttcgggaggctgaggcaggcggatcacaggtcaggagatcgagaccatcctggctaacacggtgaaaccccgtctgtactaaaaatattaaaaaaatagccgggcatggtggcgtgcgcctatagtcccagctactcgggaggctgaggcaggagaatggcgaggacctgggaggcggagcttgcagtgagccgaggtggtgccactgcactccagcctgggcgacagagcaagactccgtctcaaaaaaaaagattttgtagatcttctgtgagcgcactgcagcttctgttagtgtgtgacaccaaaccagcacattacagatgtgctctgcctgggcttataacacgtgaccttatgttacctttggcctggaatactcataccgctttctccttaaatatttatccagtaaagtgcttgattttatgcatgttgagattctcctaggcaaagaaattatagtgatatgaaaaagtattttgtttctaaaaattaggctagtagtccgtatctgcaaagtatttgtattttgcacagcttataaaagaaattgactcagtgttacagccacaaccttgagaaatcataaatacaaaagtacagtccccatttaagttattttcagtttgctttaattctgactttaaattgtatattaaattgtgtaaacataaaatgttatttttcgggttgtatttactaatttaagggtaaccaggcttgttggagacacttgttatgtgactggtattgagaagaaaataaacttgagtttagtaacataattaaaattagtggaaaagtgtaggacatatatcaaatagcagaagatggtgaagaagtagtcctgaaagtttgagaatatggcctaagttctaattcaggcacagtcttgtgttgcatattgaaatacagtgcaaacattctgctatagcaacattattttagtataatagtgcttttaattaccatttaaaatatttatcattcctcccccaaatcttgaactcctggaagacatgaggtgttttatttatttaatggttgcatgtacatctaagggtatagataccccaatttgagaaacactggttgagttaggatatatcctgtcttgcctgatttagaaagaatttgggggaaaataagaacaaacatttacatacctactaagtgtacctttgctagatgcttcaggtatatttacctaatttaattgagttaacctgtgagaaaggtgataattttttcattttacacataaaaatgttgaagctcagagtttacaagacctggccaaggacatataatctgtaagcaatgaagatggcattccaaggcagatctgttgatctattacaccattgataatgcatttgcatattctcagaatttcatatagaacctcagtgtctgaattaaagggttattttagtatttttaatagacttttaaaaaagagcagttttacatttatggaatagttgaccagtaagtgtagagagttcccatttacctcctcctccctcccacagtttcctgttaccatcttgtgttagtgtgttatatttgttataattgatgaaccagtattgatcaattattaattaaagtctatagtttacattggggttcatgctttctgtcgtgcagttctataggttctgtcaaatacatgtcacgtattcaccattagtatcatacagaatagtttgacctagaaatgtcctttgttcccttatttgtgtgatggctggatcatatggtaagtcagtgcttagctttgcagtacagaaactgccaaactgtcttctaaagtgactttaccattttgcattcccatcagcaatgaatgtgatttctgttgctccacattctcaccagcatttgatgttatcatttggttgtagctactctaataggtgtgtagtggtatctcattgttttaatttgcaattccctaatgatatatgatgttgaacatcttctcatacactttccactcaatctgctgagtgtctgcttaaattatttacccattttaaaaatcaggtttgttttttttttttgagttttaagagttcttgatatattttggataccagctttttatcgggtgtttggtaaatgttttatcccaatctgtggcttgtcttctcgttctcttaatattgtcttttgcaaagaaattttaataaagtctgcctttactgggtcatgattttggtggtgtatctaaaaatttaaggccacctagattttcccctgttttatatcctacagatttttttttaagttttgtgatttacatttagatctatgacttggtctcagtttttgtgaaaggggtaaggtttgtgtttacattgatttttggggggatgagggacatatgatgtccagttgttccagcaccatttgttgaagactgttctttctccatgaattgcctttgctctcttttcaaaggtctgttgactatatgtggttctacatctgggctctttattccattccactgatcttttctttgccaatatcatactgtgttgaatactgaagctttttactaagtcttgaagtctggagagtgtaaatcctctgacttggttcttcggtatcgtgttggccattttggaccttttgcttttccacatagactttcaaatcagtttgcctgtatccaccatgccaggattttgactgggattgcactgaatctaaagatcaagttgggaagaattgacatcttagcattattgagtattcctatctataaacatggaatatctctccattttttcagatctttgatttttgattagcattttttagctttttccttatatagaccttatatgagatcctattttgttagatttataccaaagtgtttaatttcttggtgttaatgtaaatggtgttttaatttccaattccaattgttcattgctggtgtatgggaaagcaattgacttgtgtactaaccttatattcttcaaccttgctataggtgttagttgcaggaatcttttccttgattccttgcggttttcaacatacacaatcatatcatctgcaaacaagttttatttgttccttttcaatctgcatacctttcattctgtttgcttattgcactagctaggacttcccagtataatgttgaattggggtggtgagaggagacatccttgtcttgttcccaatattaggggaaagcatccttcttcaccaacaagaaagacatttctcaacagtaagtgagatgttcactgtaggtttttttttgttgatactctttatcaggttgagggagtttccctctcttcctagtttgcccagagtttttatgaatggatgttggatttttgtcatgtgctttttctgcatttattgataggatcacatgatttttctttagcctattgatgtagtagattttatagattgacttttgaatgtcaaaccagcctcgtatatatggaaaaatctcacttggtcatggtgtagaattttttttatacattgttggatttgatttgtattttgtcaaggatttttgcatcaatattaatgagagattagtctgtaatttgcctttctagtattatctttttctagttctgttacaaaggcctcacagaatgagctaggaattgtttactgtttctgctttctaaagagattatagagaattggtatcatatcatgagatacctggtagaactctacatgggaaggttattaatgattgattcaatttctttaatagatatgggcctattcagtttatctgttttttcccatgtgaattttgatagattattcaaggaatttgcccatttcatctaacttaacaaatttgtggagacagaactgctcataacacttgttattcttttaatacccatgggatcagtagtcatgctttttgatttgtggtattattttttggtgtcttttattggctagcctggccctaagtttatcagttttattgatcaaagaactagattttggttttgttgatttttctgtattaacatgttttcagtttcattgatttctgatctgatttctttttctgtttgctttagatttatattgctcttctgtttcagttttcctagattattggttttcagtcttcttttatatgctttcagtgttataaatttccctctagcactgtttctgctgcattccaaaaattttgataaactatttttattttcatttagtttgaaacaattaaaaaaattgaggcttctttgaccgatgttatatttagaagtgtatttttaaatttctaagtattttgtgggtttgcaactatctgtaaatatttggtatgtgttattgatttttagtttaattccattgtgggctgaaagcttggtttgtattcttttacatttgttttatgtttttattgcccagaatgtggtctgttttggtgaacatttatgtgagcttgagaagaatgtgtattctgtttgttgttggatgaagtagcctatagatgtcaattagatcctgttgattgatggtgctgtttagttcaattatgtccttaccgattttctgccttctggatctgtcaattcctgattgaggggtgtttaagtctttaactatgatagtggatttgactagtcctccttacatttctatcagtttttgtctcatattttgatgctctattgctaggcacatacatattaagaatggttatgtcttcttggagtattggcccctttatcataatgaaatgccctttgtctttgataactttccctgttctgaggtctgctttgagattaatgcagttattcccactttgttttgattagtgttagcatagcatatctgtccctatccttttacttttaacctctatgtgtttttatatttaaaatgggtttcttgtagccaacatatagtgtacagtcggatcttgttgttttaaatccactttgaaagtctctgtgttttaattggtgtatttaagctgttcacatttaaaatgattattgatttagttggattagttatctggtctaggtttgcagcttttctgttcattgctcttgttcttttttaaaaaatttattttgccttccactctttttctgccttctctgttattagttgaacattttaaataattccattttctgtctgttcatagcatatcaattatacttaaaaaatttttgttttagttgccctagagttggcagtgtacatttacaacgaatccaccttcaattaacattaaaactgttttatgggcagtgctggtaccttataacatagcattaccaattatttctcccattttttataacactgctgttttttattttgcttttccataaattataattattcaatatattgttgatgtcattattttgaacaaatttatgtgttagatcagttaagaatttttaaaataaacgttttgtttttatcttttattctttaatgcttttcctttgtgcagatcggtaacctatattttccttctttcagaagaacttttaacatttttttcaagacaggtctagtagtgacaaattctctatttttatctgagaaagtctttttttctcttatacttttcaagaattttgctgtatgcagaattgtaggttgctagttttttctttcagcactaaatatttaacttcaatcttcttgcttgcatggttcctgaagaaatgtctgatgtaattcttatccttgttcctcaataggtaaggtttctcttaactaccatctgtggcttctttaagtatctttttgttgtctttgattttctgcagattgaatatgacatgcctaagtgtagatttttggtatttatcttatgtcatgttctccaaactttctgcctctgtgatttggtgtctgtcataaatgttggaaagttttcagccattttttcttcgattactattttaatgatttttcagctttacaatggtgcaaaagcaatatgcattcagtagaaaccatacttctcttgctatgctgggcagcagcaagcctcagcttccagtcagctatgcctttttgactgacagtattttcactcaggatggacttactgggacttaagtggaggagcatctgtattctgtttccttctctctttcttttctgtcttggattcctattatgcatacattttacctttttaaattgtcctacagtcttaggatattctattccttttttttttctttgcttttcagttttggaagtttttattgacgtatctttgagctcactgattcttaggccatgtgcagatgatctggtaatatgcattctttttttctgttgctgtttttttttatttctggcatttccttttgattctcagaattttcatctctttgcttatattacccatcaattcttaacatgttctctactttttccactagagcccttagcatgttagtagttatttgcaattgttggcctaataattgcaaaatatctgccatatctgaatctgattctgacacttgctttggatcctcagactgttttatttttcctaaccttttagcatgtctaatggtgttttttgtttgtttgtttgtttgtttttgagacagggtctcactctgttatccaggctggagtacagtggcacagtcttggctaactgcaacctccacttcccggtctcaagagattctccagcctcagcctcgtgaggagctgggactgcaggcgcaagccaccaacacctggctaatttttctatttttgtagagatgggtttttgccatgttgtccagactaggttcaaactcctgagatcaaggcagtccgctcaccttagcctcccaaaatgctgggattacaggtgtgaaccactgagcctggctattttttttttttttttttttttgttaaaagctagatatgatgtattgggtaaaaggaactaagatcagtaggacttgagtatgaagtttcatgtttatctggctaggggttaatctgtgtttatttgctgttgatgtcagaggctagaatttcctatagtgtccttgatcttgtctactctgtggtatttgggtttccctagagactcccttttatttttacttttttagagacagggtcttgctgtgttacccaggctagagtgcagtggcacgatcatggcttactgcagccttcaactcctgggttcaagggatcctcctgcctcaggctcttgagaagatggtactacaggcatgcgcctccatgcttggctaatttatcttttgatttttgtagaggtgggggctcactgtgttgctaggctggtcttgaattcctgggctcaagtgatcctcctgcctcggtttcccaaagtgctgtgattacaggcatgagactcctttttaaatagagcctgagccttaccattctttcagttgtgatttcctgttttacaggagctctgttgattgtagtaagatgagtgttgtggagcggggagaatagtctgtatgtagtcctgtgattaggctcaggttttttgtgggacagtgcccctgggctttcacctttacaaatgcttctcagcttttttaccccccttaggtggaacaagaaagctagagagagaaccctagttggatattttccttattccacttggtcaggctttgatatacccgctgttggttagcctctggtaaaataattttccttaaggtcagtcctttgttaaggataacagaatgttctgggaatatttgaatatggttactttttccttttttcctttctccttccagaagcacagggatttttttctcttttctttaccctgacaacctgatggggcttttggagttaaaaatcatggaagtagctgggcacggtggctcacgcctgtaatcccagcacttgggaggcctaggcagatggattacttgaagtcaggggtttgagaccagcctagccaacatggtgaaacctcatctcttctaaaataatacaaaaattagctgggcatggcgggtgctgttaatactcaggaggctgaggcaggagaattgcttgaatccgggaagcggaggttgcagtgagccaagatcgcgccattgcactctagcctgggtgacaagagtgaaactccatctcaaacaaacaaacaaaaaaaatcatggaagtgtggggagccccttaaggctggtttgccaggagtttccatctgtcaaactagtccatatttagactgtcttaattaatctatttaagtttttcttccagttgttggcttcagcaatagttgctgcttctggtaagctgtgattttctgtatttgcttgtttctttagttttggaggaggcagcagattgtcctgtgatctcggttctctgatggatctaagagaagctactgatttccagttcagtttttttttttttctgttgtgtggacaggagtgacagcttcactagttgaactcaaaactggaagtagtatgaatttttcagtgtctgaatttgccttcaatttagtttgagtcccacgacttagaagtaggctgttctactaggagctttttaaaccattacagttatttaatttgattcatttaatctctattgaggatctactaagtttcatgcatcttttattatgtatagtatttcatgcactggaaatattaagatgcttctatccccatacttcttttttcaaaggctttttctcattgttctctagaggatgggtctatctcttatattttgctaaagatttgttgccttttgtattttatctttccttctattagcaaatgtttttctctattagctcattctcatgagtatctaattatgctttcatacatcatcttaaggaagccaccttgggtctttccacaccccctaacttctgcaatctctgttcactttcattatcaagagttgtctacttatattgttacaatctctcaaatttagtttacttttcaatctattccattctggttgtcgcttctgataccactgtgaatgctctgtcatcagggtcctccctgttgcaaaatccttcttctctgcgtgccacatactcctacctccccacctcaggctctggcagccacagatcttactatctgtctagttttgcctttcctggaatgtcatagtgttggagtcatgcagtgtgtagctttttcagactggctttcacttagcaatatgaaagtttttttcatgtctttttgtgacttgggagctcatttcttattattgtatatatctaccacagtttgtttatccatcatctaatgaaggacagcttggttgcttgatgtttttggcagttctgaataaagctgccgcaaacattcctgtgcaggtttttatgtggacttgttttcaactcatttgggaaaatacctgtgtgtgcaattgctgagtcatgtagtaagcctgtgcttagctctgtaagagactgcagactgtctcaactcgactgtactgtttttgcatttccaccagcaatgaatatgaattcatttgctctgcattcttagcagcatttggtgttgtcagtgattgtagcctgtctaataggggtgtggtagtatccattgttttaattagcatttctctagtgatatagggtgttgagctccatttcatgttttttttttttctctattatctttggtgatacatctgctcagattttttgctcttttttaagattttttctttattgtgtgttaagagttcttggtatattttagataccagtcctttataagatgtgtttgacaaatattttctcctagtctgtggcttgtcttttcattttttttaaacagtgttttacagagaagaaaaattttcaattttaatgaagtctaccttatcaattttttctttatgggtcatgattttcgtgctgtgtttacaaatatattgccaaacaagattttcttcctcattatctacaagttttacagttttgaattgtatgtataggtctgtgatactttctgagttaacttttgtgaaagataaaaggtcagtgttggatagattatttttccttttgcatgtggttgtccagcaccatgaagactcttccttctccactgaattgtctttgtacttttgccaaagatcagatttacctcttaaatctttgtcaaacctgtccacttctcaccatctccattttcaatctcttcaagccaccatcctctcttgcctaattattgcagtagtccttactggtcttgccttatctgttgatccctgttttattcacagaatatgatttgtgattttaaaggcataaataaaatgccttttctgtttaatatctaattgctttcctttatacaaacaacaaaatccaaattctttatcatggcctgtgagaccctaaatgatcaggccctaccttttcttccaactttaccctcattcttcctctccagccacctttggctcatttagtctctgaatgtgttactgtctactaccttaggggattcctaatgactggaatgccccttttaagtctcagcttaaatgtttcctcttcagggatgccttttctagtcattatatctaaacatttagttctcttccttgacttttactctctaacattacatcaattctttactactattttgcccaatttaaaagcatatattgttggtctatttattgtctgacttcctgagaccagggatcacgtctgtcttgtttgctattgttttttttagcagctgctacacagtaggcgccaaacaaatattttaaggaagaagacataggcagcctttgagatgcccaaatttagtgaggaagatccatatgtatgtaggtaaattatagtgccattttagtgctgttagaaagttgtagttttggaaaacaagtaatgaaaggttaagaaagaaaaatctttcggattcttcctcaagtgtgtgaactttatagctgtcaatttatgaagtcttattgcctaggtttctttttttttttttttccattctttgtcacttttattcagtaggttttttttcccttattttcagtgccagacatggcgaggagtgattacagccaactgttattaaaacatttgttcacaacatataccccctttataccactgaccccaaactgactcattttatgtgctttcattctttctttttttaatataccactatcaagaccgggtggagggggcaagggtaagagagatgaaggggaggagtccaggaggccagaagaggggaatgctacaagccacagtaagaatgagctgtatttaatttaaaaaaaagggggaaggggtgtaccccacaaatgatacagtaatgaggatacacaattaaatcccatagcatgactgaaagctttcactgtgtttgacatcatcacaatggaattgcctaggtttcttagctaaaagtaagtttgtatcttttattatttgatagtggggggttagcgtcctagaagtcccagacttaggttctcaattgtcttaagaaaccatccatctgtattgacaatatgggtgctctaggggcagtcttaagcccaataagaggtcttttagcgcactgagcttttgctctctagggtcagtgtttggatttgaatatccagcactgccactcaccttgggcaagtcatttaaactgcatgtctcagtttcctcatctgcaaagggactaataaacacacctacctcctgggatggttttgaggaatacattggctaatatatgtaaagcatttactatgtgccagaccctgcaataaatgtgaaagtagtctctgttactacataaagggcttctcatttagccaaaattttattacattctagtacacttacgttgagtaatatgcagctttttcagtggatacttcatttcaaccttacagagaaattagaaaccatcagatgggatatccttcattctgataccaaacataaatctgacatgttcaacaccccttccttcagcttcacctatgctctatatcttatcacctctgctatctgagatcttaagatttttaaaaaattacttctttctcatatttaactttttcctttcaactagatccttctcttatgcatagaagcatgttaaagtttgtctaaaactttcattgatttatatctagctacttccccatgcttcctctgcatacccaaacttaaaaactctgtaatctctccattcctcccctactcagcccacttgaatcttgcttccacctctgataacctcactgaaataatactattgaggttattagtagatcaagtggacagctttgtatctagtcatatgtgtaccctcagcagcatttgaaacagtagactacattctctcttcacactttgggtgctattaatctttagtcctctgatttcctgtctttctggccagtttttagtctgattcgcagactcattctcactctacctggactttatatatgggagtttcttaggcagggtccttggttatcatgtgtcaattctctgggcatttctaccaataccacagattgaataccttcacacagatgactcgtgtttataacactgatcaacttcatagatctacctatttgacttctctttttgggtgtcccaggagcacttcaaacatgctttatgaatttatgatcttcgccttcaaatctggttttcttttgggagatctcatcttagtgactgtcacccacatgtgttcagttatgtatgctggaaacctgggtgtcgtatttcagtatatctgtagtccttacaccataatccatcatctagtcctgttggtttttttacgggctggagggctgaaatatctcagccatatatcctgttgtcattaccttgtctcaatccatgatttcctaacttggatgcaagagttctaattggtctccttgtatataaccttatgctaatgaaattcattctccagaatttggctggagtgatgttattcctttaattaaaacattatattggcttccaattaattttgggattcatgggtagggtagagacaaaaattcttgctataatttttgaaaacctgagagtcgccatttacctttccagtcttacctttgaccactttttggctgtctcttttgcccatttacttacttcagggacgtctcttgtgatgttcttgaataggtgagatcattctgtttgctgtcattgtgccatgtatactccattttgtatactcctggttttacatttttgcgtgccatttctccctgtagctaaaatcctgtgagagaccaggatcttgtttacttttgcttaccatttgccattgcttattagcatagctaattggcttatacccttcatacattgaattttaagatgtcagccttatttttcatttactatgaaaaaaagggaaggaaagtaatcagtgaaagaagaaacctaacatgatagatgtaaaacatactgctttgaatcaatgaaagataagatcacaatgatattgttgaaatcattttctgtaaaagctgaactaacttaaactataacatcctctcccagccccttgcttttctataatggtaaaataaatgctattgaagaaaaaaaatttagaccggttctagattctaacaccttaagaaaataattggcactaaatccactgtttcaggcctttcaaaactgaaaaattacattgtgtttctaacattgaaaataaagtttcaagatagttttaattaatttggatataagtatagaaggtttgaccactttcagaactctcaggtgattttgacttgtgatcatctctgggaagggatatttagtgatagcctgaattttaaaaacctcaacttgaacactgggagttgatgggagaccatctgattaagggatggactaagtaagtgtaccagtgtcagtttgcctattaaatacaatcaaagcgcaatgtctttccttttaagataaaaaaccagtaatttggataatattttaattcagcaccaagtagattgtttctcacacctgtgttggaagttactggtttagagtatggtttaaaatttttttctctcataggcctttaaaattaaaataatttgcatgttaattaaattccagccttaatagggttttccatcaccttaattcccacatttgtttttcatttccaacatctttgaacttttattgaataaaataattgtacaatcttagataaatattaaaccaaaatttgatgaaagtaatactgcattcatgatactttgctagctagatactataattagaactgaatgaaataaacaacctgtttttaatttttcccttttttgagggatgacacagtttgcctaattagaaataccttttgtgactgtcgtttgtttacctctattttgcagcagcatagcacttctgagatgtttaacttcttttttcatcaaaattattttgaacatgctgacatatctttgagatttaattcctagtcatttaaagaaaataaggggctaggggtggtggctcacttctgtaatcccaacacttggaggccaacgctggaggatcacttgagtccaggagtttgagaccagcctggacaacatagagacctgtctctacaaaaaaaaaaaaagttagctgggcgtggtggtgcacgtctatagccccagctactctggaggctaaggtgagaggattgcttgagcctgggaggtccgtgtctgcagtgagctgtgatcctgccaatgcactcagcctcggctcagtgagaccttgttaaaaaaaaaaaaaaaaaaaaaatatatatatatatatatatatatatatacacacacacacacacacatatatatgtgtgtatatatatgtatatatatgtgtatatatatatatacacacacacatatatacgtatatatgtatatatatatagtattaagctggaaaatacttaaactttttttttttttcttttgatagaaacagggtttcaccatgttggccaggctggtcttgaactcctgacctccagtgatccacccacctcagtctcccaaagtgctgggattataggcgcaagccaccgcacctggcccggaaaatacttcaaaatgctcaggttttgattgatcaatggatagtaatcctgcacattttcagtttgaaaatttaacaattctgttgttattgatatgtcttgccaattgtagataatttcttgtgggaaattttctaatttatgcttactgtttattttttctaatctttacccaatttttgtgaggaaggagtacatttgtgtgtgtgtgtgtgtgtgtgtgtgttttgtttttgtttttacggtaacgatggttactattgctctctgttttagaagtaatggtcatacataagagcacattgtgtacaaaaataaatattagtttgtaaaataggttgtagtacaggatgaatagagaggtttgaaaaataggtccgtttccattatttcctttaaaatgcatatacacacatataatctagatcaaatttttatatacaggtatacatgtgtatacacacaaacacacacgtgtatatctctgtgtaaacctttcattgatctcagaccaggaagggaacatgatggatcaggcagctgtacttccaggttgcttttttaggattgttgccctggtgtagagctgagatcagcaggtggcaggaagaaggcggggtgactaactgggcaggacttaggaagagactgctatccctttcttcctccatcttataggtaattgatctgcttttgctgaaatgttttctgctttgataagcttctgttgttagtagtgttgctgtttccagaaataggaggagaaatgaagggaattacagagggaaaatttaacttttaaaaatcctgcctttgagggaagaaaactaagtgcctcagcctcatttcttctgcttaatggattcttgatggggtactttaaaaaatgtctctttatacattttgctaattttaacaaaggtagatcaagtgagtattcacttgtaatattagtttgcttttttttccccccataaaaagaatatttctttactggtataatgcagtcactggtgtgctttgaaaatggcctgggtgtctttgatgtgttggggtgtcctgggtttcttttctgtctgatggccaccatgtggctagtttccataagcctttatgccgaagtcccctttgggagcttgatttcaagtcttcaggaacttttatttattaagagattttaaaaagactattaagagaatttgtttttaaaaagcaggttcttcagaattagagggaggtaacctgtggtagaggggagctggtaaagggaggtgctttctcaccattcagcgtcaatttctagtgcccccaaagtctcaagtaaactaatgatgttcaacaagagaactttttttttagtagcataggtgctaaagttctgcaggtcaagtaatgtattattccggggatactgcatactactaatagctaaaacacttgaaaccactttttgggaattggatatgtttttattaaaatcaaccccactttctatttcagctgttcatttcaaaaagtattagaaaacatgaaaagtttgcctactcttgaaaatagtatactagaagtgtggattttgtttatattaatatccttatttctccctctgtgaagttctactgcttatttgaagtgaggtggtttttcttttgaaaatttgtaataggtgtaaaatggtacatattgcaaagttttgctcttatacctgttttaaattcaccaaatacttctcaccttcctagccctaggcagccactattaagttttttatatgttatttcagatatatacatattcatgcaattaagaatttttttcacttaggccaggcatggtagctcacacctgcaatcccagcactttgggaggccaaggtgggtgatcacttgaggccaggagttcgaggccagcctggccaacatggcaaaaccctgtctctattaaaaataccaaaattagccgggtatggtggcacatgtctgtaattccagctacttgggagtctgaggtaggagaatcacttgaacccagaaggtggaggctgcagagaaccgagattgtgccactgcactccagcctgggtgaaagaaagaactgtctcaaaaaaaaaaaaagatttttttcacttaaaattttacacaaaacttgtacactatatatgctgttctgctctttgcttttttttcacttaatatttcttggccatctttccatatagtaaatagatgactaccttattctttttaaaaaaaaaatagttgtagaggattgtgtctcatggatataccacattttacttaaccaatctctaatcaatgcttattttagatagtttattatcttttgctactaaatataatactgtagtgagtaactttgtacaggtgtcgttcctgtctatctgcatatatatattcataagttaaattcccagaagtagaattgctgggacaaagggtatgattttataattttgatgactattgtcaaattgccctctataggagttgcaccagattaccctcccactagcaatggatgagaatgcctcttttcctgctgccttatcattagagtatgccattaaacatctggatttttgcttatctattaggttaatactgtatctcagagtaattttaatttgcatgtttttaataaatgactttaaacttcttttatttatttatttttttctttgagacaggatcttgttctgtcacctaggctggagtgcattggtgcgatctcggctcactgcaacctccgtctcctgggtacaagcaattctcctgcgtcagcctcctgagtagctggaattacaggtgcataccaccatgtccagctaatttttatattttttgtagagacgtggtttcaccttgttggccaggcgagtcttgaactcctgacctcaagtgttctgccccctttggcctcccaaagtgttgggattacaggtgtgagtcacggtacctggcctaaacttctttttataaatatttgtgtttccgtatactgtcagtttgtatcatcgtgtgtgtgtgtatgtgtgtgttttggattagccctttgtcagtgatatgagtagtaaacgtttttcccagtttgatatttatcttttgatcttgttcatggtggtttttttgtgtgtgtgtgatgtggggggcatgcataggttttttttatgtagtcaaattcatcaaagtttccttttatgactagaattttgagtagggaagatcttgtttacttcaaggcgataaaggaattattttacatttactttattgattctttttttttcctacataaatcttaactcctttgaaattgattttggtgcactgagtggattcaattgtatttttttgcagatggcttctagttgttctaataacacttaatgaataattcatattttctccagatcatcagatcatattcagaatgagttttaattggaatgtccttcaaatttgcatataagggtgatagaataaatgagtaatagaaaaggtaacattttctattctcagtttccttgttagttgagttgccaaaactttagttgtctatacctgcaagttgaaaggaacttttagcaacttttctactacatggtttgagtttggtgtgggttatcctcaaggtttatctattaaaactgtttttaattggtgtctgaggttatttgtgcttactgaagtaacttgtcatctgaattctcttttcccgaaggccttaattagctgagaacaaagttaaaagaagttagaagagaaaagattctctactgcggttcagcattgccctggttgatactgcttatggtgactgtagttggatatgtctcctgttgttagggtttccagtggtttacacaaactctgaatctgaatgaaaaaacatagccagggtttataagtggatctctgtcctagccaattcactttatttctggagtgttttctattgctaaatatttcactctattttgttaggccattttcttcccaatctagttatctccacattttcaagtatgaagacctatttctgttatcaaaaaaagtcacaggttatgtgttttgtgtattgtgacttttgaaaatacatgacaaaaacctatcatttctagcagtgatttaaattggtatagtattgatcaccaaaaacatttatatatgtttggaaaagtatgttcatgtttgagatataaagcatgaggcaattattagtcacatgttagatcacatataagtgattttaatgaactcctagatgcagtaaagcaaaatggtatcagagagacaatcccttctctcatgcagaagctcacttaataggataaagacaaccattacaaggacattttttagtgttaggggaagtagaggagtactgtgagatcaattgcagttaaatccaacctgacctagagaatgggcaagaccttcctgaggatgtgacatttaagctgatttctgaaaagaattggtgaaagttaggactggaggtgagaaagtcaactaggaagcaatttcaggatttaggaaggagctaacctgatcctgaattaggacacaggctttagagataagaatgaagaggccaggcgcagtggctcacgcctgtaatcccagcactttgggaggccgaggcaggcagatcacaaggtcaagagatcgagaccatcctggccaacatggtgaaaccctgtctctactaaaaatacaataattagctgggcgtgatggcgcacgcctgtagtcccagctacttgggaggctgaggcaggagaattgcttgaacctgggaggcagaggttgcagtgagttgagatcgcgtcgctgcactggtgacagagcaagactccatctcaaaaaacaaaacaaaaaagattgcttttactaaggaattcctaagtcttgttaatttatagatgtagatgtagagaaagggatgaagataatctgattttccaggtgggaagtggttctgtttcacagtaatagggaatataggagaaacaggtttacagaggaaacactaagcttaaggcatgttgagtttgaaataaatatccaaggctgggcgcggtggctcacacctgtaatcccagcactttgggaggccgaggcgggcggatcacgaggtcaggagatcgagaccatcctggctaacacggtgaaaccccgtctctactaaaaatacaaaaaattagccgggcgcggtgatgggcgcctgtagtcccagctactcgggaggctgaggcaggagaatggcgtgaacctgggaggcggagcttgcagtgagccaagatagcgccattgcactccggcctgggcgaaagagcaagactccgtctcaaaaacaaacaaaaaaagaaaacaaacaaacaaaaaaagaaataaatatccaagtagagatggccagtgggcgttcaaatttgagtttgaagattgggatacaattctgaaatgaagatgttgatggtgggagctgtcatcttaagtgataattaaagctgtgagaataaatgcgattgccctgaaaatgtgtgtagaatgagaatgagaaaagcagaaggttgaaggtacaacttttgggagcattggcatttaaaggggatggaagatcctaattctgccctttgcttgggtagctcctgtttatctaaattgctctccaagctcttcacttaaccaaatataatcaggccctccttcagtgtctgaattaaaacttaccttcatgaatccatttctactacttcctctaaagattgttttaaaaagcattcattggtggcagcatttaaaaaaaatcataaattctacttcagagattcccaggttttttggcttggttgtctgattcctgattgtttaacaacaacaaaaaagtgtgtgtgtgtgtgtgtgtgtgtgtgtgtgtatttctttttattcagaaagctgtcatttagatggataggtgtttttggattgtcatattgaacaattactatatgtcaattagttatatgccagatgttagcgataaataaaacttggctcctgatcttagagtaccaacaacttaattgagatgatagacagctgggtggatgttttatgacgttcatagctttcttttcccaaatataagttagaagtaaacttcttcctttcccactattactgtgacatgagctcagctatagaaaagcagaagaattacaggcaaaggtttttgtttatgttgtttgaaaattttttttggtttttttttgaaacaggttctcactctgttgcccagtctgaagtgtagtggtgtgatcatggtcactgcagctgcaacctcccgggctcaagcaatcctccagcctctcagcctcctgagtagctgggattacaggtgcgcaccaccatgcccggctaatattttgtatttttttgtagagatagggttttgccgtgttgcccaggatggtctccctgggcttaagtgatcctcccacctctgcctcccagaacgctgggattgcaggtgtaaaccaccacattggcctgaaaatgtttgaaattatacttggtatatacaatttttcataattttttcacaaattaccacgagttcttcagaaacattgtgagtttcttataaaaaacatatggctgggctggacatgatggctcgtgcctgtaattccagcacttgggaggctgaattgggcagatcacctgaggtcaggagtttgagaccagcctggtcaacatggggaaaccctgtctgtaccaaaaaatatacaaaaattagctgggtgtggtggtgcattcctgtagttccagctactcaggaggctgaggcaggagaatcccttgaacctgggaggtggaggttgtagtgagccgagatcatgccacttcactccagcctgggcaacagagagaacttgtctccaaacaaaacaaaacaaaacaaaacatatggctgtaccagagctttattcttattgcctgatgttcatttcattttctactatatttataaatagtgctgtgaagaacattcatatttgtgcattaatctttttagacacttaggattatttcgttagagttaattcacagaagtgcaattgcagggccgaagagtatgaacattttttgttttttttttgagacggagtttcactcttgttgctcctgctggagtgcactggcgcaatcttggttcactgcaacccccgcctcgcaggttcaagtgattctcctgcctcagcctcctgagtagctgggattataggcatgcgccaccacgcccggctaattttgtattttttttttttttttagtagacagggtttctccatgttggtcaggctggtctcgatctcccgacctcaggtgatccacccgcctcagcctcccagagtgctaggattacaggtgtgagccaccgtgcctagcggagtataaacatttttaagactcctaatatatgctgacaagttccttttccaaagggccttgactatagcttcactagcaaagtacatgagaactcattttccttgcccaggttattttttttttttagctttttttttttttttttttttgcttattttctagtttgacaggtgaaaataatatcttgttttaataatgtaagtttattagtgaagctaaacatgttaaaaatatatttctttcaactgtctcttttttctgttagtgaaccattacatattcttactgcatcttcaatttaatagatttagaaggtatctttcttagcttttatgttttttcatggtgaaaaattgtcttacagatctgttgaaactttcctattccttgaaaaaaaacctggtaaaatacacataatataaaattcaccatcttaaccatttttaagtgtataaaataatggatggagtctcgctctgtcgcccaggctggagtgcagtggcacgatcttggctcactgcaacctccgcctcctgggttcaagcgattctcctgcctcagcctcctgagtagctgggactacaggcgcccgccaccacgtccggctcattttttgtatttttaatagagacggggtttcaccatgttgaccagactggtctcaaactcctgacctcaagtgatctgcctgccttggcctcccaaagtgctgggattacaggcgtgagccaccacgccctgccttatacacttcttaaatgtacagttcagtggcattaagtatattcacattgttgtgcaaccatcaccagcgtcctaccctcttcatcattttgattactcctccagcgtaataatcttggcttcagaattcactggtattgactgtagcattgttagtgttagtgcaccattttggggggggtactgttttgtttctaataattttattggcctgtctgagtgtggaagcgcactgggtaaagttgagattttcactttatattgggtcttgggttgtttgataataattcagagttcttcattcaatgagtatggcttattaacattaattttaattttccctaaacttgttattttgtcctgtcaagattgttgcttatctgccacttcatgcttatcacatggggcctcatgtgctttttatatagtttgtttttgcttggacatttccttcctcagttcttacccatgagcacgggggctgtgtctgactgtgtgtattggctgaggacacaggaggtacaaaggctctgctgtggaaaggagccttgatttgctcgaggaacagcagggagacttgggtggctggagcatggggagcaaggggacagtggtgtgagatgaagctgcagaggtaagcaggggccagatgctgtagggccctgtaagagttaggttcctattatactgtgaatagagctttgttgaaagatttttaactggaactgggtggtgggcaacatagtctaatgtgcctttaaaaaaatcatcctggctgttggatggagaaacggattatagaggaataagagtggaagctgggaggtgtgttgggacatgatttatgttatccaggtggcagtgttaaactgattcgtttcctttttttaaaaaaacaattcatattgtgaccatctgcagcacaactgaagataactggccaagtttactccatggaaaagttaagcttatagaacgtatgaacatcggaaccatgtgttcattagtatcatactttaaccaagctcaccaacccctggctaaatatagtttctatgtatgtgaatctcaaacatttactgtcagctgtctttgaacatccctgtgaagttaactgaactttaattataaatgattgagtgaattcagaagatactaatattgctattttacataggaagaatgggaagtctggtcatttatagtactgaaataaaaagcaaaacacttgtcagtttctcctagctgcaagcaccattttattaacaacatgttttaagtttaattccctccaaatctattataacttcagtgtatggatgagacttgagagttctgggatatattattcttgggacaccagttaaattattcccacacttaactgctgtcgcaagttagaatttgtataattcctctaggaagctgcctgtgattccccagggctcaggaaggatccctctttgtgctgtcgtagtgccttatatcttcccctgtggtaggcatttatcatgctgaattatatggcactctgaggacagagccaaagattcgggagaatgaatgcaaacatggggagttggggaagcaaaactgaagggattgaggcaagagtgaaaattctttgaagtcttgggaatcttctacttcatttcttaatgcggttttgttttcatatgaaatactttacctaatgaataaaattgacattacagcaagctgtaaattttgtttatattgcagcttcatctattttcagtatcttcttcagtctgaggggttgcaattctatagtattttgtgtactttaaatccatctcctgtgttagctatagggggctagcatcaatacatacatattagtctttgcacattaaaaaaaaaaagtaaagtaagatatttgctttgcaaaactttgaaaacatctccttagtttgaaaacatcttccttagtccttcagtataatgtattactctgacgccttctcagacctccctaatcttggcctttcgctcctttttgagccttcctcattttgaaccttgcgctactgtagcaacgttattcttacctctgctgcttttatctcctttcttggctgttaacccttcctcccataaggtacctgtaggtataaaaggttatctccttagttctgttcctttctgtctacttactcctgaagcatttgctgtagttcttaaagtctaaactctgcaattgactccaaatctttatcttcaacctgggcctctttcccattgccctgtgctgagatagctgccttatatttatatgtgctccctctcctcagtttatagcttctattgatgattgtcccaattttccagtactccaggctaaaagcctaggacctttgactccattttctcatgcctctgacatgcttgttcctgagtccccagatacacagcaggcactgtgtacacattcatcccattgtgaaatctcagattctgtagtgtcttgcctttttgttcttctcctctctatccccattatcaccactgtagtccaggctgtatgacctctttaaattatctgtggagacaccttactggtcacccagtgtccaagcccacttccatcttttccatactctctcgatacccagctcagaaatctttagtggtagaacacttttccctgttcccttctagctatcttcttacatatactttttatttattttttcccatccacttttaagttctgggatacatgtgcaggatgtgtaggtttgttacataggtaaacatgtgccatggtgatttgctgcacagatcaaccataggtattaggtccagcatccattagctattcttcctgatgctgtccctcccctgccccctcaacaggtcccagtgtgtgttataacccctgaagtgttcatatgacatcatcgttcagctcccacttataagcgagaacatgcggcatttggttttctgttcctgcattagtttggtgaggataatggcttccagctctatccatgaccctgcaaaggtagactgctttcacacaatgtcttgctttttcttaggcatctctctttcccagaattcctactcaactgttcccctgaaactcacctgcccttctgggaccatatttaaatttctacttgatggaatgtaatctaattttggaaactccatacattttttctgtagctttaagaaactgccatcattattacttcgttataccttcatcagtgcttgagagtaagtggggcagagtggttagaagcatggactctggagccacactgcctgcattcgcatcccagttcacctcttattattccccaccttgctctggttacttaacctctctgagtctcattttcctacctatttcacagagctgttaggaggaataaaatgagttaatgtatgtttaaaatactgaaaacactgcccagtactagagagatttctgctgttatcattacatgttaaaaaagatttcttctgttccataagcccctttaggttaagaaatgtcttattcttctttggatgccctcacagaatgtagcatggtgccttatacatagtaagcattcaataaataagtacttaatgaaatggaaatttattgaaaagtctagtagttcaataacaatgatttttggttttgatcctaaagtgaaatcacagagttttttctgggataatttaatagcagaatatgttgtttccttgtttaattgcacaatttggattttaaaaaactgtatagtttaaatatatatagtatgtattttattttttgagacggagtctcattctgccccaggctggagtgcagtggtgcagtgttggcttactgcagcctcaacctccagggatcaagcaatcctcccacctcaacctcccaagtagcagggatcatagacacgcaccaccacgcctggctaattttttgtatttttgtagatacagggtcttgccatattgctaagtctggtctcgaactcctgagctcaagtgatctgcctgcctcagcctcccaaggttacaggcaggagctgctgcacccacccttattttaattttttttggagatgaggtcttgctttgttgctcaggctgactcaagcgcctggcttcaagtgatcctcctgccttggcctcccaaagttctgggattgcaggcatgagccactgtgcttgacccaaaaatatatattttgaccaaatcatacaaggatgatgaaatggcaaacctgtgagtactaaaatataagacacaggctttgacattaaaggaaaagagcactacgattcacattaggcaaaaatttgcctgcaatggagataaccttctaaatgaaagcatcccagagtagaaagatcccagagtagatccagtcatgatgtataattttctttcaagagcactagttttaaaagcaccattctgggatttttagcttatgtatgcatttggcctttaacatatatttgatagagctttttagtacctcttagaattaaataagagatgtccaggattaaaatttgctgttgatgttgatatgtgaaactttaatgcattgtagattgtggtaatccgatgtttcaactttaagtatttgacatcatttggggtgttagttttatgattttcaagaaatgaaaaacattatcattggggcagacatttcattcaaattacttctatcagtttgcttgaaaattttttttttttttttttttttgagacagtctccctctgtcacccaggctggagtgcagtggtacgatcactgctcactgcaacctccacctcccaggctcaggtgatcctcccacctcagcctctcaaatagctgggaacacaggcgcaagccaccacgtccacctaatttttctatttcttgtagagacagggtttcatcatgtttcccaggctgttcttgaactcctgtgattctcttgccttggcctctcaaagtgctgggattacaggcatgagctactgggcccacccagtgacttttaagagagtcacttgagacttttaagagagacttaagaatgctctaaaactagactacaggtgaaatgtagagtgatatttggtttccggggaggggcgggtggggaaggaagaaatattcattaaatacaggcttgctttttctggcttcaagtcaagtcaagtagttttttttttttttttcatttgtacattttacaggggctttgatgggtctgacaaagaagcacttgcaatgttttggggtttctgttatgaaattaacacatagctcaaattcccattaagtaatcatgacttaaaatagagtccagctatatagtcttgcatatttcagagttaagaatgtaatctttatcttttattgttaatattctctaaggtttatttactgtattattttgtcatgagtttatttaaaatattttttaatattaaagtattttaagtatttctagttgtaataaaaatgtagatatattcaagaaattataaaattaggttttgtaattgatcggtattcaagtaaaaggaggaaagctatcaagtagtcatgatgaaatattcatcaaatgtaaaatgacctactcatcaacttgccaggtctaacctctgtttctgtttcatttgtctttacaaccttttaagaagtttattttgtaaacttcttttttctctgctttagagttggaaatactgaaagacttttctattctagattgtatcttttccccccagccccaacccaaattgaagaaaactattgggacaactggatgatttacaaatctattagcaatggcaacaatatgaaaatttgaaggtatttatgtatggcatcctgtagtttgggtggaaatcattttttttttcctttcacttctgccatgtcaactttagtctcaatgtgtagattccaaaatagaatcccaacagatttctggagactttcgtctttaactatgttgtctctctcttctctgttttttttctgtgtactttaggatatctgtgtgggaacctaagaaactatcagagggaactaggaagtaaaattgctgaaatagcagcctttatattagtattatatgataacttgaaaattattggtgatatgtttatgttatgtaaatcttgtttgtatttttatcttcaaatttcagaatgtttaatatacacatattagcatgtctctaacaactgatgactatagtttggctcgagaggcttatatcatgtaagctagtcacacctatttgaattcacttttctttgtttcttgatttcttatggctattattgcaacaatcaaacaaattttgaataccttttgtgagctagcactgtggaaatatgagggaagtttattgtggttcttactttaaatagtttgcagttttattgtgtatacaaatgtatgcatgtgaaatatacagattttaaaaaagcagatcattaaagattaggtcataaggtgtagtctgtacatggaggaagagctaagttgattcagaataacatggttagattttgaagctagcctggatttgaatcttggatccaccactgactagctatgtaagcttagtcaagcaactcaacccctgccactgtaggggcacagtttcctcatctgtcaacagtttcctcatctgtcaaatggtgacgataatataacctacccactgtatagttgtgacttgtggcctttctttactggtatttcttgagaaaattgagccctaatgagctaagcatttgttgtatgaatgaatacaacagttttgtggttctggaatagcattggtcatcaaccatccttgggatatttgagaaaacaggcactcagatcattttctgtgtgtggtggttccaatgaaggaatcttagttaaggattaaatgagttaacatataataaataacagaaaacaaggcctggaagttttaaaactagtattgttggactctgaaaaatgaagacaatttaattaatcagaggtgagagttttcagcctgagagaaatcaaaggtttatatgaaaatgtttttcatcttaagcaagtatccaattactttgtgtctctggaaccaaatgggactgggaaaatcaacaacgtactcaccaatcaggaaggcatccaacatttggaaggaggctcacacatagaaaaaagattcttaataagcatattacctgtatcagaatcatcaaaatttacaaatatattgaaacgataggagagagagtgcacataagagtaagccttaaaaacttctaatgagaaagagatggtgaatggaaatgaaccatgtaggataagatgtgtaaactgatacaccttttgttgctatatataaagacaaattatttcacttggtcttcagtgccatgtgagtacaattttaggtaggttaagtgtgaagaactggctgttaagtataaagatcatttggcgactttgggaaagagccattttaatggacgatcagcccacagcacatgtgttagcgcttatgttttctctctcacacacatacattagtttcaatatgatattagtaaatttatgaggctttgatacaggtaatatgcttcttaagtttagcttttcatgtgtttattacagtagactcttagctcattatccttcttttagggtttctcttcctggcagtttattctgcatgtcactgccgtgatcattttctttcatctgttccacttgattcctactaatacgctaccccctccacccggcctagcctctgggaccaagtgtgcccttaggaaggatttagagttccatttcaatgccaggggattcagcagtaagggtagttgttgctagtttgatgctttattcagtatttataattagtatactaccttattccagtgatttgttccccaccttgcactccaattcaggtacctgggctacttacatttctctttgaagagtccttggtttgataaccctaagcctttggagaggggtctctctgatgtgtgacatttgtgatttcctatcgttgggatatctgttaatgcatgctgaacttccctcaaaccagccacttgcctgattattaactgttgcctttcagggttttatctgttttctattataccttctaaattgtccctcactgcttgctattggttcaccacctcgcagtttctagtcccaaatcactattcttttcggtccatggcaggaacctctggtactacctggaaaatgacaacagcagagaatgtagtgttctttataaaattcctctggcacatgaaggagccagcagaatcaatgccattaaatataccagttggaccacacatagttgctcatgcctgtaatcccagcactttgggaggcgaaggcaggaggatcgctggaggccaggagtttgaaactagcctgggcaataaagtgagacactcatcttcacaaaaaataaaaaaattagccaggcatggtggtgtgcatctgtagtcccagctattcaggaggctgaggcaggaggattgcttgaacccaggaatttgaggctgcagtgagctatgattgcgccactgcactccagcctgggtggcagagtgagaccctgtctctaaacaaaaacgaagcatgtccatagaaagaaactgaaaaatgttagcattaagaacccagatggagacctttcttttggtcaagattataatttagaaattttgagatggggtgtggtgaggaaagtgaggaagcttaactgcttggttctttcatctctgaaatttaggcagtgacattatttatttagagtgagataaattgtgatggctcaaagagaatgaaaaatccctataatggtttatatgggggaatagatatatagtcaactaagaatgaacacaaggattgttgaacagctgtgaaataattttatgtctggctcctgtaacatttggaggcccagaaacagactggctaataattagccaagtgtgtatatgaggtttttttaaaggatttcttccagaagggattaaaggcagtttacaaaaatatatccagcatgacaaaattaaatatatataatggcaaaggagaaaaaaagtttaataagatggagctcagaatgaggataataaccagattgcatatgaggaagtttaaaaatgggccgtaagttagccgtgagcttttttctttttcttttcttttttttttttttttcttttttgagacgggctttcgctcttgtcacccaggctggagtgcagtgggcgccatctcagctcactgcaacctccgcctcctgggttcaagtgattctcctgcctcagcctcccaagtagctgggattacaagcacctgccaccacgcctggctaatttttgtatttttagtagagatggggtttcaccatgtaggccaggctggtcttcaactcctgacttcaggtgacccgcctgcctcagcctcccaaagtgctgtgattacacatgtgagccactgcacccggctagctgtgagctttttagtagccaattgcaaagatggaaataataataaagtgatcccaaacctgtaaaatataaaacaaatgaattacttaggcaaagcacaagaattggtggcattgagaaaatgtttgcccgaggtcttttctgggaatttatcaaatattaacttgggggaaatgctttgggtccagcagaaatagccctaggaagaatcagtcttgattctaagaaagtttatagttgtgcttcatgccttccagggtttgaaatctatagatgttgtaaagtgggcagaattagattggatttgaacaactagagtaaaactaacctcattaacaaaacactttaatgtgtcacacaaatgtaattttataggaaatatttatatattttagatattttaaaatattaatttatctctagtcatcaaggaaatcctgagatatattctggcttttcttgggctcacctgggtacattcagattgtcaaaacattctcagatatcaagtgtgtcagcacaaacaaaaggaaagagtagagaatactttctttgaaaaatattccaaaagaatctagtttccagcatattatctaatgccaaccaaatgatttggcaagcctgagaacttggcaatatgccttaggggattggtagatagtggtacaggagtgagtataactatgtcaaactctaaagactgaaattgaattgtatttccagtgagggagagaacagttagttaaatttttgtatttaaggtttttaaaaattttctaaactaattaaaggattttgccttgactgcagtcttatttaatgaaactttgcatttttttttacatttccttagattgacttagactagttttcagtttttttaataagaaggattaaaaagtattctttcgtgtatcaaatgtgttaatcatgtcaaaagctcttgttttacttagtttgaggatggagtactaaacagaaacattacacaaacaagttgccagttattctcagatactggctagtcatgaaggatgagggcaacggtgagtggggaatgacgaatagtgatcctcactactgaggatcaggtagtgaaggatgagtggatccctgaattattttatgcttgactgaatgactgaatggatgaacatttgctgagctaggttcttgagacagaagtatgataaagtcatggcccctgctctgagagtctactgggggattatctagttgattagaaaataagccagttatactacagtgtggtataactgtataccaaccattatccaagcatggcataaatggttggtatgctgtgaaatggttggtatgctgtgaaaatagagaattggaaactgaatgagacgtttagttgaatttttagggaagttgctcacttgggaaagagtatcccaggcagaagtagagaacttaattaaacagcatggtttttgttgtttttgtttttggttttgtttgtttgtttgtttgtttttgaggcagaatctcactttgttgcccaggctgaagggcagtggcaccatcacagctcattgtagcctcaacctcccagtctcaggtgatcttcccacctcagcctccagagtagctgagaccacaggtgcatgccaccttgcccagctaattttgtatttttttgtagagacatttttgtggagacatttttttttttggttttttttttggttttatcatgttgcccaggctgagcatagatcttggaagtaggaagactacaccctctgtatagtggaggaaggggaggagtgacaggaagtgagcccagagggataggaaggggctagaataggaatggccttttgtgctaggataaggagcttcatattatcctgaaagctatcagggaacaaggaaagattttgagtaggaaacttatatgattagatttgcatttttagaaaggtgaatctggcagcaacttcagaagggattaaatgtgggaacagtgctgttgacaactagacaatctatgaaactgttgtaattagtaggtgagaagtgatggttctgaatgaaggcagggacagttgcaaaggaaaaagggggaaaatcaccttctaaagtggaagtagaatctgccttagctcagtgacaggtggggtgtaagtgatgatggaaaaaagaaattgaagataatttgtggctttctgattaaggccacaggtgttttgttgttgttgttgttcttgtttcctttttaaattgaggtgacatttaatttataaacaacataagattaaccatttgaactatataattcaatagtatttggtacatccacagtgttgtgtaactgtcacctttatcaagtctcaaaacattttcatcaccccaaaagaaagtggcaattcccagtttgcctctgccccagcccttggcacccaccaatatgctttctgtttctatgaatttacctattctgaatatttcatatgaatgaaatcatatactatgtgaccttgtatgtggcctctttcacttagcacgatttttaagatcatccatattataatacaaatcagtactttatttatatggctgaatgatatttcatgtatatatttaccacattttgtttgtttatctactgatggacatttgaggtgttttcaccttttggctattgtgaaagctcctgtgaacattagaacaggtagtgtcttactacccattttcaattattttggtaatatctaagagtggaagagtgactcataattccatgtttaattttttgagaaactgctatatatatatatagcacagcagctataccactttacactctcaccattgtatgagggatccagtttcttctcatcctcaccaacacttgttattttccatatttttgattgtagctatcctagtgggtgtgaagtggtatcttgtggctttgttttttgagacagagtctcactttgttgtccaggctggagtgcagtagtagcctcacactcctgggctcaagcgatccccctatctttgtctcctgaatagctgagactgcaggtgtataccactatgccccactaatttattttttattattattactatttttttgagacagagtctcgcttttgttgcccaggctggaatgcaatggcgtgatcttggctcactgcaacctccacctctcgggttccagtgattctcctgtctcaacctcctgagtagctgggactacaggcgcttgccaccacgcctggctaatttttttgtatttttagtagagatggggtttcgcaatgttggccaggctggtctcgaactcctgccctcaggtgatccacccgcctcggcctcccaaagtgctgggattacaggtgtgagccaccacacccggccaccccactgatttttttaaaaaagttttgtggagacagggtctccctatgttgtccaggctagtctcaaactcctggcctaagcaatagcctcccaaagtgctgggattatgggcgtgagccactacactggcctcttgtggctttgatttccatttccctaatggctagtgatgagcatctttcatgtgcttgtcagccatttgtatatcttcttaattccactcccaggtgtatacccaaaaggtcttttcaaattctttgcacattttttaattgagttgtgtttttgttgagttgtaagagttctttatgtattctagatacaagtctcttatacaattcacaaatattttctcccattctgtaggttatctttcattttgatgtacaaaaggtttaattttgatgaagttcaatttatctattcttttttgcttatatgtttggtattatatctgtctattgtcaagtccaaggttatgaatatacactctatgttttgctctaagaattttatagttttaactgttacatttagttcattggtatattttgagttgtatatgttaaggtgtccaacttaatttttttgcatatggatatccagttgtgccagcaccatttattaaaacagattattctttctcctttggatggtcttgacacccttttctgaaatcagttggttgtagatgtaggtgtttatatctagattctcagttttattccactggcctgtttttttttatgttgttgctacaaattacttcttttacgtggtgtcactgtcaacagatttatgattattgttttatgtagatgtcttttagttcataagggtaaaaaaagaagagttgcaaattaagaagtaaaatagtactgactttcatatttatctatacagttacctttaccagtattctttatttctttgtatggctttgtgttattatctagcatcctttcatttccacctgaaggacttctttagcatcacttgtagggcaggtctactagggagaatgtcttaatttctctctcatttttaaaagatagttttgtcagatatagaattaccgttagactgttttttttttttttttccttagcattttaaatatgtcaccctgctgctttctggcttacatacagtttctgctgagaaattggcttatcaaatttgggaagtttttggccattatttcttcaaataattctttccttttctgtctattctttccttctggaactctcattatgtgttgagagtgcttgatgttacctcacaggtcttttggcctccattcatttttcttcattctttctgctcctctagtttgataatttcaattggcctattttcagtttcactgtttctttcttctgcctactcagatctgctcttaaacctccctagtgcaattttcatttcagttattgtatttatcaattctagaatttctctttggttcctttttatactttctgtcttgttactgatattctgtatttgttgagacataattctcctggtttcctttagttccttgtccatgtttcctttaagctctttgagcatacttaagaaatctgatttaaagtctttgtctagtaagtccaatgtcaggaacagtttctgttaatttcttccatgatgggtcatattttcttttttctttgcatgctttgtaagtttttgaaaactggacattttattattgtaatgtgtgataatgctggaattcagattcttccccttcctcagatcctcagagtttgtttttgttgcttgtgtgggttgtaattgtttggtgactttctttttattttttattttttttgagatggggtctcgctgtgttgcccaggccgaaatgcagtggcacaattatggctcagtgcagccttgacctcccaggctcaagcagtactcctgcttcagcctcttaagtatctgggaccacaggtatgtgctaccatgcttggctaatctttttttttttttttttttttttttttttttgatacggagtcttggtctgtcacccaggctggagtgccgtggtgtgatctcggctcactgcaacctccacctcttgggttcaagcgattctcctgcctcagcctcccaagtacctgggattacacgtgcacaccactacgcctggctaatttttgtatttttagtagagacagggtttcaacatgttggccaggctagtctcaaactcctgacctcaagtgatccgcctgccttggcttcccaaagtgctgggattagaggtgtgagccaccatgcctgaccatgcttggctaatttttaaattgtttgtagagatgatgtcgtgctgtgttgcccaggctggtcttgaactcctggacgtaagcaatcttccctcctcaccctcccaaagtgctgggattacaggcatgagccactgcacctggccaacttttgtaagctatttttgtaaagactgtacctttgtcatgtatgatgtctgaagtgtctgtttgttagcttgtggttagcaattgttttgacagatggccttgaatacctggagcctcaccacccacctcaccactacttccaaaataaaaataaataaacaacaaaatgtattcttctaaaatttgctgattggctctgcactggggcactttttcaaagcttagacaggttatttacagtcctctcatagcctgcttgaactgagcctaaagatcagcaagatgtgaaagtttggggtcttctcaggtcttttctgaatatgcatcctaccacgggcatgcatatggctttctaaattccccagtaacacatggcagcttttcaatgcactaaatctccaaagaatctttcttcccaggctgcagcatatcttttgtgtgccttaacagtaatcttttgcttcaggtgacggtggtttgttcatttgcctttcaatgttttcaaagaatgccctctgtatagccacttttctgccttgagaaagtcttgagttaggtgaaagtaaggcaagtgtcttttgtcaggcctgaaggttgtccccagataagtcaaaacagacaaacacagttctttgaaaataagatctgctctgccttctgtagaactggagtcccacgctggaaatgtgggctgccattgtcaagattgtcactaaatcagggagggcattggggcaagggcaagtaaaaatgccaccaaaatttcatgtttcctctgtcttgagccactatttacttagttgctgtaaacctttgactattttccagcgttcagatgaagttaattctgatagtttcttctcatttttttgtttgtgtgtttttctggagggaagggccattggtactctgctgtctttgctgacattactcccgtgggtgatttttttgaagaataaatttgatagaagagtttctgagctagagagagagggatttgagttagcagatgccaagagctacaagggaggtatatctcttgagcagttttcaagggaaatattagaactcatatttatgtattttaagaagttttttttgtcatttgttatgggattcatgtaaaagaaatacataacttttaagtaaattattaggaaaaaaaacccctgtgaatctaataccaaacttaaagctaacacatcatagtaactttgaaacgatattgtattcctcccagccccatcctccaccattcctccagagataagtactagagtgatttttttttgtttggaggggggagcttatatttctgcgttttaaaacaaagcagactccaaagcagcttacctagatatgtacatatccctaaacaatgtgttgcttagttttgtcttatgctttatatggaatcctgtacagagtcttgtctgttttacatttttcactcagtattgatctaagagtgtcaatgtcgtgtatagctgtacagatggtctctaacttactatggttcaattcaagattttccaactttacaatggtgcaaaagcgatacacattcagtaaaaactgtacagccattctgttttttcactttgagtattcaataaattacatgagatattcaacactgttataaaataggttttgtgttagatgattttgcccaattgtaggctaatgtaaatgttctgagcacatttaaggtaggctaggctaagctatgatgttcagtaagctagctatttaactgtatttttgactgacagtatttttaacatatgatgggtttataagaatgtaaccccattgtagattaaggagcatctgtatgttgttcatttcatgaatgaatgaaacttagacgtgaatgtaccacaattgatctgctctctacttgatgggcatttagggttgtttccagtttttatgttttgtgaagatgaacaatgctagtatgaacatttttatgtgtgtgcttaagaagatatgtatagtgtttccactgaaatgaaataactgaatcacggaagatatacatgttcagctttacaagatgatatcgcattgttttctacaatgattgttccactttgctttcctaccatcaatacataaaaaaccccactgattattgttttcctaacatttgatattgtcgggctgcttcaattttgctgatataatgcttgtaaatattagttcattgtggttttaatttcaagctaagcatgttatttatatctgttaaactgttcatatttccttttccgtaaattcattttctcaattttctattggatttttttggattgtacttatttacggaagctctttatgtattctggatactaatcttttcttttttcttttttttttttttttgagacggagtctcgctttgcctcccaggctggagtgcagtggcgcgatctcggctcactgcaagcgccgcctgccgggttcatgccgttctcctgcctcagcttcccgagtagctgggactacaggtgcctaccactacgtccagctaatttttttgtatttttaatagagacagggtttcaccatgttagccaggatggtctcgatctcctgaccttgtgatccacccgccttggcctcccaaagtgctgggattacaggcgtgagccactgcgcccggcctctggatactaatcttcaggttacatatattgtcgacattattgcctcatttgtggtatgccttttcacattctctgtgatgtcctttgttagttttgtttttttgagacggagtcttgctctgtcgcccaggctggagtgcagtggcaccatcttggctcactgcaacctctgcctcctgagttcaaatgattcttcgtgcctcagcctcccaagtggctgggaccacaggcatgtgccaccaggcctggctaattgtgatatcctttgaacagaagttcttaactttaatgtagtcaaatttatgaatatatacatatatatgtatatatattttttttaatgagacggagtttcattttttttaatgagacggagtttcactccagccttgttgcccaggctggagtgcagtggcgtaatcttggctcaccgcaacctccacctcccaggttcaagtgattctcctgcctcagcctcccgagtagctgggattacaggcatgcaccaccatgcctggctaattttgtatttttagtagagacggggtttctccatattggtcaggctggtctcgaactcccgacctcagatgatctgcccgcctcggtctctcagagtgctgggattacaggcgtgaactactatgcccagcctatatattctttatagttagcaattcttgggtttaagacatcttttattacctcaatgtcatcaagagagtttcctataatttcttctaaaatattgatttttttggttgaacatttatatctttaattattcagaattatttttaaaaattgaaatatagcatacagagaggaaaatgtacaaatcatatcacttgatgaattattacaaagtaatgggtatgtaacctccatctacatgaaaaaaaaaaaaaaaacttagcattctctcaaatgacctgctaagtactattcttctccctagcgatacctcctctacagacctctaacactatcagttagttttggccattttgaaatttatataaatgaaattatatactatatattcttttgtttcttatcttccgtgttcaatactatgtgagattcattcatgttgagcttaatagaagtttgttcattttcatagatatatactatttgtacaagtatgccacattttatttctctattctgttgatagatatttgggttttttccatctgggggctagtacacctttgcatctctgttggggatatttgtaggaatggaactgctggtaggtttgtgtatgttcgtcttgagtagatactgccacatttccaaagtggttgtacctgttttcactcctagctgtgtctgtgaatgttccagctgttccacattccatccatctcttaggtttaacccctgtcagtctttgaaattttggccatcttggtggtgtgtagtggtacctcattgtggttttaaattgcatttcccttattgctgttgagattgagcatagatctatcaataggcagacagactatttggatatattattttataaaatgcctgttaaagtctcttgcctatttttcttttttatttatgtaatttatttttattttttaaaattctttatagagatgaggtcttgctatgttgcccaggctggtctggaattcctggcctgaaacaatcctcccacctcggcctcccaaagtgctggaattataggcatgagccagtgttctcagccttgcctatttttctagtggtttatttgtcttttttttttattattgattttaggacttgtcttaatatttataaaatgagctctttgatgtttaacaaatatctcttctctccatgtgacttaaatttttgttctcttattgatgtcttttaataatcataaattcctaattttgatgtagtttactttgttcagcttttcctttatagttaatgtttttgtatcctgtttaaaaaatctttgcctattcccaaaatattctcctatttatcttctaggaacagttttacctttcacagttagagctataattcttctgatttttttttttttttttgcatgaaatgaggtaaggctcaaaagtaattttttccccatgtggatacctaattgactcagcaccaatatttgaaaagactttctctttttttgcagtgctgcttttgtcataaatccatatatttagggttaatttcatttctgcaatctattcttttaatggaatattgctttgctgaaaagttttggtatctgggaaggtctcttcactttcttcttctttaagatgccatggctattgtggggtcttccatacaaattttatggttcctcataaaactcttttgggattttggtgaataccattggatttaagaatactgctgaatctacagatgaatttggggattttcgatattgaatttctctgtttatttcagtctctttaatatagttcaataaaattctgtgtatcctttgttaaattctaggtgttttatatttttgtttcttttgtcaatggtatctttttgaaaattacattttctaagtgttgatatatgcagaatgcaattagccattttgctaaaccttcttattgattctaacagattctttatatattattttgtttttctgtgtagataaccatagcatctgagaataatgacagctttgttttttcttttccaatattggttcgttctgttcttttttcttgttttactaactgattaggatagcactatccaatggaaatgcaacgttagccttatgcgtaatttaaaaatggctggtagtcacagtggaaaaaaagcaaaaaacaggtgaagttagttttaataatttgctttattttatttaactcaaaattgtcatttcaatatgtaatcattataaaattaatgagatattttacttttgggggggtactaaatcttaaaaagctggtgtgtattttgcacttacagcacatctcagtttggactagctgtatttccaggcctcatagctgtgtgtgtatggctagtagctattgtattagacaatgcaggacttcagttaccagtagagtgctgatactgcacgtacttgttactcattttgaaacaaatacttctgacatttgaccattaagaaggatgtgttctgtagattttggtagatatcttttatgttattaaagaagtttctttttttttcttttgagacagagtcttgatctgttgcccaggctggagtgcagtggtatgatctcaactcactgcaacctccacctcccaagctcaagcaactctcatgccttagcctcccaaataactgggattacaggcgtgcaccaccacgcccagctaatttttgtatttttagtagagtgggggtattgccacgttggccagggctggtctcaaactcctggcctgaagtgatccgcctgccttggcctcccaaagtgctgggattacaggtgtgagctaatgcgactagccaagaagtgtttttgtacttttagtgtactgtgttttcttcttaacaagaaatttatttatcttttttttttaacctcttgaagtgatctttcttgattttctaatggtaagctactcttgtattgctgggataaactcagtttggtcctgatacctctttattcactactagatttgttttaattttgtttttaagaatttttacattgttcataaaaggaatggctggtaatttctttttcttttctttttttttttttttttttttttttttttgagatggagtcttgctctgttgcccaggctggagtgcagtggcacgatcgcggctcactgcaacctccacctcccaggttcaagtgattctcctgccttagcctccccagtagctggggttacaggtgtgcatcaccacgcccagctaatttttgtatttttagtagagacagggttttgccatgttggacaggctggtcttgaactcctgacctcaggtgatccacctgccttggcctcccaaagtgctgggattacaggcgtgagccaccacacctggccagtaatttctttttttaactatgcttttctgattttggtttaaaggttttactagcctcttaaaataagctggagagtaaataattttatatatatgtaaaatctctagaaaagtttttatacaagagtttcatcttctgttacttggcagtttggtagatggtagaaactttgcatttaaaaccttataggtattttttttttacatttcctaagtttataatcctctaccttattgtaagcatttacaataatataagcatttaagctatacaattccttctgactacttcatagcatattttagaaatctgcatttctttttcattctaagtgtcttaagtttctattaagatttattttttgatccacatattatttaaagtgttttgaaattatccagtgtgggtgcttttatgctttgtcattttgttagtgaattacacattaattaattgcatagtgttcagcaaacgtggttgtatgaactgattcttttaaatgtatttggtcttgctgtatggtttagcacatcaacagtttatatagattgtccatgtatgcctgtaattctttaattttgaggctgaggattctctatgtgtccattcagtcaagtttttaaattgctttaattagatctttagtatcttaactaattttatctgctagacctaacagtaatatagagattatttgatacttccttagagttctagcaaatttttctttgtctgtttatctatattcagtgcatgtaagtttagaattcttatatcttcctggtgcattgaagcctgttatgtcacgattctctttaaccctaatgatgcattttgcttagatttattttgtcttatttaacaaggttattccacctttctttggttaatattgccagtggtatctttttctacttccacttttcatcttttagcatttgcatgcccttatattttagtgtgtttcttgtaaatatcatatagtggattgtttttttgtgggggtgacatttaaaatctttggtgagtcttgtctgtttatatttattgtgattatggatctgaatttctttattccatccctgttcttctgtttgtcctgctttttctatgctttgccctccattcttgccttatttttttagattaagatttttgctttggattatttacattttctttttcgccttttctggttggggagctatgtattaatgttcctttagtttatacttttgtctaatccatctaacaaaatctaaaattattccatatttaaaaacccatcccccttgaaaaaatacagaagccttacaacagtttaacactaattaccctaaccttcccctactacctacaatttatttgatactcttatccataattttaactttaaataattctacaaatttgacagtattttatataggtaatgtttgtttagattggcccacaggtttaccagtttctttgcctactgttctttcttgtaactcagacctttctaatggagtatttttcttcttcctaaataatattttttgtgaattcctttagtgaatgtcaaatggtggtaaacttttatgcttatctgaaaaatgcctttattttattctagttctacaaatatctgagtacccatttccaggttattctaggcatctgttctctctgaactagtaggacatttttgaaatgtctttctaattagaaaggtaatctagaggtctaatatttgttatgtatgggattaatttaaaaatcttactaaaaacacttttaataaccttgtacaaagtttgtgttatactgaaagaattgctatacaattaaagactgaaatatgactaaaagaactttccatatatatatcttggtgattgcttttagattcatagctggagtcactatttatagggcctattgcttatggctttgagtttcatttacttatactaagcactcatttttcagaaaacttgtactttattagttcttggtgatggggggcagcatgcattctattctttaaaactcttattttctaactattgtcttgattggagtcagcttaagtggatatgtactattattgctgcctgctccttattgcttctataatatggtaaaagaaagaggatggactccaatatttattgactctttatgtactactcatcttacatactctacatatctattctttttcagttctcactacatataatcccactttactttcattttgtaaatgaggaaatcgaatttgaaagttaagtgacttcctgagttatagtatacaagtgttgggactaggagtcaaaacacagatgctcatgtattttctacaattccagtgttatcagttaaaatatcttctggtaatcagtcctttatatgcagcccagtaagcagaagggatacccacctgtgtggcttgaggttcgatgtgggaaagagcccatcagctaatgatactgctgtactattattctgtggtgctgcatatgtactattattctgtggtgtggcctatacttagatttacttctagggtttgcgttgggccataaattgttaaatatgtttatcatgaatattagttgtacctttaacaatttccatcatttcctgccttctccaaccgcatctcccattctagactaacatgataataatacacagctatgcatttttccgcttccagactaattaaagtaacgtatgtttctgtgctcacattcagagacattatttacctctgaattgagaagcactattatttataaagtatataggatgggctagtatgggaagggaggaaggactgtgttcccttgcttgtcaacaagaaattagtatattcttcatagccttaaagggttttacagtaagaaatggaaatcttgttactgtagagactagagatttttgagggattttttttagcattcccatagttgaactgtaggcataatttcaaactcttaggctactcaaacctcaaaacgttcagatactatttgttttgagggttttttaaaacctgttcctacttttttcagtttcaaactttgtgatagtatgtatgtctgttttatttgttagcaaattttgtagctttttaatctatgtttaagtaatgcttttaaaaagggccaagattcgtgtataagatacctatgtgttcagcttaagcaaaattaggttagaaatgaaattatatgaatcaaattgtacctaatttaagagccctggttgcattcataaaaataatctagaaggctaaatggaccattttttaatgaaaaggatacgttgtattagcgccatctactgttaggtcagaataattacttcttggtgtacgtttggatttttcccaatggcatattccaagtccagcatctttctgcatgtcctttaacttaattgaccagtctgtagaatgtgggcgttttaagctattcaaataatatcctgtctatgttcagggtcagccaatttttgtagatcttgtttcataattctttttttttttttttttgagacggagtctcgctctgtcgcccaggctggagtgcagtggcgcgatctccgctcactgcaagctccgcctcccgggttcacgccattctcctgcctcagcctattgctgggactacaggcgcctgctaccacgcccggctaatttttttatttattttttgtatttgtagtagagacggcgtttcactgtgttagccaggatggtctcgatctcctgacctcatgatccgtctgcctcggcctcccaacatgctgggattacaggcttgagccaccgcacccggcccataattcttgttaaagtagcaatggcaaatttcctacaattttcttgatagttcatgattttaaaataaagctagctgattgtgctagctttctacaaagcatccttgttttaaaatttgctaattgataattgttataaagactgggatattaaaattgaacatccaatttgtagctgaaagactgtctagagaaagctgtatctcaatatgttgcttgttaattcactgaatgtctaactctgcatcgtacattattaagtgtattcgtaatttaggggaaaacctatatctaaataatgtagttacttttttaaaatttcttaatgtaaagaatattacaaaaatagctttatataatgtactgattaggaatataagctttaaagttagattctctgagtttaaataccggctttagcacttgttgcatttatgatcttgggataattgtgaagcataaatatctttctaaagcacttggaataacatctggcatattagtaagcactcaataaatgttagttgctatcattaatattttaatcaatgtttacatatccaaagtaaacataatgtttcaataactatatttttatcttagtaactaataacttttttggtaatgaaacctataatatttgacataaaatatgtaacttaagaatataaatgttcaaaatgtttactgtttgtttctgcatatcatttagagtaaagggtagtatggtagagcagaaacaacaaagttgagtcttcagtctcagctctgtcagttactagcagtgtaacttgaggttatttaacctctctactgagttttttgttttgttttgttttgagatggagtctcactctgttgcccaggctggagtgcagtggcgtgatctcggctcactgcagcccctgcctcccaggttcaagcgatcctctggcctcagcttcctgaggtactgggattacaggtgtgtgccaccatgcctggctaatttttttttgtatttttagtagagatggggttttgccatgtgggccagactggtctcgaactcctgacctcaggtgatccacttgcctcagcctcccgaagtgcctggattacaggcgtgagccactgcacctggctaacctctctaaagctcaatctcttcacctgaaaatgagttgttttgaggattaaattatataatgtatgtataaagtcattcttggcacttagtagactaacagcatagatgtcaattcttttataacatactgcaaatttactaacatgcacgtgtttccataattttgctttatattacttatatgaaaataaaaatatattaagcaccctttatatttgaaaagctgatggagtttgagaaggaacaaagaaattgtgacatcttaagaagtataattgaggatggaatagaaacgtgaagagttttaactgggaataatggttcagtcagtaatatttgtatgtgattgctaaatatacagaattttttttaattcaaaggaggaatactttctacattggacctagattgcatgtcccccaccgactttgttattattgctataattttttggtagtatggcccattgcacattctaggaggacataaagaggatgaaatccacttgtggattattagaagtatttgttgatttcatgttatctgccagcatcatggaccacgactgtagatatatccagccttcagggtgggtggagttaggtgggctctgttggtaaatgatcagcaccgagtattgttcctgagcatagtagatgcttgtaaatatttgaatgaacaaatgaaagtgtctgtatcacagttattacactgactgaggctagtgttctcatcacacgctaatttaaatttctatgtcaaatggtaaatagctcattccttcctgtgttctctgggactttgctttatcaggatatatcatctcttgtttaatcttttccactttattgacaacctaagtgaaccagaaccacccacccctcaccagttacctgtcttcctcattttacccattcatctacactgctgtggtgtggctgttcctttttccttaccacctcccaccccaagctttttctgcagatgtcaccaatgacttcctaactgcgaagtctcaagccccgaggatcccatttccatccttcttgtctcatttgatctctctgtatctttggcattgctgcctgttacttcctgaagttctcctctgttggctccagtgcaccagtctcttctggttctccttctgtctcttggccttctccttttcagtctcatttactatttgtttggcttctctccccagctctcttaaacgttggtgtttccctaggttctgttgcttggcctcccttctttttatagtaggttttctttgtactccagcgacccaatttatctgtggaacccaattcagccgctcataacacaaggggaagagggtgtaggcagcagccccccataatctctatgacctgttacacatgaaagcttcactgagtaagcatacaatctatgtaaaacaaccaaaaaacaaacatttatgtaaaaggagtgtggttagtatggaaacttggcctcaagaagtgtctcctaacccctgtccctggactcctttgtagaaattctagagttgtctggagtgtcttcaatttccctgtgaacatatctacttggatgtctcctccaaacagcctcttatttattcctgttttcacataatccacccctcctgtattctctcacagctactagtaccaacatgtactctaccttaagcccaaaccctgcatcatcctaaattctactttattctcaacagctggtcctgggatcgctgctgccttcatctctcatctgtgagagaatttcctatattataattatttgattcatgtctatttctttcattagaatctttatgtcccaggcacctacaatttttatagtattaagtgttcaactaatacttttatatgtaaaaatgaatttatcagcaatcactaattcccaaggaattaatagcattaccctgttgtcttaaaaaaatgccaaaaccataagaaaattgattttccaatcttaattttttaatgttaatgaatgttaaattcatgctatattaaaatgaaatacttttaagatctttgtcttttacagttgctcaatttaaaggaaagttttttcaggtgctgttgataacattttggaacttgtacacatcttatacattcaatttaaaaaaaagatccaaacttatcagtcttgttattaacactatttttcaaatttaatatttctcagtatttattcattgaatgctctcaaatggtggcttaatagtttcatgtttgttaaatacagagctgtgtcttccatctgctatttttgaaataaaattttcatacagcagtccttgatagggccagcctagaatcatagactttttccattttagtcctaaataaataataggatggcatgctgtagattctgaatagtaacaacttatttacctgatttttcattggtttgagtatttgatacacagaaattgaagcttaaacttttatctaatcttgttttaaccttctgagaagactgtgtgtccttagtgactcagatttagcatacaggtgatgagttgtctcatttggtggccagtacttactttttgtcttattaggttgaaagctatctcttcttgagaatgctggtgtatgtggctggtaacagcttgccatttttgtttagttgcttttactttcctgaaacccaggaagccagataattaagttttaaggattatacgatatacaagtcaataattttctaacaagatcttaaaagcacagtatattgctttggtacagtggctttatgagagctttttgaactgtttagagtaggggtgtccaatcttttggtttccctgggccacgctggaagaagaattgtcttgggccgcacgtaaaatacactaacactaatgatagctggtgagctaaaaaaaaaaaaaaaaaaatcacagaaagatctcatactgttttaagaaagttcacgagttaggccgcattcaaagctgtcctgggccatgcccgtgggttgggcaagcttggtgtagaggttggttttcattcttcaagtttctagactgtgtgctaaaggttagggttgctgattctagatacacagatgcattttccattcatagataacctagttctggtgttttttagtatcagtcactcttgtgtagtttatttcattggatctgctcctagggccatctaggaccaagtaagagggcttaatattttttattcagtaatattcagagacctataatctttgatgatacaggatagagagcctgactgaaaagctacacacatacacaaacacacacgtaaacatacacacatacataaatacacacacacacacacacactacctgtgtgtttgtttatatatcagacatagcaaaaattcattaatctcgtttcttttggttcactgccagaaatccctacctagtgctgtttgacaattagtgtccatgtctgcatactgggctctcttgctgggtggcgtccatagtaggaaaactagataccgtggtagagtgtggtaaacaaactaatcatgagttttccataaatagtttgatggtggcttatgttttggaatgtggtgtaaatttactatcattggctcattttaattatgtaaagaattgctatgcatgaaaaatgtgaaaaaattcaaataccccattattttacccttcccccccagattttgagcttcctatttattttattctttgtagagacaataaagcatatacactctggcatcagactgccaggttccaagcctgacaaaaaattattaatttatgcctatgaacttgggcatgttatttagtctttctgtgtctcagtttttctgcctataaaatggtaaaacaaagttagagttatcatgaggattacatgaggtaatatacgtataaagtacttagtgtgtggagttcaatattagtaatattattctacatgtattttttctgtataaaacatacagaaatgtaagtaaattttaaatgtgagtaaattttaatatttcttgtaacttaaggcttgcagaattttctggcatctctaagagaatgttgtgatttaactgtttaagtaatttaaaaatagttctgcttttaaattttctcctagttttcccaaggaatctatagacattattttacttattattattattatacttattattttactatttgctttttatataaggactttactttaaaatagtgttaatacttctgtgttcttcatggtctcttcttctgtctcttaaggaatggtatttaaatctattagcaggctgggcgcagtggctcacgcctgtaatcccagcactttgggaggctgaggcgggcagatcactaggtcaggagtttgagaccagcctggccaccaaggtgaaatcctgtctctactaaaaatacaaaaattagccaggcgtggtggcacccgcctgtaagcccaactactcaggaggccgaggcaggagaatcacttgagcccaggaggcggaggttgcagtgagccgagatcatgcccactgcactccagcctgggcgacagagcaagactccgtctcaaaaaaaaaaaaaaaaaaaaatctatgagcacatttgatagggagacctcacttgatctaagggttcatgcaaggctcacttcaggaaggaacttcctgagatccaaagagtgatcagagttataaactagaaaaggtgtaccatggaaggacatgcctttcaggcagaattagacgtttaaatgcccagaaatgaaagggagccattattatatataaataatatatattgtttcaggaaaaataatggattcttatttttgcagtgattgtattttattgttaaatatattccatctgggaagatccatgcaacaatctttaaatttttaaaatcaatcagtgactaggatagtctaatatagtcttagtaaaatgtttgtgtttgagaaaatataggtcaggttggccaggcatggtggctcacgcctgcagtcccagcactttgggaggccaaggcgggtggatcacttgaggccaggagttggagaccagcctggccaacatggtgaaaccccgtctctactaaaaatacaaaaattagccagctacttggcaggctgaggcacgaaaatcatttgaacctgggaggtggaggttgcagttagccaagatcgtgccactggacctccagcctgggcgacagagcaaaactctgctcaaaataaaacaaacaaacaaacaaaaaacaggccaggtgtggcaactcgtgcctgtaatcccagcactttgggaggctgaggcaggaggattgcttgagaccaggggttttgagaccagcctgggcaacatatcaagacccccatctctacaaaaaattaaaaaattggtggcatgcacctgtagtcccagctacttgggctgctgaggcaggaggatcacatgagcccaggaggttgaggctgcagtgagccatgatcatgccactgcactccagcctgagtgacacagcaagaccctgtctctaaaagaaaaagaaaatataaaaagaaatttgatttttaatgtagattgtaattactaactatagaaaacagccatcataaaatttccctttgactcataattgtctatgatttttaaattaaaggttgacttcaagtataagatttatttttcataattcaagtgtcagatcatgcagtttatgggcactcttgataactttctttttttaaaatagagcacatcatccctgtttttgtatattgatattttttattagataataatcaacaaaaagaaaaaaatcacttcattattctgtttatttcaagttacaaataatttatataattgttgactgatacagtattaatgattctgttttataataaacataatgtatttttatatttaaattcctggacacaacacaagtttccctacagtttgtatatagcttatataactattaaagtagaaagttggatagactgggagtaatacttaatttatgtatatgtcaataatcacatctcagctaatatttgaaaactccatatcccttaagatgtaaacagttttcattagaatattagtttttattaattataatccatgtagcccccacctaatgtgggataccagtgcctcttccaaatattttttggagtccccagagtatattatatggttcatgcagagctctgggtgtcaaccacatggcattaattttaatttttttcttctggccatgtactaaggttttgtcattttcactggagactgccacttttgttgggctttgttgttgatctttcctttggccattgcagggactggctgagctgggtcacttagtgctttgtaggactttttggtggagctatctagtctgggagttttatttgaggaaatatttttcactattatattgatttaattttatatgatggcaatataggactattcagactttatatctctttgtttcagtaagttatattttttctatttgaccatttaatctatatctcttaaattatggttacatatttttttcgttcctgatactgcttatttctgccttctctttttttcttgattaaattatactggcggcttgctggtttatggtctttttcatacagccaatttttggttttgttgatcttctaatatatgcttgttttctattttaacagtttttgctgttgtctttatctcctttcttgaatttttttttttttttgcttttgtttgttttacctccctctcctgaccctcccaccctgccagtttccttgaaatccttatcccaataatctttaggctttattctaatgttcaagactatacatttcccctaagtgctactttagatgcatcctgcagttttaatatatgctacatttgtcattgttcatttcattcttataatttaaaactacttttgtgatgttggaccctttggattatcttttttctactacaaaatttttttaattttctcaagtttatttttttaaggagatccaacttgtatatttacttactaattacatacattttccgtctcataattaataccattctgcttttattcctttcacttgtttttttggttggttttatcagtctcttgtctaccttctggaacaacattgcagactgtttaaataatagaaaaacaaagaattgtagatttctttttgtttcccgccccttccccacctctgctccaataagatagtatatttctagggctagagtagaatatctaagatataaattgcaggaagtacaatgaggccttattgtactgggaatgaaaaagttgtcagatatctcgtttctacatttctgaggcttcttgatacctgcttgcctgggttttggtttacttgtctggttagtttttcttccctttcctctccctccctccttttactctcctcccgtcctccttcccctacctccctttcttcatctcctctccctccttcttccctccattcttatttttaacccttccttcatcctttctcttcctcttctccttccttccattcttgcatccttattgttttttcacctctgacataagtgtgtcaaaagtggggaaaaccctcactagattttcctgattttgggatcaagacgaaatgatctgtagaggtcttatgttattaacttgttgcactctaagaaaacctaaagaaaatcacccatgccttttaaaatgcttgaaacataacaaatcactatattcatagtatttttgttctctttgaagtaatgagtcatcataaataaattggaccactgcccctttaagtagaaactgccttaggggacagatggaattttgggactacttcctgaagcacttgtttgtccaccaggagtgtcagttgggcctgggtgggaagagaggcccaagaaagccaccatagtctgtagcgtgaagcttttcctatagtctagtgataatcctgctgtgagtacctcactgtaattcaaataattgtggaaggaattgtctctcagttgtcctaagtcctgcctagtaccttgaaaagcagttggtttctaaatactcagcttggagggtgaaataaggttcagttcagccattttagttctttgctttgtttttcccagctggaaaaattttaaagctattttaaaaatcacttggaggattatttggagatcatgatagaaattttttactggttaactgagatgaattgtatagtccttttttagcttaagatctttaaacatttagttgcataacagctttttaatttgttggactcctcagttgaagccattacaaattggcttaaaattgtaaaagattgagtattatattgagcctttctatcagaaaacattagcttaattagtctataattaaagatgatgttagctgtactttagtttgtcttaggaatagaggtcctcaaattatatgtaaaccatcagttgcatggttcttttgaaatgtggatttttgtgaatgcttaataaagctggcctgactagcttaatttaaaaatatatacatctatgctaaatatatacacacacacacacacacacatatatactgcttctactgtttgtataacttaaactgatttgcatgctgacaaaagtactcatccaattgtacagttttatttttatttatttatttattttttatttttagagtcaggggtcttgctctgtcgcccaggctggagtccagtggcatgatcttggttcactgcaacctcgacctcctgggctcaagagatcctcctgcctcagccttccaagtagctgggactacaggtgtgtgccaccatgcccagctaatttttgtattttttgtagagatgggttttcaccatgttgctcaggctggtctcaaactcctgacctcaagtgatccacctgcgttggcctcccaacgtgctgggattacaggcctgtgccgttgtgcctggcctccagttgtatagttttaaatgaatgtaaaatacttgagtgattggtagatttaatattatttaataaatttaatattttaaatctaaaaatgcattaatcagtttgaataaaagatgtacattgggtctgcaattccgttttaaaaagaggaattcccctgcacaagctctctctctttgcctactgccatctatgtaagacgtgacttgctcttccttgccttccgtcataattgggcttccctggccacgtggaactgcaagtccaagtaaatctctttcttttttaaattgcccaatctcaggtctttatccacagcatgaaaatggactactgcagttgtacaattagatgtggagcttattttgagaagaatttgagggatagaaggaatgttcaaaaatatatacctcaaaacaaagaaaattgcctttccttgaagattaggtcatggctcactgcagtctcaacctcccaggctcaggcaaaggcagtcctcccacctcagcctccagggtagctgggtctacaggcacatgccaccacaaccggttaattgtatagccagggtttcaccattttgtccagggtggtctcaaattcccggactcaagtgatctgcccacctcagcctcccacaatattggggttacaggcgaggactatgctttttcatgtttccgttttagggacctggtacacatagcaggtcctcatatgtttgttgagtgagtgagtgggtgagaggggagacagaaatcagatatgtcaatggttgagagtgtctgaaggattgataccagtgtgcaaagtaaaacatgctgtctcatatgaaaaaaaaggaacagttctcaagttgtgagacaaaagagatgaccagtatttgttaaatagaagaattcaaaggatgctgtataacagaaaaatgccacagtttatctttgcatttgtgacccctctttattccaggggtcacattctaagactccccatggatgcctgcaactgaggataggatcaaaaccaatattcagtatgttttttccctatacatacatacctctgataaagcttaatttataaattaggcacagtaagagattaacaacaacagtaatagaacaattataacaatatgccagcattactactcttgcactttggggctatgaagtaaaataagggttacttgaatcctccaatcactttgacacgctgacagtggatctgataactgagacagttactgggtgactaatgggcaagtagtgtatacaatgtggatctgctggacaaagggaggatttcagcacataatttaacatttatgacttatttctggaattttccacttaatatttttggagtataggtaactaaaattatggaaagtgaaaccacagataagggaggactcctgtaattggtagtttatattttcacaggataagctttcaatattttatttgtcaaaggagacttagtcatcacttaacaattttctaaaagtaattattgtagatgatgctctgaaactgccagtggttctgtattttaattcactgttttagaactattctcttatacgtcaatatgatgttaagaaacttaagtctatttaggttcattgaagagtctgaacaatctaaaaattataagtttagtaaagatatagaaatttaccatacttaatctctacttgtagttaaaaattgatcaagcaatgctatctagtaagttttgcagttctatttatttaacattccggctatttaactgtcagaaaggaaagtgtgatggtaagagtttatcaagagatccaagtgctacacaattgcatttccacatcttatgttggaagagataatttagttttgacctgagaaataatttcatttcaaacaaatttcagtgcattttagctaatgtcagcatgagtatttaatattttaaaataactttatcttgattaatattttttcaaataagcacattttttaaaattagaaaatttatggtaaagtatgaagtacttttgaacaggtaccacaaggtggcaggattgtattttgtagattctttttgctttgatgaacagcaaaccattggttatctaaaatctaagttttccagatagttggctattacacactttatatgccagaacttttaaattttaacttttttgatggaaaactaaactatatttcacatttcctgatttcttaagcagtagaatataacttatctgttgtcagtgagccatttgaatgtattattggatgtgattaagatggagtggtcagtaacagtagtgtggagggaataaggactggtcccagcagagactctggaccgtgactcttaaaagctgggtctgacgtcaacttgctttttgctttatctgcatttttttcctattggaggtgaagtgaatcatgtgaagtgccagcctctggtgtggtacaacatggctgctttcctgcaaaattaaatagcaaatgaaggcagacattgccttctcccagcggcttttgtgacacagggtatttgggggaaggaaaataaactatgaggccttaaaatttcttcttcaaacaccagtatcgtaaaggtagcaccagaccatgaggaatgagttctgtagttatgagaaatattagaaacaaatctaactgctcatggagcaactttaaggaatctttcctataaaaatattttagactctgagttgtacatcatttgtatgaatgagataataataattataaaggatgtggccagacgcgaatctattttcctttcgaatccaattacctgctctggtaattggagagctgtttcaaggcagtttatgcctttattggtgatacaacaagcagtgggtaaaatcttcatcctttggacttcttggtttgctcattagtggatactgtgtttccctttccacaggcttccaggtctggagttgttctgcgaacctgttataaaagatttgactagggggaagttttctttcatatttgttcccttcattaattacttgcatatttttctaatcttttaaaagatgaatcagtttaacatcacataagcactaagaaagcaacagttgagccctaccttaaggggagaggagagggcatggtttccagcagcaatcctttctctggctctctaaaatgtttatctacctgtcactttcttactcatatggattttgcatgatggctgcataaatcatcatatttcccccctcatcttaaattcagtcctcaaggggtaatggagaacttttataagagctccagagaagccacaggaaataactgataaattagctccacctgaaatggatattagggcatcgtcaattgactcttctcagttctgcttggtagtagaacttttttttaaacttcatagtagacgagtaagtggaactttcatgacttaaatagatagataaatttcactagcttgtacttctaggattgggtacattttcctcttggcatggtactatgtgttttcaagtaaaaataatacaattcaagtctgacaaactggctcagtgaattatacaagattcgtgctttaaaacacagtctacaccctccctgttgctttggggcagagtttttgagtaattggacatctaaaactaactctgaacttcaagattaccagaaagatcagatgcaagagcttaatttgtgttaagaacatcctcctacatattctgccaaaagtttaagagctattagtaaaagcagctcatttgaagtagtatgagatttgaacatttaactccaagatagctagaattttattaaaacggatttaaagaattagcccacaatttaaatacttttctcattttaaatgtggcttaagatgtatttgtctttatgaaggaattttggattaaaaactgtactgtagttgaatttaggaaagggaagccggagatgggtaggcggtgggtacttatagatcttgaatgcctggttataaagattgggggcttaccctgtaggtaccctgtaatcattaacagacttgtaattgcatgggtgacaggcaggaaatgttttaagaaaattagcctgaaagcgcagggtgcatttgcttggatccagctggagagagattggagccagatggaccagttgagatgatatggcaatcaataatctggaagttttatgatataaatctgaattagtgtgatgtcagtaggaatacagaaagaatttaaaagcctttaagatattattagggcagaattgataaaacatagcaacttgctaggtgaggttaagaaaaaactatgttatataaaatttctatttttgttagaaacagcaaacttagacataagccagtcttctacaggaaaactatttctgtgcatttagcatattataaattcttcataataaagatgataatatttcttgatataaagaccagtaataggagatactgttgattttgtgtctgatttcaaagagtgaaatggctaaagcgacttgaacattcccatagtatagcggttcccaaatgctggattaaataccagctacctcaaaaaattacttggtttgttgcaggtggaaggtatcttaaataatgcagaatgtcatggttaggagcacagactgttttgaaacctggatccatctactatgggcaagttacttctctgtgtcccaggtgactgttagggttgttacaggaacgaaataagatgatacatacaaagtgcttagaaaattgcctagcatattgtaaatgctgaataaatggtagcagcttttttaaaaaaaaaattcaatagctttaggggtacaagtggtttttggttacatagatgaattgtacagtggtgaagtctgggcttttagtgtacccatcacccgaatagtgtacattgtacccaacaggtgattttctatccctcaccccctttctacctaccccacttctgagtctccagtgtccgttatacaactctgtatgcctttgcatacccatggcttagctcatgtttataggtgagaacatttggtatttggttttccattcctgagttgagtttgctttgaatgatggcctccagttctgtccaagttgctgcaaaagatattattttgttcttatatggctgttctttttattccattgtgtgtgtgtgtgtgtgtgcgcgtgtgtgtataggttgatcccatatttttgcaattgtgaattatgctgtgataacatatgagtgctagtgtcttttttatataatgactcttttccttttggtaaatacccagtagtgggattgctggattgaatgatagatcttcttttagttttctgagaaatctccatactgttttctacagaggttgtaccaatttcccaccaacagtgtataaatgttcccttttcactgtatctgtgccagcatccattgttttttgactttaaacaatggccattctccctggggcaaggtggtatctcattgtggtggttttgatttgcatttccctgatgattagtgatgttgagcattttttccatatgtttcttggccatttgtatatcttcttttgagaaatatctattcatatcctttgctcactttttaacggagttatttttttttcttgctgatttgtttgagttccttgtagattatggagattattcctctgtcaggtgtatagtttgcaaatattttctcccattctgtagtttgtctgtttactctgttatttcttttgctgtgcagaagcttttagtttaagtaagtcccatttatttatttttgtttttgttacacttgcttttgggatcttagtgataaattatttgctaaggctagtgtccagaaagtgtgtcctgggttttcttctagaatatttatggtttcacgtcaggtatccatgtccttaatctatctcaagttaatttttatatatggtgagagacagggagggatccagtttcattcttcatagcagctatttttttttgtttttttgtttattttgagaaggagtcttgctctgttgcccaggctggagtacagtggcgtgatcttggctgactgcaacctccacctcccgtgttcaagcaattctcctgcctcagtctccgggtagctgggactacaggtgtgcaccaccatgcctggctaatttttgtatttttagtagaaatggggtttcgctttgttggccaggctggtctcaaactcctgacctcaagtgatctgcccacctcggcctcccaaagtgctgggattacaggcttgagccaccatgcccggccatagcagttattgttgctaatttattattttatatctctggagattctaattcataaggtttgacattgggctcaggaatctatatattgttttcttttttttttctttttgagacacggtctcattctgtcacccaggctggagtgcagtggtatgatctcagctcattgcagccttgacgtcctgggctcaggtgattctcctatctcagcctcccaagtagctggggctacaggtatgcatcacaacaccaggttgattttttgtatttttagtagagacaagatttcactatgttgtccaggctggtcttaaactcctgagctcaagcgattcgcctgccatggcctcccaaagggctgggattacaggcatgagccactatgcccggccaaggaatctgtatttttaaaatatcccctcctgtgactctgattaccaagtttgaaaacttttgttgccacccacttatctacctccatataataggatggtatttaaaccactctgtacatttttgtcctttattttgacattccaaagatggccatgttttaaaatggtacgtgctattatttgtatgtgctaagtcgcactgaatagtttacccaaatccctctggtactagttctaagcttccaccctctccctataccccttccctagcttcttgaggatcgtaaatcctagcccttggatgccagccctatgtgctgccttcttgagaagtctagatgagtgctcctgggggattggccctcacactgcagctctgcttatttccagccctgcttgtgtcctaggaatatccttgtaaattttgttgggaaaaatgaacaaacagtcttatttgctaattaaaaattgcaaagttttgtttgtttgtttgtttgtttgttttttcttgaggcagagtttcgctcttgttgcccaggctggagtgcaatggcacaatctcagctcactgcaacctctgcctcctgggttcaagcgattctcctgcttcaggctcccaagtggctggggttacaggtgcctgccaccacacctggctaatttttgtatttttagtagagacagggtttcaccacgttggccaggctggtcttgaacttttgacctcaggtgatccactcgcctcggcctcctaaagtgctaggattacaggcgtgagccactgtgcctggcccaaattgccaactttttaatacataagtaatatcagtcgtgggctttgttgttgtttagaaaatttcttcctaagagctattctccaatgctctgattgctgccagtgccccctctggtctagtggtttgtagccctggcttcacattgaaatcacctgtggcagctgactcacacaagatgagtacagtctgaatctctgaggcatgagcctgaacatctgtattttttaaaagcttcctacatgattctgaagttcatccaaggttgagaaccactgaattagtctcatcattgtcatgctcgtgtccccccacagagtcctattagaaaaaggaatgcttcagccatatgacgtgaatatagctttcttagcctggcaaagtcttcgggggtaaagacaaagtttaagcctgcatttttttttcctgggaggctctccttgtattcctgtctctgtgctttaaaccttcacacatgctatttccatattaggtcaaggtcctgtgttacatactgtcctagtaccgtgaaagtttccttcagacatttcttctatgccacgatatatatgttcctaaatacctcattctgcagcattatgtgttaaaaataagacagcctatgaagaaaacacggtgggggtcaaccactcaaaacttgtgcagcattgtaaccagagcagtgagaaaacaaaaagttggtaccagtttagtaaaacagcaagctctaatggtaggtattaaaaaatacacaaagaagagtgaaatgctaccaacattttaattagagcagaggtggcaggtgctgatataacacagaaggaagtggagctccaaaccaggggcgctgcagtaaggttgggtacaagagtcagggtaacctggcataagctgaaaggagcacaaagctggtaggggctcctggtggaagtgcttgcttttaggtcttgttaaatacaaatgaaaagattcttcctgctgctatacagcagagctgagagctctttccattcttgataaaggctgtaattcaccagctgtactgagtgctcttgtgaaggaaaaaaccctgtgaaccaatacaatttttgtgttatgctgacatcattatcccatttactaatcacttaattgatttgccttctagaaggaattaatttgccttccagaaacatagggaaaaaaaaaagactatatcactatgtcactatctgtaatcctagacaaatttgattaaagtctgtaaactccgtaaggtcagtgatggtgactattctgacttgtcatcctcgcaggcatttgttcaatgagtgaatgacttcggtaaaacttctccaaagaaaatggtgggagtaatatgaacattacgcttttaaaaaaatggaacaatgaaagtgacataaccttaaagaaagtttaggaagtagaagacaaaattactcccagtcttcttctattacagtcacactaaaatactattattatttttacatgtccttttattaggtctctattgctacattacaagttaccctaaaattcagtggcttaaaacaatgaggatcatcttagtttctgagggccaggaatttggaagtggtttagctaggtggttctggctcagggtctctcatgaggtcaagatgtcagctagggcttccatcatcccaagacttgacactggggccggaagatccatcctaagacagctcactcacatggctggcaagctgatgctgtctgttggcaggaagcacctcagttcttagcactgtggaactctccataggccagcatgagggtttcatgcttgaatatgaaaatttaagctaggtacatacatgtaagataactcaaaaacaggtacagtaaacagtatgggaaatgactaatttttctcttatgatttaatcttctactctggcattctttgacaattaccatgattggattataggtaaggattctttaaaaccttttcttctttattatatctttagagcaaatggccattaatttgcaaatacatttttttcatgaaatcctctaatcaaatgccacacatttaaggagttagctatttgtttaaaaaggccattttgaaagagagaactgttctctttatgcaaacctcctaatgaaattcaacagtgaatctgattttatttgcattgacccacctctgagtttaagttttttatgtttaacatatgggctgtttagccaccttaacttctaattcaaagtcaaccagtaattaaactgcagtttagctagaactgctatttctataattctggatagactgaagagtaatacagatatgtgagaagcttgcagatttgtcaaataagttgaatttgatgtatggatgttaggtcattaccacacttaaaagaaatttccatggactgtttgctgaaaattcataattttaggaaataccatgtagcttttatgtctatttattacttttgttctctatgcttatacagagatggtgatgtctgtttttgttactttgtcaagtaaaactgatccctttaatcaaacacatgagaaactcataggcaatattttcttgtatgatcagctttagtttttattttagaactaggattagtaggggaaagaaagaaagtattaagtgatctctttcattgatgactggcaggatttaaactgtttaagttcctcaaactctttgtaagtgcaatatgcatctaaaatctttataatttatagtttgtaattatatgttagctgtaactctttacttttcacaaataagtgaacagtttttaaaaattcccaaacacattaatcgtcctaatggatctgagacataccatgcttgattctttttgttccttattctcctgtactctagttttatgacttattttgtgttcctttgagggtctttctgaatttttatattatcttattgatttggaaatagagcctatatcaactacttaaagcacccagacaaatactataagtagaggaacctctaatatcttgtatctcataatatggacactttacagatcttgatattgtataagatttgtttttatttagatttttgtgctgtaattgtacacattgccatttgtaggcttgtaaatggtttactggagtagtgatccatataactgaaagtagtgtgggccagaatatatagcttgaacatttgctataataaaatgatcacagagtaggactcagaggcttattagaaatatatcagtacttctttcttttgttgaacaagtctgctttctttttccataaaatagattaaatgaggccattgtgatgtagagtttatagaaccatattttctatggtccagcacctttccaaaaatgtttgtaaaatagatgtttgatgttatgtaacttgaacaaaacaaggtgcttagttaaatgatagtaattttcttgttactctgctgaaataacattcaaatatatttgtgggggtaatcgcagagtcaccagtctgaattattcttattgtgtaatggtttctgtataatacatagtcctatttgttattgtaatagactcatttgaaatgatgtttacattttgattacctggcgtcttttaaaatcatttatctcccctctccctccagcagaaaccctttaacagaatttattcctggtctctgcttttgccttccttctgttcatacttcatattatatcttcatgctatatatttaggaattgccttcctaaaatacagagctggtcaggctactcccctgcggtaaacaccccactggtgctcctatttcctaaaggcagggttgatatttcgctggtttgcactagttaggttgaactggccatttacaactggtatctgttctgattggctggggctcatgtgctgtggggtgaatttcggattccttagcagtgttttcagtgttttgggggattagaagatctctgaatgagtatttatctgccttaatttcccaccatactgtaattatttcagaggaccctactgtttgggcaccttccataacgatgctttgacttactgcctctgttttggacattttctgcttttcccttaatacagtcattctctggtctaattaatgattttaagattattcttgatgatttaatttaggagaaaattccttggtgaaatctttactgactactcaccatctagtactttactcggttaccttctcttatgctttcctggtacctgccatatacctaagatatcacacttattactttgccctataattattgcttacacatctaccaccccttctggactatgggccagtcacaatgcttaccacaggtaggcactaaataaatatttaagtgtatggaaagaagttagatttttgagtcagaaaaacctgagttcatattccaggtcagctattatacttactagcagtatgagagtgaacaaattaattttgcatagtctcagttaactactaatttgtatatgcaatgataatagacgtgagttgaatattaagcaagatactgtgtaccatgcttattatattacctaggatttagctgttcaataaacattccactgtcctagttaaatttggtttaaaagtattgttttgcatttccttttctctttgaactttaatttataacaagaaagctgtttttatctgaaaacatctctgttctactggtctgtgataaagctagatgataaattatatcattcctactgctaagaaaaaccattgttttcacatttctactagcattttttggtttgaaagctttttagaaggagggcttcttcactcctcgaaagaagcccagtaactactataatgccaggcacaagatgtttgtgaattaagtatttgtggaaaggagctgtggtgggaaagaaagactatctcctcttccttgttctggggagaaggtcacttgatttcctgctggagcaacaaatatgacaaaatcaagggaagagaacactagaagcggatggggcctccctccatagcttttcctagaggacagtctaggagggcagagatggcctctgtgaaagaggctgcaaggactctaacacagtttaggacatcaaataaatgggtgaggaagtaagaggtggttctctttaaagacataaagtaaaaaaatattaggaatcaccctctgaactaattcatcatgtcatagggattaaggcaaaatttgagttgcccttttaccaaaaacaatgaagtcacttataaattgcttctccagataattattctgtgtcatggaaaagggcatcaagctgtataaaggtggttttcgtatttgaaaaaaatttcctttggaagtaatctataataatactttttatattaggccattctcaagcaactctctactttaaggagtaatttgagaaatgtgaggatctcttttgattaaccccaattatggctaaaaccaagtagttcagaacacaagggcttcaccttaattggtcaccttaattactgtggaaagagccaggttcttttcttgtgttatctcttttaaatgtcataacaatattattgtcacaggatccttggggtgtcgctttttcagccagaaacctctgtggctgggggtacctttgctggagttttctcaggccctctgagctaataattccacccacttggcctggctggctgctttccgctggctgctctccgcttgtgctactgtcctggatcccatgcctgccaaggatgagacaggcacccatgcctgccaagggtcagtggcaaggggtgtgtgaaacgagcctggggtctcaccactgtgcacagccaggtgtgctggctgcagcggggtaggcagctctaggcgccggctctgtgcaaggctgcggctagaccaggcatactgtaagtggcttccactgtgggcaccggggagtgcagtggcgcctggaagcttggagatgccaggaactgcagagccccaaagagggtgtcacagccctgggttggggagcccctaggtctgggcttcctgaagggctgcagctcttctctctttcttgtcacctgcaatgtggcaagccctgtttctgttacagctctttcagtcccaccactcggcaggtcctgggttcttgtctcgtgtccaggaagaatgaggtatgtggacaactggagggagagcaaggcagagaggagcttcattgagtgacagaacagctctcaggagacccaaagtgggtggctgctttctgcaggcaggtcgtgccaataagtgtccaggtgtcagcagagaggatatccatagtgggtagctcctttccacaggcaggtcatcctggcaagtgtccagctctcagtggagaggagacccatagtggatagctcctttccacaggcaggtcattccccacaagtcgagcagaccccaagtgggtcgctccttcctgcaaccggtagtccccacatctgtgcaagtctgactgagtccgggggtgttttatgggcttagaagggaagaagtgtgtgctgattggtccatggacggccatgagtgggcctggaaaaagcacaagttctcactgccatcccacggactccacccggaactggcagcccagcccccaggctttaggccatctaccacttgaaagtggggtttcactagggatcctcccctttctctccaagaacctgtctgcctcccgccatcaacatgccatccacagtgcccaggctgttcgtactgaggggtgcctgcaggtttgcatggagctgccctcagccccaccctggccttcttcctgcacttgtcggtgcccaaggtccagagggggccgaggcagagtaggggtggctggcatgtcagctgctgccccgagcgcacacacacacctggtcggacagcgcccaggcttggccataactttgctgcaaaatcagagcgggcactgggagtggggagagaccagagagcaggatcgggcccttccaagcctgtgggggaagtggggcttcctgggtccccgagagcacagggatgcccaggtctggaggtacggctgggcagctgcagctgtgcctgggagtgcaggcttctgtcctgctaacttggtagggggtggggctcccgcctgttcctggcccttgctgtctctctggagcctgcaatgcccgccgcgcctccccagctgcagccagcgtctttgcagtggctgctctagatgggctgctgttgccatcattatgaaatatgtattatcacttccattttactatgaataagtgatttttggaaatttgaattaggctctaactccagtgctcaaaatctgactctttaaaaagctgcactaaagtcagtactgatgaagatgttttataattgcatttatggacttaaatggctaaaacaacatcatagatgctttcaaaggttgtttggaaatgatgctttagttggaattaaaaaggaaaaggatcatactattaagagaacattaagaatttttgctgatagaatcacagtgagaaattaggaggatcagatttgatagaatatagtgactggaaaggcttcaaagatttcacctatctgtttcaaaagtgaaagtagatcctagaacttgttctacttttatatgagcagactttgaaatccttggaaacttagttttctaattctgtccaagaatatgaaacagtgtcagttgacagatctgatgtatgtgtaatagataactatttcatcagaattgaaagtttgacccaatatatagccaccttcttcagttagcttctgtatcactgctggaaattctttttgcagttttcttaggtgagctctctgcttcaccctacaaccgaaggctttggaaatcatagagatttttgaaactactaaaccagccactgctagcacaaaaggagcaaattctgcaggatttagcgatttcctttttatataaatagtgctttctctttgattctgagaaaaagtattcctttttttttttttttttttttgctatttgcttttcagtacatatattcaacaagctttctttttcttctgtttctttaggggttgctctttttgcagcccttgaaattgctttaccaataggcgtttcttttatttccatgcgttgtttgtgaaggcccacaacatgaattttatttctgttgcttgggagataccacatgttctcatcacatattctctcatttctttcaaaatgccttatttctggcttctcaatatttaaaagcttttcttttgtgcatgctgcttgatgtttttgatccagtgtgattagacatatttgagatgttgaatgcgtgtttttatatagaaaagttatcctttgcgaaagaatagcaaaacataattttgcagagtaacaaacgtgccgaactgaggtagctgttacatgtttgagatatgtgctgtttgcgttttcctaggtgcagttttggttcagctgggtgcagtttcctgcgttcacctgatgtttctcacaaacaaaatcacacataagcaaatgtgaaatgtgcattacgctcaaattgttctctaacatatgaattgtgttggaacaaattggtgttttccaaacaagttttataatggaacagattgtacttgataggctctgttaattttaaaaagcctgatctgtagttctaggaagttttcttgaattattttatgacacttttctcctgtccatattgcacatttctgaaacttcttttgttagggtgttagcccttctaaatattaatagctgttatttattttctttcctgtattaacctttttggtattttgttctagtttctgagatagttcttcaactttactttctattctagcacattttcacttatgctctcatatcaatttttcagtttccaagagctctttctagtgttctgaatgttgtcctcctcttattttatccatgtaatcttttaggattttacaagtttcttcagttccctacactgtctctgtttcctctaggttccttttgactgagtgttggctatactagagaattgttagtcattgtgaaaggtgaagccggctgggcttctgggtcgggtggggacttggagaacttttctgtctaggtaaaggattggaaacgcaccaatcagtgctctgtgtctagctaaaggtttgtaaacgcaccaatcagcactctgtaaaaatggaccaatcagcgctctgtgtctagctaaaggtttgtaaacgcaccaatcagcactctgtaaaaacagaccaatcggtactctgtaaaatggaccaatcagtgctctgtaaaatggaccaatcagcaggatgtgggcagggccaaataagggaataaaagctggctactccagccagcagcagcaacccgctcgggtcttcttctccgccgtggaagctttgttgttttactgttagcgataaatcttgctgctgctcactttttgggtctgcactacctttatgagctgagctgtaacactcactgcgagggtccacggctttattctttaagtcagcgagaccaacaacccacgggaaggaaccaattccagatacaattgctcagttattcagttgagtaagattgggtctgtcttatacagacttatgttgtctgcaccttgtactttttgagtattgagttctttactgcatatcaatggtctttggactttctttacggcttgctcaggtttcaacttgatgaattaccgtcttttttccagctttgaaaaactattgaaattgacgtctcttttatatttactctatccttatgcatttaaaactgggttctcatctctttagtggtgtgaggtagaaataaagataaatgagtgtgttcggtgcaccatgcttagtcagaagtagctttaaaaggctctgtaatagattccctatgcgattaattctcatggcttcttgaaactatccaaagcaagactcaaaaaagagctatcattgcatatctagtgcttaaattttgtagacagatgattctacaggaggacctgacttatttgtacttccagacagggaaagtttttattggaaagtgaaaagcatcccaaaataattcttgaagaaactagtttagaatataaagtggcatgtaatacctattgctattaagtgcagaacagtgtttcttaaatgcaccgtgtaccataatgatggtctcagtaagcatgtttctttaaaaaagagtctttcagaaaaccaagatagcaaaagtgagagagatctcttgtatcatacattggttactgcgcagtcctatgatgcatcatgctgtcttgactttgttgggtctcttgaatacagcatttccccttgctgttctccctgctggaagagttcttccatgactaatcccatcatctctcttaggtctttactcaaaactcattttctcagggagtccttctttgaaagctagctaaaatttcatcctctctgatctttcatatccctgcttctgttctttaatttgtctcctgggtacttgtccttatctcacatactgtatatgtacttatttgtcttgtttactttttcagccccagttgaatgtaagtttcaggaagacagagacttttgtccattttgttcatactgaatcccctgtgcctagaacagttcctgacacaaaatgggtgctcaatatatatttgttgaatttttattattttaaaaaaaaactatttccagtgataaccagtctttcaagggactgaagattactaaaacatgacagcatctgttatgataagagtgcagaagtattttttgcttttcatagtggtgatgagtatgaccttatcaagtcacataactcctttgcgccttggtttcctcctctatatgaatgggaataataatggtacctagatgaggtggttatttaaaggattaaatgaggtaatatacataacgtgtagaatagggactgacaagtagtaagtctaatcaagtattagtaaacaaaacttctgcctttgtctagtatgttttagtggaggaaggaagccaataaacatagtaactaaacatagtaaatatagtaactaattaaatgggaatgatttcaggctggagaagaattgcccctggtgtgggagtagaggatgaggaggagcataagagtttcagtggtgttgataacgttcttagtttagcggggggcagtttgtgggtgtttgttctaccgttatacttcctaacttacatagatgttgttatatatgtttacataatgtaaatacttcattaaaaaaatactttctgttccaagcatacctcagtgttaaaacaggttaatcactcatttaatttagttatcctgattaggtaagaaacttggttttaaagaaaatctcttcatataacataactggtcttcccctgctgtccccctcccccaatctaatgtattaaagccaaagtttttttagaattaactctgtttttactagcaatatgtatttgaggtattcagttttatgtgtttgtgcagcattaccctaacttgggttacgtaataggtgatggaacttatgctttgtcaccaacatcattttaatggcctttgtaaaacatcttgttttattcaaaataatgcaactgaatttttaaatatatgtagtatttaatttgggtaatgaaacaaaggaattcattccctctacaccagactaaattaatcctttatgttttaactttaccttcaaaccaatgcaaaatcattaagtaaaattgaagcatcttcaattaggagcatttcttattagaaacatacgtgtaatactctgataaatctgtatattttagatataaattgtctgaaggtgtctagccatgatgactagaagtaacatttactattttaaggacaggtgtcagttttttactaaattaattgaactgcgtatttctggggtgtctagaaatagcccactttttggttctgctagattattgagtcatgccctgtaccaaagccgactgacttgagtttggatcttggctctgccatttgttaaacatatgtctccttgggtaagttgtctgaccactatcagatttgtttgtgttaatgaaaataagctttattgcatcaagtaataaatacatataaagatataaacagttattttcttccagttttgatcaacttaaagtatgcataaccgaaatctactgatagtttgaaaattttgggtgttccttgttaagtttggtaggttattctgctgtatttataacttgtgcattttaaaaattgacttcagtgcactaatagtcatgcatatgtttatgcaaaaaagttatattaagcagaaacgaggagtggctactaagtgcgctgttagtatgcattgaaacaaaatccttatggttgtattagcttaacagaacagtttggggcacagaaacatattcaaaggagaaggttaaagggagacactggtatcttagaggcaaactagtttgctgagataactttacatgcaccttttaaatcaatgcttaaaaaataacttgggtaattcctaactactgaaaatgtaaattctaattaactgcaaaatcttttttcaatctgtgagactgtagttcagagccaggtgaaacatgggaggaaaaaccaacctgttagcattttgaaaacaagagtttcatcgaaacaggggaggtgaactgtaacttctcatcttgtaaaaagatggaaaacctttaaagccaaaagcagcaaggatatggcactctgttcggttttagccaagcacttaccttaccagctttctagagtgaataatgcctcgatttagtctctttattctgttcttactccacgtaggcagggttgatctctccccaactcttcactggggctcctggctgttcccagctccctgggtgtagcctatggatagtggcccatggtcactcagcagctggcggtactgggggggcatcaccaggctgtcagaaggcaagcagacgtccctagagtgtagccaagttactttgtaagacatactcacccttccccatgagtagcccagccaggccatgaggacagtggtggcatggggccctgtgaggcgcagaggcccaggctccctgtgctcgggctctgggagcactggcaaatatgattgccctcaccctcgtgcccactgtagggtgtcatccacacattaggcaggtgggcgggcacagaggaggccataaacttcaagcagactttttaactttaaaatgaagaaaagaatggtacctaccgcctcagagtagtaaagattaactggggtatgagtgtgcggcagtttcctttttcgagtagttgccaccaactctgccactcctttttgctatacattggggttgccttacaacatctcactttatttagttccatgacttgttagttacttctcgttacttaacctcatttgggttcttaaggcttagttctgttatttgatagctttatatcgtgttttgttcaaagttctcctcttctgtcaagtcggactaagcttgtgtctctagcaatttggaattgacatgagaggacctggattgtttccatctatatctgtcccctgcctgctttcctgactgaacaagtccctgatgtggggctgggagcgcaaaagtgggaaaggacaggggtgtccttgccagggagcccttggtgagtttgcagtcctctcctcggtcagccatggcggatgtcctattggtgatcggtgggatagatacgggcatgcagtggccccaacagccccacaggtaaggggctgtgccccctatagctcactggggtctgctcagcccctgacatgatatggcctcatctcacagttgatcctcagcgtgtggcttcatgccgcattcttctggatcccctccagagccatttgcttaaagtctcaattcattggtgagaaatatgcatgtcatggtttgtttttatttctcctaataactgctattaattgtgctcagttgaatcaccctttcactctggtagcaggcttccttactagcatgtcgacccatttccatcgctttccagttaattttggtcatttaaacagtcacttaccattttttaaacacttcgttctttgcattttgaaatttgactctcatgtcagaatcaaagctctctcttctctgcccactctttccctgaaaaggaaaaaaagaacccagtctgttactggcgccttggagtggaggctgtttttggctctcacacgcgtccctccctcttggcagtagcagtgcgctagcatggaggtgggaaggaagaaccgaggggcagagtctctgtgctgactgttgcagtgtcccgcttctgtcacggttgcagctgccgtctgtctgtttctgtctaacggactgtccattggctcatttcgtgaggctgccatccacatgagctttctcaaaggacgcagttgctggctctttgctggcaccttagggtgcctggcattggagagctgacctgatctcttcatttccccgctccctccacagttaaatcactttctctgtcttggtctccttgttgggtagaggctactctcccattcaaggttcttgcaagtgcctcaagcctagccaccttctgtagtgtccactagatccacagaaaactcaggtgtctttgctatgccaaacggctgccccagtgtgtgtggccgcccagctccaccatctcttgcctatatggatttctgaggtaatctcatccactcccaaggagacttactgctaacctaacaacttttcttatgccagtattttcttatgcccaaccccacctgagttccaaaaccgtatttcccactgcctagtaaggcctatcaatgttataccccagaaccagtttactccccttagcctacagccttattctggctaatggcatcaccttccacctgttcacataatccagaaacctgtgagtcatcctgcctcccttacctcacacaagccagttcggtcagttctatgttgcaatgtctttgaatccatcccacttttctctctgtctcccctttgctccttggttttggccctcattatttccttccttttacccccagttccatctcttgtagtcttatacattgtggtcagagtgaccttgccaaaacacaaatcccattgcatcatttgccccctttaaaccctattatgtggaccttcattgccctcagactaaagtccagtctcccatcacatggcctgtgaggccccagcctgtcttaaacttttttccttctactgcctttctcttcactcccactgctaaactccaacctcctattccatagccacactcaactactgagaggtgtccaaactcagcatgctgcttcatgaccctggcttttgcctggcccttcctttttcatggagtgttctcattctctttgtaccttgtagtctaactggacaactcttatttgtttttcaacacccagagggtaagtcttctgccctcagaaacactcccaggctgctttctgctaaccatcattttttatatacactcaaattatacaaaatatcatacgtctttctccccttgccccctgcaactgcccccaagtcactaaaagcaaggattgtgtcttactcatcttgataactgtggtgccaagcctaaagttcctggcctttcatgggtgctcactgttaaataaatgcgagtaaatcaaatggctgaagagctaatgtatagaaagtttttaaattctagtttatatctttctagctaagatgtattatgttgaccatttcttttacagtagttggcagcaggtttaaatgctaaaaagtgaccctcattctcattgtaaatttttatttcccacttcattggccccactcagcactttattattttcatcgcattgtcttcttacccttatttaatcatggataggagaatgtggcaatgtcagaatcacactaagatgatatggaaggagatccaagctgatgaccacctagagtaaaaatccttggggtatattgggacaccacagaagttcttaaagtgattgccgctaaagccatttctcctattcctggccacaagccttggggacgcagcctgcctgccttctttacaagtgagcatcattttctttgatccccttggacttcctctaactcgtcttctcacagctcttgagggctttgcaaggaactgtcagggctaatgaaaggacaatttgaaaatcttctttaggcacattcactaagtaatgtgtccgtcagcaagtgtggctctgtgtctgtggtgagcccctttctctgtcgggaccttgtcccagtgcctggagagcaccttctcaaactgtagacctcactggcactgggactgatctgagtgcccctgtcagcctgcccagcctcagaaaggaagctgtggagggccagttctcaccaagagctcaccagctccactctagactaggcccagaaaccctgcagccaggctgcctgactcacatgcagcatgggtctctggctgtggtttccacacagcctcccagcttgtttcttaatctgtaaaatgggtggctttcaatgaatactgtggctccgttgagatcagcagaagggcatttcactttatggtccctttattcttccaggtctaacatcttacacacacacacacacacacacacggatctagaatttctggtgtgcacttctagggcacactatattgaatcagcatttggttctatgctccatccaacagttgatgaggtagaccctggacaaagcacctaatgcctttgagcctccatttctaaacctagagaataagaaaattaaatgatctccaaggtccattttgctttataattctgaatagatcagagggttaaagaaaccctcagacctcatttatgtcacagagctgctgcccatggaggccataatgtagaaatgtgtcccttgatcgaagcagaggtatttattatgtaaacacactgtgtccccagcacacagagtcaactttgccaatgtgttaatgcttacctaggcctgtactacattagacattctggagctaggtaatatccttaaatttatctttaccgttgtaaatacaactgtgtaattgagcttcatctgattgttttagagtcaccaagagactgcctctaatgaccctaagtggctctgtatgcatagaaaaatggttagttggttagtctagttcctaccaggtcttttaggactgcttatcgttgttttcttctggaatttaacaggaaaattagcttaaagtaactagttatttttaaaaagtgctcaaagcatctatttttcatagctgtgcaaaagtaaaagaaataatattcatttttcacttcatgcaagaacctcacttgcatgaggttctcgaaatagaaaatcataatcaggacaacttgtcacttcttcagatgttttatatagaatatcatttggcttctaaatctgtgattccttttttgtctgtggctccagattttcataatctaccactattaagcagaagtggtaatttatgaagaaatttgggtttgaaatgcttattattttcatgaagataaaaagtaaaataagaatgttaaccatttgagtcctgttgctgaagggcattgagaggagttgagccccatctctctctcccattgcagtagttcctcttaaagtctcccttaccatcttaaaaaaaaaaaaaaaaaaaagaaaaggcattgggtcttcttagcattatagatattcttttggaattagtagttatgctaaataaggtgaagacagccatgggaaaacttaaaattgtttctagaattgtaacaatttaaaagtaattataaatgtttagagagagaaaaatacagaaaaaatgtatttacagagggtaaatacatgtgttatatataggtgtatataaataaaagattatatttaaatctattagcattttaagacttttaaaattctcacacttaaagcaagtatttaatttttacaaatcttttaacgctaatatgagatttaggaatgattaatcaccaacaaactcaacagttctaagaacagagcaaaattatagttaaaaaattcaagcctagtaatgcattttatataatgatagaacaattagttataaaataggcatttttaggtctcctcaatgaatatatttaagtccttgcattatatcttttaaaatagtttttgttcccttttttcttttagtttaaaatgttttaaatcaaaatactacatgtaggctgggcatggtggctcacgcctataatctcaacactttggaaggctaaggtgggaggactgcctgagcccaggagttcgagatcagcctgggcaacatggcgagacactgtctctaatttaaaaaaaaaaaaaaagtataggtatctaaagtagccgaattcatagaaatagaaattagagtggcagttactaggggcaggagaagggggaaatgggaagttatttaatggatagtttcagatctgcacatgaaaaagttctgaagatctttttcacaatagtaaccatatgcttaacactactgagctatacatttaaaaatggttaatgtaaattttatgtgttttttactacaataaaaaatgataatgaaaatataaagattagatagaaatttaaaaatatgtttctttttcttcttcttttcctcttcttcttcttcctcctcctcttcttcctcctcctcttcctcctccttttcctcctcctcctcctcttcttcctcttcttcctcttcttcttcttcttttttttttttcattcttcccagtctgctatttaggggcagtcatcttttcattttttaagatgtaaattacatatagtaaagtttgcctttttagtgtacagcaatagtgttgtttgttttgattcagggcatacaggcacaggtttgtaatatgggtatgttatgtgatgctgagtcttggggttctaataatcccgttgcccaagtggtgaacgaggtacctcataggtagcctttcagccctggctcccctccctccccacttctggagtctccagtgtttattgctcccatctttgagttctacatgttttgaaaaacagtgggcataacaccactacagtttagatatgagatagttccatcacccataacaatctcccctccctcccctaccccaagtttctgggaacttctgatctggtttttgtctctatagttttacctactctagaatgtctcataaatggaatcatatggtttgcagtctttaagtgtggcttgtttctcttaccataatatatttgagattcattcaggttgttatgtgtatcagtagtttgtttctttgtattgctgagtattattgcattgtctagatgtaccatggtttgtttatcttttctccagttgagtgacatttggtttgtttccagtttggatctcttaagcgttcatgtccaaatttttgtggtaacatgttttcaattttcttggataaataacttgaattgggattactggtttttatggaaactctgtgtctaactttataaataactgcaaaactgttctgcaaagtggttgtaccatttttcattcccaccatcaatatatgtgttccaatttttctgccttttcagcattttgtattttcaggtttaaaatttaaactatattttagctattctgataggtgtgtagtggtatatcattatggttttaatttgcatttctctaacaattaatagcattcagcattttttccaggcgcttatttaccatccatatatctttgataaagtgactgttcatgtcttttgcccttttcttttaatgggttgtttgttttcttgctattgagttttgagttctttatatattctggatataagtcctttatcagatatgtgacttgcggtacttaattctggtctatagtttgttttttcattcttgtaacattatctttcaaaaaacaagtttttcattatggtaaaagtccattttatcaattttttttcttccatggattgtgcttttggtgtcttacctaagaaatctttactggttcaaggttcaaaagatttatgttttcttatagaagttttataggttgggattttacatttagtcctatgatccattttaagttaatatttcatatggcgtaaagaatggatcagttgtattttttttttttgcagttgttccagtaccatttgctgaagactcttttctgaattgctttacatatttgtggaaaatcgatttgctctgtgtgtgtgtgtgtgtgtgtgtgtgtgtgtgtgtgtatctttgacctctctgttttgttccattactctatgtctgtcattttactagtaccacactgtggtaatgcaagtagttattagtctgtagtttttcttttttataatgtctttatctggctttagtgtttagggaatgctggcctcatagaatgagttgtaaagtagttttttaaaattttctgtctctctggaagagtttgtatagaattgatattatttctttctttaaatatttagtggaatttaccagtgaaaccatttgagcttgaggttttctttatagaaagagtttaaactataaattcaattttgtaaatagatacaggactattcaagttatctgtttcttctcatgtgagttttggtaggttgtgtctttataagaatttgtccatttttgtttaaattgttaaatttattgaaataaattttgatatgccttgtttttattttcattcagttcagaatatttcctaatcttccttttgattgcttatttgacccatgggttacttagacgtgtgtaatttttccccaagtatttttcagataatctcatgttattgatttctaatttaattacattgtagtcagagaacataatgataaaatcgaccttttatcattataatgacctttattctttataatattctttgcactgcagtctactttgagtaatatagccacctcagctttcttttattgttaacatggaatatcttcttccatattcttattgtacctatttgtgtttttatatttaaagtctatttcttataggcagtatatagttgtatcttgctttttcatccaaactagcagtatctgctttttaattgaggtgcttgagaccatttatatttaatgtcattattgtttttttttctttttcttttcttttcttttttttttttttttttttttttttttttgagacagagtcttgctctgttccccaggctggagtacagtggtgcaatcttgagtcactgcagcctctgcctcccaggttcaagcgattctcctgcctcagcctcccaagtagctgggattacaggcgtatgccactatgcacagctaatttttgtatttttagtagagatgggtttttaccatattggccaggctggtcttgaactcaagtgacccacccacctgggcctcccaaagtgctgggattacaggcgtgagccaccacgcccagcctaatgtgattattgatacagttggtttaaatctgctatcttggtattcattttttattctattctttattccccttttcctcttattctttcttttagattatacattttcctatgattccattttatcctcctgtgttagctttattagatttagagtttatagcatacatctttaacttatcatagtgtactcagcagtatatttcccttctcccttcttagccgttgttctatctttgtcatacattttacatctacatattgtagtacattccagtacattgttatttttgctttaaacagtcaatgattattatagacagagcctcagtatgttgcccaggctggcctcaaactcctagctaggctcaagtggttctcccacctcagccttttgagaagctgggactacaggtatgtggcactgcacctggcaacagtcagttatcttagatttaaatactaagggggaaaagtttttgtatttaaccattagttatcatttctggtgctcttcacactcttgcgtagatctagttttttcatctggtatcattttccttctgtctgaaggagttacagtgatgaatccttccagcttttgtatgtctgaaaaagtcttaatttcaccttaaatttctgaaagatgttttcactgggcatagaattacagattgacaggtttttttttttctttcagttaaagatgttgctgcactgtcttctggctagcattgtttccaaccagaagtcggctatcattctttgttgctctgtacatagcaattttttccagctgcttctaagattttatcactgatagtaagcaatttgattatgatacaccttgtcgacttcttcacaattctcttgtttggggtttgtttagcttcttggatctgtaggttattgttttagtaaaatgtgaggaaaattaccgttatttcttaaaatgttttctctccttttttttttttttcagggacttcactacagatatatttggttgcttgaaactgtcccatagcttattgacactttgttctttttttgatttgttctttttcattctttttttttttttttttgacagagtctcgctctgtggctctgtggcccaggctggagtgcagtggcgcaatctcggctcactccaacctctgcctcctgggttcatgcagttctccagcctcccaggtagctggaattacaggtgtgtgccacaacgcccagctattttatatttttagtagagatggggtttcaccatattggccaggcttgtctcaaactcctgacctaaagagatccacctgcctcggcctcccaaagtgctgggattacaggcatgagccaccacacctggccgatttgttctttttattcaacgtttcttctgtgttttattttggatagtttctattgctcatatatcactaatactacttctgtcctatctaatctactgttaatctcatctagtgtatttttcttctcaaatattgtatttttcaccttgataatttaatttaggttttcttacatttctcacacctgtccttaatatgctaatgttttcctctactttcttgaacatatgaaatatagttataactgtttttaatgttcctgtctataaatcatctttgtcatatctgggtcattttgattaatttttctcctcatgagtgatatttccctgcttgtttttatgcctagtactttttattggatgccagacattgtgaattattggatgctagagactttattaaatattcttgagctttgttttgagagaaaattaagttacttggaaacagtttgacctttcagggcttccttttaaactgctttatgtaggaccaaaacactcttcagtctaggactcatttttcccttaaattagtcctagactgaagggaattagaattcttctaagcattcagaaggagacttaggcagtatacttctgaatatctgatatccctttttacagagtttttttttcatttaggctggtgggtggtaataccaactggtgcctaccctatgtgatttctgaaaattgttctgcttgcttcttttgggtggttctttccccagcctcgggtagtttcctcacatgcaggtgtgctaagggctctgctgaagcctggaagcaggaagaactgctgcagatccctataaacctttcttttattttgaagtgtttaaaatttattttatttaaattttttaatcaaaatacatgtacatacccaaaaagcaaatagaatgaatagaaaaaaatagcagttctcttttttcacttatccactcggtgccttagacgcagccacttttaagttttagttgttttttctcatttttacctccacatttctatgtaatatatttatacttacactatttcttgctttttccattttagatgttaggtaatcaagctgtagtagattaggatttagcagttttaaaccattcctgccatgcaatttttcttcctgttaccttctcaataaagttaacttttaaaaggtaaatccacaaaaaaatgaaaaaataatatgggtcatgtatattttatgagcattccgtgttttcttccttgctctgttttcagtaaaactgcctttgagcttatctaattgttccattagatctatcatacacctatcagtagctcacctgtgccctgcaaatgcttagatgtgttagataatctgtgtgttcattagcacggaagctctccctcctggagttctccatcttcccttaccattgcagaccaggtacagaccagctgcagcttgggcttgtccagcagcagtccccctgagatctccctgcactccagcctgctgattcccttcctttcctccagtatctgagttcctggttcctatttcccatgcctgccttttttcttgatttgctcctccattttggtgtctgaaatatctaaaaatgttttaattctacctttacactcaaatgatgatttggccaagtaaagaattctggataaaaaaactcttttctctcagaattttaaagacattttcttcatctttttctgactgccagcaaagtggttctgttcctagtccctgtgtttgtaacttgtttcttccatttggaagcttttagtattttctctctatgcctagtgattaaggtttcagggtggtgtgctttggtggagggctttttcatttcttgtggtgggcatttggtcatctcatttaactggagacttgtgtccttcagttctggaacaattcttaaattatttgataattctcttccttctgttctctctccaaaatagaaatgcatcctattttgatgttggacctcctagatttatcctttttcttttccgattctttttttttttttttttttttttgagacagagccttgccctgttgcctaggctggagtgcaatgatgcgatctcagctcactgcaacctctgcctcctgggttcaagcaattcttcgtcagcctccccagtagctgggattatagacatgtgccaccacgcccagctaatttatttgtttttgtttttttttaaagtggagacggggttttaccatgttggcaaggctggtcttgaactcctgacctcaagtgatccgcccatctcaccctctcaaagtgctgggattacaggcatgagccatcgcgctcgcgcccggccactgttctactcttttggaagctttttccaaccagcctttctgtggagataaggaaatgtaaattgtggttgaatttaacagccatttctttggcatttcttcttgttttgacagtgtgtgggacccaacactaaaacactatttgttgtttttctgccattcacatttaactgatagtcctgtagtttcatttgttaaacctggtaagtatattcccatgcctagtgagagtaaactagaaaaatggaggtgacgtgggagtccttagacagcagtgatttggtcaggtacagggtaatgtgccttcgcttctttcctggcagttgttttagatttgcaaggagtttggatagggggagaaagaggttactctatttcagtgctgaatctccaactgtaccggtgttggccaagtcagattaagtttggaagaaaagcacatgttacaggaaacagaaacactcaggcctgttcctcttttcctatcctgtcatgcttgctaccaatatgcagtagcagttgaattggaatctgtgtaaaaaggcttttaggcagacaacactagaaaatacctcaatctcaattgtccaggctgtttaatgtgtatgagttcccactgaggtgatacctcctgatctttgctcagtgcctgaaatagacttatatggtccatggctttaaggatctctcctggaagccttgtagtatttttctctgccctgtcagcaagtctcagtgagctctgatgaggcaccagacatatggatcgtttgtcttgcaattagaagagcctttgaatgtaattctagccatttgtgccacggacatttctgatccaagggttttccctccatggagctttccatttcctttgccttctttttcaaattatgtcttctcagttttcatacaaaagtctagttttaaaggaatctagcatatttatgtgaaatatatgagaaaattagatttctaatcatttttttagttgcctatcctttggctcaacaaattctccagaagtgtgcacacacacatacatgttcaaggatgtatgtagaaggatgttccttgcaattttatttaaaatatccaagtattaacaataactgtaatgtccttcaataggaaaatgggttaaatagactatggttgcttatatttgcttctcttgcttgatacaatggatgatcagttaaaatgattgaaataaaaacagctttctgtttatgttgaagaacggcatgaataaattcagttaatttagtaattttttaaaactgcagcttggaatttaaaaatttttttatatgaccttagagttttgttttttaaagctctttttatagcttaaatggtgctttaatacccttttttcatgaagttggcattcagttaaaacatgtaaatggaatttagcatacaaatagttttaggtataactttaactttcaaaatatagagactatcatgtagtaaataatattctggttagcattcatagacatagggaccacatgccagcttcccaaataattacgatttctaagcttctacttagtctccttttgttggaaatgggtatctttttttttaaagcatcatatgagttaatatatgtaatttttataaattataaatatgttaacaattattgttattcaaaagccaagccttaaaatttggagaatatgaacctttcagtaaaaagggaatctcatcactttatagttggtcacactttggtttttaacccaaaagagaattgtggtcttcatcatttactgtgcttaccgatctggtctggttcctaataactttggacagtttctgaaaaccaaatctacctacccccactaccagcattgagtcaacttaaaaactgtctaaatggatctgatggcaattttagaaaaggatgctgcttgaggaaagatgcttattttggagagaagactgtgtgtgtttgtgcatgtgcgtgtattacatatatatgttctacggtcagattttatgttggaattatttgtgatgacacaattttatctacagattagagaggtctccccaagtactttgtagattttttggtttttatattatgccattagagggcagtattgtagaggttaagttttctttctcgcatgtattgacttggaaactgtttatgttgtattataatttagcaaacttcagggcttagatttctagtatattaaattgtagccttaattgatgcatccctgcaagtattttaaattaatataggaaattttgaaagggttaagctattttatacccacatctctcgattttggtttggagaagggaattatttggtcagtgtggccaagagggtgaaacagaggtgagcctacagcatctattggctgcttaactatttttaaccaccattatatcctcccttttctggttctggacactgcaaatgggcagagactaacttcaaggatttgtatgctttgaatacatactttataatatttcaatccctctgatgtaagaaggctcataggattgagggattgagtcttagaggaattgtcactcagcttgcaaaaacgtgccttagggacttaactaaaaatagatttatgtggaattcaacctgtggattgacttttttgggtctaaatagaagaaggcatatttagttactagggagaagatgctaatagggagatgtgattttaaggtttgtggctctacgggctttttgggaagatcctggattttatctggagtctttccctcatgcctagcaaagaatatataatgttttttgttttgtttctataaaacaaaaggtagtatctctcaaagagcaaatgtgattttttttcctctaaaattaaaaaaatacatgattgcagggtgattattatctttaaaaataaaaccgtctataaaatcctcccagtaccgctgccggtaagaactagataattgaaatcaagacactcgaagtcttacagtggtgggactgggcatgcccagtagctcagacggttcgggttacaaataggaagctttcgccgttaagcagccgcgggacacagctccggggaccggggtctgactcccttaaacgtaagcacgtgtgggggcccccatagtatttttcagggacccttcacattttctgccgaagcaatggcccagtgttttgaggccgccgtggaaacctccgaacccagcaccccactccctctgagcacggcccgcgccaggccagcccaccccacgagcgggatctggagaatgggggcggaggtgggggtggggggaggcggggaagcagggaagcgggaggacctggaagggagtagggggcggtcccagtggcgtgccggccaatcggcgcagctctttcctgcatatattttgcactaagactgggagtcctggtctagagctgagtggagcccggctgcggatctgggaagcgcctcttcacggcactgggatccgcatctgcctgggatcatcaagccctagaagctgggtttctttaaattagggctgccgttttctgtttctccctgggctgcggaaagccagaagattttatctagcttatacaaggctgctggtgttccctctttttttccacgagggtgtttttggctgcaattgcatgaaatcccaatggtgtagaccagtggcgatggatctaggagtttaccaactgagacatttttcaatttctttcttgtcatccttgctggggactgaaaacgcttctgtgagacttgataataggtaaatgtcggctaagatagtttctttaaatttattcgtgggatacttataataatacaggtgaaagatagccaggcgaattcctttgtccattgctgagagattatggtgacatggatgttgtttttcgaaatgttaaaaaaccttatttttgcaagtctggccagagaacaggctttccccacattatgtaatttagtcctttgtggcttactaaaatagggagatgcctggatattcgttagtaagagaggggctggcattttctggagggtgatacattacatagtgttaaataacattcaaaatatgatgctagcaatatcacaaaattgggagatcctttttatcttggaagcttaagataaattccatttatcgatgacctttttccctcctctttttcagctcctctggtgcaagtgtggtagctattgacaacaaaatcgagcaagctatggtatgtactgatgaaaaatcatttatactaaatgtgggcacagcacaaaaataagatgttttgtggaaccagtgcatccctaagttcagatgatgatgattgctcttgatgcgcgtagaaatgccggcgctgtctccattcggccagcgtggagccacctaccacggcagccgtggagggagaaaggggccctgcgggtattaaatggtcttcttccccggactggtttcacacgacgggattttctcacggtgaccctttttgctggggatttattagggaagcgctggccaactatctccttcggctggtcgtgagcacacctttagcgatgtggctttactaggaatcctaatattttactagggagccgggaggtggggagggccccagaagtcgggatcctggataagggtcttctagacggtgcacaaacgggtccccggtggcgcgggctccttcacaatgaagaagaatcagagaaaaagttttgttttcttagcctgcgcctggatttctcctattttttatttccgccttggccgttctttgttattggagcagcgcctgtggctcttctcacgggattctctgcccactgttgctaggcaaactctgaacctttaattcggagctataaataactcgggctcccattggctgcgacgtctgcccaggtttctgtgatgtcagcttaatcacgaaaagaggggggcggggtggagggaagaaaatgcggcaacatgttcggtaggaactggctgcagccggtgctgaaggaggcggctccgggcgagcgcggggcggggcctgggggcggggacgcggtgggcgcgctgtggcttggacgtccccgctgctggtctcagtcggggacccagcgcccggctctggcccagtctcaggaagccttacttgggcgtttctggccaacgtctgcagagaagcacagacttttacaaagcttgatcatttatacgttaaactcaagtattgtacagtcatgtttgtattcagatttccccaagtgtcattgaaccaactttaaaggtggaatatgtaaatagttagggagatccatgtaaaataatgtcttggaaactcaaaagagtccagaaaataccaaataatgagttaaaccttttctgtcttctttccaggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccacagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgat

SEQ ID NO: 38070 - DNA, 28836 bp, Homo sapiens; identical to SEQ ID NO: 37100

SEQ ID NO: 38071 - DNA, 13069 bp, Homo sapiens
gcctgctcctctggcccctggtcctgtcctcttctccagcatggtgtgtctgaagctccctggaggctccagcttggcagcgttgacagtgacactgatggtgctgagctcccgactggctttcgctggggacacccgacgtaagagcacattgagggtgctgagctactatggggtgggggaatatagggagttgtgttaacattgtgcccaggccatgtcccttaagaaattgtgaggttttcttcagagattgctcatctttatcaagggatcgcaaattatttcctccacaaaaggaacttggctacttgccctctccatgagacttgtgtaaggggcctttgtacaggccatttcttctcaaatctccaccaataaaacctttgcatcacatgtactcagggtctttagaggatttggaaataaggatgctaaaataaattccccatacagcaattccctttattatgttgacttatgtcagacaaaaggaggtttttactgaaaattttgtgggagtcaagggaattcaaagggtctctcctagacgatcctgggttatgtcctccacaggacctgtggtgttggcccctcttcctcatatgtgaggatggacccagtggcctccctagtatctcctttcttttctttctgaactccaatgtttataaagcctgtatccctgtagtgtatgtaggttgtctgacagaagttatacttagtgctctttctttcttatggggaaaaatccctggaactgaagctgagatcattagtacttggaatcaccttacagatacagagcacttatgaggtattctttggtgcctaaagaacttaaggcatcctctgaaaaactggcccaggttagtgtttattatgaatctttttaacctttctatacttgtttctcctacatctcctacatgctctaactagacatgacagaagagatttaactaatgtagtataaattatatgaaattctatttttgtaagtcaaaaataatcaaatatcagaaatttaataatgttcaaactatatactgtgtggggttaccgagacaatgtggacattgttcacatctcatagggctgaaagtcaatgggcaagtcctggaaactcattgtcttactgcggtcttgtcctcagtttcataggttcacccatcatgccctcagctttccttaattagccatgtctgcttacctcttcctcccatttctctctatttttccccaactatgttgtcatcatttccagaaatctctaaagcttgcacagatccttagcactatgagatccactgaaagagataatatttttctctttgagatagggcctgcctctgtcacccaggctgtagctcagtggtgcgatcgaggctcactgcaacctctgcctcccacactcaagcaatcctccctcctcaggctccagagtagctgggaatacaggcaggcaaccacgcccagctaatttttgcaattttggtagagaggagattttgccatattgcccaggctggtcttaaactgctgaactcaagcaatcctcctgccttagcctcccaacatgctaggattatagatgtgagccagtgtgcccaggcaaaagagatgactcttaataaaaagatttcctttttcttaaatcactgttcctttatccatgaattcttcttccaactagaagaaggagaaagaagtttgcctgtatttctcaccaggaggagaaggggtctagtgtgacatcaaaatgaaagagtgctggaacttgagccccttcttgctttccaggatccccacagtgatcagttcccataccctggtttatttgtgtaaaccacacttatttttctcagcagctactgtgtactgggttccattctaggttcaaatcattctatttgattaagatagagagggtcccaactctcaaggaagttacaagagtggaggagacagacactaacccaataagcatttaacaaagaagataatgttagagagtcatagtgcactgaagaaaagacatcagatgtgtgttgaaagagagaaatggattcatctactttagtttgtatgtttagggagctctacctgagaaagtgatattcagctgagacaacaaaataagtagacagtcatgaagatctaacggacgaaagtttcagggagaccgaatcgagggaaagcactggtgtgggaaattatgtggagggagagaaagaaggctagaagggctgacgtatagaaagcaaggaaatggagaggcagaagatgaggtaggacacagagaggaagtcaggagcctcatcattataggctctgatgtccacggtaaaaaatttgaattttattttatttttatttatttttaaattttatttatttatttattttgagatggagtttcattcttgttgcccaggctggagtgccatggcacaatctccactcactgcaacctccacctcctgggttcaagtgattctcctgcctcagcttcccaagtaactgggattacaggcacccaccaccatacctggctaatttttttgtatttttagtatacatggggtatcaccatgttgaccaggctggtcttgaactcctgacctcagataatctgtctgccttggcctcccaaagtgctgggattacaggcgtgagccaccacccccggactgaattttatttaaatagatatgagaagctgctgtatggttacaaggagagtcaatttatattcaacttttgtgtgtgtgtgtgatggagtctcactctgttgcccaggctagattgcagtggcacaatctcggctcactgcaacctccgcctcctgggttcaagaaattatccttcctcagcctcctgagtagctgggaccacaggtgcatgccaccacagtcggctactttttgtatttttagtagggatggggtttcaccgtgttagccaagatggtctcgatctcctgaccttgtgatccacccgcctcggcctcccaaagtgctgggattacaggcatgagccactgcgcccagcttatattcaattattacaattaattctagctactttgtggggattggattgttggggttcacaagtggttaggaggactatttaggagcacagcagggaattctccagggaaaacaggcttgtggcttcatggagtgcattagtgataaagacggtgaaaaagataaagtggacaggcttggcatgtatttttgcttagcttgttaatgaattactgtaaagggggtggaacaatcaagtttattcctgaggattttgttttgacaaataagtgggtggtagttttgtttattgagataggaaaaactgtgggaggaaatgatttgaagtgggtggttggaaataaaagttttgtttaaattagagatgatttattgacatttatgtagagcaatcagaaggtcagtggcatttaagagactcatggtgaggtgaggctagggcgtcagatatttatgttggcggcatcaatacgtgtagtgtgttaaattctagggagtggaagaggatacatagggagatggattgtgtggagaaaaaagaagagggcacaggccagcaaagtgggctgagacagagcccagggatgttggagaaaaaccaagagaacataatgcgtgtaagtcaaggaaaatatatttttttcagggagaagggagaggccaattgtggtgagtaccactaagcagagggggaagtgagaacgtgacagagaagcaagtgctgggtttggtggagttgatatttgtagtcaatggagtatccagggaggaaactggattggactatttgaagagtgagtagaagtgaggacgaggttaaggttgactgttttgagtagaacttcgggaaggactgtgctctgggttcagggagcccgctgaatctaaaggaaaaggctaaagaagctaaagagacggaggaagacctgtgaacaagagatgctcagtcattagcaaggaaatactggagagcccctgtgtgcagtggtgactactcatgcaaaaggtcacacagccaatatttaacacagccagtatttcacagagccaatatttattagtgacatagaatataccagttattactctaggtcatgagagtggtgataaataaaatgaatccgctcgccatcagtatatgccatgtaacagtttgcagtgactgtgtaccaggcctgtgaatttctgtatgcaatttcaataatgatcctgctgtatctgtggtatttaaaaacatatacatctctggaatctaaaattgagaggttataagtaaaacccagtattagaaatttagtgctggaaatcagattgcagtttaaatctgagcatatagaaagtccctttcttctatgtcagcagatgccttttatgtgaggtttaggtatactacattattagacataaaccagtgtttctgccctatgttttcagaatgacaattctttatgaaactcatagaagaacagaagacaattgcaaaatcatgaagatactaattgctttagaattaaggaatacaaaaaataatgtgagctacagttatagggatcataaaagttaaaatgggaatgtatttgagtgtttattatgtgatcagtgctaagaagagtcatcatttaattttacacttaacagtaatcctgtgaggattatgctattattaaatgcatttgatatattacaaaaaggcttacggttggtaaaaattgacccaagtagaagaggtcacctttttattcagattttctgattgtagggtttgagagtttttccatcattagtgagtagtgactatattgtgtctgaattattgacagaatttctgatattcatatataccaggttgtttctttgagtggggacagagatgcaagggctgctaattccaatgtataggagaaactttcaatgattttgcatttatcattttaaaagttcagtatgtctataatggtcatgcgttgacaaacacaaggaagtattaaatcactccttcttctgaggtttgactagcaaattgggcaagagttaccaaataaaacacatgttcctagttaaatctaaatttcagatacacgaccataatttattggaaatccaaatttaattgggtaccctctggttttatttgccaaatctgtcaaccctaagtgggacacatggacatggattacagtgctacccatgcaagccacagtgacagcaactttacacatgtttacattttaactttctctctgtaagaaagtgcttagataatttagggataaaaagatagacattgtttgatccagggtggacacctctctgccatcgtttctaaagggcaaagggagatttctgcaggtcttgctcacagtctggggacctgctcatgttttgaaactgtctgtatcagaatgtcattttcttggtttctccctttctgaggggacttgactacaaaaccaagagttctgcctctggccaaggctggaaatgtgatgcctgctagcattgttgggagtgggagactgagagaaatgagttagttggggcatttaatgggaataaaatagctgtggttgtgattcattactatagataattagtggaccagtggcggagaaattaagaaaaaagatgatgtgaatgataaatgatatgattagtgactgcttggtaaggcaaggaaatcattaaatcttggttctcatcaagttcattttctgaaaagatagcactgtattgggaccagaattctacaaaacattctttttacctaggaccaagattttcaagaaatatttttcaatacaattctcagctgctccataactaatagtagcttgttcaacacagattttttcagatggttcacacctgtagttcttacccagggatagttcaccacccctcccttccctcccatcatccttggggaacagtgacaatgtttggaacaatttttggttgtcacaacaggggtttcttctgatatttaatgagtagaagccaggaacactgctagagaacctacaatgttcagaacagcctccgccatcaacaaagaattatctggtccaaaatgtcaatagtgctgaggctgagagcactggttcacgctgtgctctttttgaaaattctacactcacatctgttatacactcaccacacagttgttttttatagtttatttttgcttgttccattataaaaaaattagacagttgcataaattcaaccactttcttgttgaatccacttagtcaatgcaagcttaatattttcatatttagtttttgccttatgcaatatttttcaacattttcatgagttgttggtcatcaccatctctattaacttccaacaacttgctcttgtaagtcacaaatagtgatgctgctgaaattatttctcagtaacatgcctcagatttctgtagtgattctacatttgatattattcacaatgtaaaatgcttctatgtactcatttcacttttacccaaggattatttttaagttatttttgtcgttttcacacttcaaacataaagacaaaaacatcaaaaatatatactgtgttttacatatgtgtctattttcacacatatatgtatgtatgtttatatgtatggaaactacagaagcacatgtcgccaataagagctctgagacacctttgaccacttacccttatcagatgcgatttgccaaatgagttgtggaaacaagttttttaaactgaatttctgagctttgtgaatttagaaatgcaaaggaaagtttgtggacatttacagggatcatggttttattgtcctttaaactcttcgatactttaccattgtcttactataaatccaaaatcctaacgccacccacgaggctttcaatacctggcttcttgtgatttctccaggctaaccttttaccctccttcccctcagcctctctgctttagtgaactttctcctagttttttgaagaagttcatcaattcaagcttttgtacatgggatttcctaaacctgaaatgtgcctcccgttttgtccaaacagacacgggctccactctgccccctggctcacacctgcttaacctgtcaagtcacatctgaactgtcactcttcagagggtccttctctggcaccctaatgtaattgagatcatcctattattctctgctctagaacttcccacttccgggatttctcattcctgtctaacctcttgtgtgtctggtttttggccatcgctttcactgctctttaagctcccccagcggagtggagaggtctgttttcccttgtttggattcctagaggcagcgcaggcctggcacaaggtcatcactaagaaagtgttcacaggatgaacgcggtgggtgctgtttaaggaaccggtaaacatgtgggatgagagaaggagcagagtgtctttggggtggaggctcctaggaggaggcggggcgggctgcggtgcggggcggatcctcctccagctcctgcttggaggtctccagaacaagctggaggcagggagggggtcccaaaagcctggggatgagaaggggttttcccgcatagtcccctaggcccccgttcgcctgaggaaaacggaggatgagctcctgggctgcaggtggtgggcgttgcgggtggggccggttaaggttcccagtgcccgcaccccacccagggagccccggatggcggcgtcgctgtcagtgtcttctcaggaggccgcccgtgtgaccggatccttcgtgtacccgcagcacgtttcttggagctgcgtaagtctgagtgtcatttcttcaatgggacggagcgggtgcggtacctggacagatacttccataaccaggaggagttcctgcgcttcgacagcgacgtgggggagtaccgggcggtgacggagctggggcggcctgtcgccgagtcctggaacagccagaaggacctcctggagcagaagcggggccgggtggacaattactgcagacacaactacggggttggtgagagcttcacagtgcagcggcgaggtgagcatgtcggggggcggggcctgggtccctgtgagctggaaatctgagagagagtgtgtgtgtgtgtgtgtgtgtgtgtgtgagagagagagagagagaggaagagacagagagagggagcgcgccatctgtgagcatttagaatcctctcaatcccgagcaagcagttatgaaggcacaggtgtgtgtgtagagtgtggattggtctgtgtctgtgtgcctgttgtgggaggggaagcaggagggggctgcttcttatccttggagacttctgtggagaggtgacaagggaggtgggtgcgggcggctggagagagaggagaccttgattgtcctgggtccttagagatgcagggaaggaaagtgtaaggtgtgtgtgggtggggtgaaggtttaggggaggagagctgaggggtaaggaaggtttgggataatgtgaggaggccggttccagactgtccctggcacacacccttcatgtaatctctgaaataaaagtgcgtgctgtttgtaaaagcattagattaagttctaggggaattgagtagacctctaaggcacctctgaaacttctttaggtataaatttcttgctagttttttgtttttctagtgtgtatatttttacatagtagaaatgacagtgaaactaacttttgaattaaagttttaacacagttactgtattattataatgctaatagttttctagtagttacatattattcttttatatataatagttgtgacacaacttagggatcactttcccctttgttgacctttattatgacattcaccaaaagttgaaaatgtatgtttctggttaatttttaatttatattttttcatttgaaaaaatgtggagaggtctgtttttcattcaaaagagttcttttgaattattttgaccgatttattggtcaattttaataactgctctaagaattccctattttatttggtaggtaatggacaatgatctactgcctaatatctctagggcttagtatttttctcagtgactttgtgggttctttgtactgtaagattattaacactttattgatatttgattcagcatttgctccagtttgtggtttgtatgttgattttgaaaattcttttccatgttaagaatttgaacatttttatttaataaaatgtattgcaaaaattttattaatgatttacaatccatcttaaatctgccattttgtggtatttttgtctctaggtttctccttacttctaaaaacattgtatttattgagagtatgctaatgtcggggattttcctgggcataagcaccacaagtaatgagttccagaccctgccttaatccaaatgtgattctggaaagaaaaatcattttacaattggcctgataataattctgcttgtgttgcacgggggatacattgagcagctgaatgaaaatataagaactttcaaaactaaaatgacgctcctaaatccttctgtctgctttaggactcatgcttttctaggaacgtaaaaatttggagaatcatttctgtctgtcccaccttcccaggggcagaaccatttctgtggtgttctaaggtgtgagtgcatggcagtagtattcctaaaaattcatactcggttttctcatgtacccaactctgtccctttgtctatgtacattgctttaaatcatatttttctgtcacggtgtacaaggatgataaataggtgccaagtggagcacccaagtgtgatgagcccccttacggtggaatggagtgagaagctttctgatctcataaattgaaggctatcttcagtcattatgtattttacataaattaatcctcatataaccccaagaggtaaattagtataattatccttcattgggggtgacaaagttgagacacagaagaatcaactcttccaggatcaaccagtaaaaggcagaccttggatttgaaccatgcaacctggctcaggtatcagttttaattactacactctgtactttcaaaaatttgtaaacactttgacaatgcatgccaatttcaagttatgaagaagcaaacgcaatttttcacatctctcaaatctaatgggtcctcactatcaagattaaattccaggctgatgacactgtaaggccacatggccagctgtgctggaggcctggtcaaggtcagagcctgggtttgcagagaagcagacaaacagccaaaccagcagaattactctgtcttcctgactcattccctctacctttttttctcctagtccatcctcaggtgactgtgtatcctgcaaagacccagcccctgcagcaccacaacctcctggtctgctctgtgagtggtttctatccaggcagcattgaagtcaggtggttccggaacggccaggaagagaaggctggggtggtgtccacgggcctgatccagaatggagactggaccttccagaccctggtgatgctagaaacagttcctcggagtggagaggtttacacttgccaagtggagcacccaagcgtaacgagcgctctcacagtggaatggagtgagcagctttctgatttcatacatttctcacccaccaagaaggggactgtgctaatccctgagtgtcaggtttctcctctcccacgtcctattttcatttgctccatgttctcatctccatcagcacaggtcactggggatagccctgtaacagtgtgtagaaacacctgtactccctgtggaatcagtcatgctttttttttttttgaacctccccatgatgtcacaggtcagggtcacccgatctccccaagctccaggccctgcttctgggtctgagactgagtttctggtgctgctgctctgagttacttgttttgatctgggaagaggggaagcataggggcctacctgacatgaggggagtccaatctcagctctgccttttattagctctgtcactctagacaaactacttagcctcactgagtctcaggctttctgtggatcagatgttgaacgcttgccttacatcaaggctgtaatatttgaatgagtttgatgtcggaaccttgtaactgttcagtgtgatttgaaatcctttttttctcccaaaatggctagttattttagttcttgtggggcagccttcttccccattttcaaagctctgaatcttagagtctcaattaaagaggttcaatttggaataagcatcactaaacctggcttcctctctcaggagcacggtctgaatctgcacagagcaagatgctgagtggagtcgggggctttgtgctgggcctgctcttccttggggccgggctgttcatctacttcaggaatcagaaaggtgaggagcctttggtagctgggcctttccataggcttttctgcaggaggaaatagagctttgctgaggttagttctcagtatatgagtggctctgaataaagcctttctttccccaaacggctctaatgtcctgctaatccagaaatcatcagtgcatggttactatgtgaaagcataatagcttgtggcctgcagagacaagaggaaggttaacaagtaggggtcctttggtttgagatcttggagcaaattaaggaagagccactaaagttaatggaattacactggatcctgtgacagacacttcatgcttcatgggtcacatggtctgtttctgctcctctctgccctggttggtgtgggttttggtgttagaactctccggtgggagatctgggactgtgatattgtgttggaggacagatttgcttcaatatcttttaagtgtatatcttttcctctttttcccaggacactctggacttcagccaacaggtaataccttttaatcctcttttagacacagattcagtttctccagtgagaggtgaagccagctggacttctgggttgggtggggacttggagaacttttctgtcttacaagaggtttctaaatgcaccaatgagtgctctgtaaaaacacaccaatgagtgctctgtaaaaattgacactctgtggctcgctagatgtttgtaagatggaccaatcagcactctgtaaaatggaccaatccacactctgtaaaatggaccaatcagcactctttaaaatggaccaatcagcaggatacgggcggggacaaataagggaataaaagctggtcaccctagccagcacctgcaacctgcttaggtccttttctatgctgtggaagttttgttcttttgatcttcacaataaatcttgtgctcactctttgggtccgtgccacctttaagagctataacactcactgcaagggtctgtggcttcactcttgaagtcagccagaccctgaacctaccggaaggaacaaactcaggacacactagaatgatggtagaggtgataaggcatgagacagaaataataggaaagactttggatccaaatttctgatcaggcaatttacaccaaaactcctcctctccacttagaaaaggcctgtgctctgcaggactattggctctgggagactcaggaacttgtttttcttcttcctgcagtgttctcatctgagtccttcaaagagggggaaagaaacgttagtagagccaggttgaaaacaacactctcctctgtcttttgcaggattcctgagctgaagtgcagatgacaatttaaggaagaatcttctgccccagctttgcaggatgaaaagctttcccgcctggctgttattcttccacgagagagggctttctcaggacctagttgctactggttcagcaactgcagaaaatgtcctcccttgtggcttcctcagttcctgcccttggcctgaagtcccagcattgatggcagcgcctcatcttcaacttttgtgctcccctttgcctaaaccctatggcctcctgtgcatctgtactcaccctgtaccacaaacacattacattattaaatgtttctcaaagatggagtt

SEQ ID NO: 38072 - DNA, 507937 bp, Homo sapiens; identical to SEQ ID NO: 37848

SEQ ID NO: 38073 - DNA, 405672 bp, Homo sapiens; identical to SEQ ID NO: 37013

SEQ ID NO: 38074 - DNA, 13385 bp, Homo sapiens; identical to SEQ ID NO: 35939

SEQ ID NO: 38075 - DNA, 111623 bp, Homo sapiens
cctgttcctcttaccctgcccggctccagctgacccgggaaggggtgggctgaactgaggcgggggcaagggagtgcccgacatcttgtccgactccgcgggtgacacgagccggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactgtgagtgaagccgaccgcggcccccgctccccggcgcccgcgcgacccgcgcgcgtccttctctctctctcttgtctttcacccttctactgcctcttccctccctgcgtcttctctggcacggccggtcctgtgcccgttgagctgtgttcttttgcttccatcacacctgccttcacggcctccgctccccgtctcaaaatctgacaagccactcccctccctattcctaggggaccctcgtctccctgcccggtgcgctaccacaccccatcatacccaaccaacttgcttccccacctggcttctcaccccctacccgtctccactgcagccttctgctcttccttcccacccgtccggtgccgcctcgtcgccctcgtctgagcgtctccaagccccattgtttcttcatcagcctccttcgggtttcagtaaacgcctggttccttgcatccagatccttgttatccctccgggctgcctccctggaagggatcccccacttcctttgctccactagctgcttcgcccatcccttcctggctttctgttccaccttccctcctgcttttgggttaccttttcatcgcctctatagtagcttcagtgtagtttcttcgactcattttaaataccatacccagttacccgacttttatttcagattaccttctttgtgggagtgaaagtaaaaggattcaatttggtgtagggaaagctttctggaaagttgggatttttatttgcctctggtggaatttaatcgttgtgttgtccatacttttgactggggtgagtttgtgactgtcagctctgccccccagcttttcacatggggatatggaaaaaggcattttgctgatactcttatcagttcctggaactgttaattctggcggcttgaattcagaagcttgagtgttaagcgtagactgttggaattccaaatggattaataaatttacttacaaataacatacatcccttaaaaaaattggcaaaatgatgtttgatgatgcttgagtttggatgttttaattatgccagttaccttttgaggaactagctttagcttctcttacacgacatagtattcgtccattcgctaacgtagatacaattagtagagctaactcctcgtaacttttttctaacctggaagtcacctgtaataccctcctttttctttgcgctcttttaccccagggtacaaagctcattggatcactcaagccaatggagcttagacctgaaacttttcagggaaaaatagggcaatagtcacgataagtaagttccctttttaaatgactggacacattagtctgactgactttcatcatacatgaaagttactttgttttactgtttgaagcaagagtgagcatgccctgaaagataattcactgtctggaagcctgttttgatttctcatttggactttggccgtaaagtttgcactttaaaaaaaatgtacgaaatgtagattcttccaagttactgtgctcatgaatgctgttagaacaagtttttgctacacagaagcctattattctttgtgattgttcctccactgtggaaaaaagttttaaataaaaaagcattagtgcttgattctttcagatatgcatgcaggctgcttttaaactctcagtccttgcttgtcttagagaatggagaatatgtttaaatggtgacactcttatgaacagaaaactttttaaaatgcatcgtaaagccatatgtgattttttgattatctgatacgtgtagtagacgtttctgctatttacggctcttcaaatactacttggtttgccctaccaaatcttacagtttgtcctgacactgtgttaattcttttgttagttgcttttggtttttttttgttttttttttttgtatgggagtatgaagaaactagttgtgactgtgtgaactattttcctctttcctcattcaaaataagaatcgataaggcttttaaaagttttttttgtaaaggtttgtgtcttatttcaaatgtagcagtggttcttttaaagcattgtcaaaaagaggagaaaataggtagggttagaagagtgctatttgcatgttgtttcataaatgttattagctatttctcttgttatagccactactgcagatagatggtaactgggattaggtttggaggataatcttgcatttgtcgttctttttctctaccacttctgtgtttacaagctcccacgtttttggaacttgaatatacctggtagtatttgatttaaaaatatatgtgtcgttaatgtgcttctgtttcttttcaatgaggttttaaaatacagggatactattttccctacattgttgattaaaatgtcctgtaatcagttctcactaataaaatacctttatcttaggtaaagtctgaccagtgagtggtttactaaacaaataccttccttgcacacactaacatgctttgagaaaattaaaaagtcttctacggacagttcatggtgttgacatcatgaactttaggctttaatacagaaacctgtcatttcaagtaattttttgtcttttaggaatttttctttatagtgaaagcttagtttatgtgcaccttttaatgcccctagcaactgatgcttatttatatgaatctaatgaaaatgatttcattttaaaatggcagcatttaacaaaaaatatgcttaggactgttgtttttcgtataagcccttagagtgtggaggtggtttctgtcagtttctcgccaagatctttccacattaggaagtgattattaataattcatgaattatggcttaattcatactacattatatacttactgaagaaagatttttttgctttgcttatactgtaggtgttagtggataatagtgttgactagcatccctagtgtgaaagagttgtcaaacttgaaatatgtttgtaaaaataaacacgatttccgtttaatcttaggcctttagtagccataatcaaggtagaggaatagcagcccttatatttgaagaacttcagttttccaggcactttctcatcatctcatttaatcctgtctcacagctggaggtgggggcaattcatatacatagaaagtagcttctaattccatttagcagtacagaatgcttaaaagaaccataattattgcaggatagaaaaaacaaattttttttttttttgagacggagtctcgctctgtcgccaggctggagtgcagtggtgcgatcttggctcactgcaacctctgcctcccaggttcaagagattctgcctcagcctcttgagtagctgtgactacaggcgcatgccaccacacccagctaatttttgtatttttagtagagatggggtttcaccatgttggccaggatggtctggatctcttgaccacatgattcgcccgcctcggcctcccaaagggctgggattacagacgtgtgagccactgtgcctggcccacaatttttaatttataacttcttaatataaaaatcatttttatctgatcttacaatctttagtcttaaccccacccctttttttggatacagggtcttgctctgtctctggtgtgcagtggcaggatcatggctcactgcagccttatcctcctcaggctcaagaaatcctcccacatcagtctcccaagtagctgggactataggcatgtgccaccacgcctggttaattaaagaaactttttatttttggagagatgggggtctccctatgtggcccaggctggtcttgaactcctgggctcaagtaatcctcttgcctcagcctcccagagtgctgggattacaggtgtgagccagcatgcctggcccttatcctattttttgatatgaattcttaattttctttattcttatttactatcgttggacatttatattttgacatatttcactgaaatgtaatatttatactaatggctgtaatgtctccttttttttttttttttttaaaatgaggtgggtcttactctgttgcccaggctggagtgcagtggtggaatcacatctcactgcagccttgacttcccgggttcagacaatctttctgagtacctgggaccacaggcatctgctaccacgcacagctaatttttaatttttatacagacagggtctccttgtgttgctcgggcaggtctcaaactcctgggctcaaggatcctctctaccagctgagcctcctaaagtgctgggattataggtgtgagtcaccatatcctgtatgtctctgttttttaattcatattttccccagttaatttacagggacatttcatttcaaccactgccttatcttttctaaaacaaaatcaagatcaagttcttactaagcatccattatcaacatatctctggtcgatacagcatggttatttgtatgttgtgaactggatctagaaattggaaataagtttttaaaaagtaggatttgaatattttgcatatgtagaatttgtatttgggctagtggtttgtgtaactacattaaaaatgcgtataacataccagactgtacctgaattaattcccttttaaagcacaaatggtttttaatgtctcagttaataatatcttatgggtgcttagtttgcgtattgtcaagaaggatctggtaactaggatgtgatttctaagaagatgcatgtaaggaagaaataaagtagaagatctgtcccaggatatcttttatttaaaagtaaggtaactgggactttttttttttccaaaaggatcttgttttaagaagacagttattttgtaattaatgtctgggcttcctattctttcctgtaagaattagtcatatgatttatattttcatttttcattatccttactagtcttttagtagttttgcaatacagaaaatagaaatagagttatcaaagtggtagtaatgagtaagatttgatcacacatgtcaaatgcctgaggcattttatttatttttattttttctgtcgccatggcagaacagaatgcctgaggtatataataaaattcacaaatgtatcctttttcctcccagatatgtctagttaagtttctgaacagtatgtgttttaaaagaggaactctaaagagaacttaatattcaactattttttgtagccgcttattcataattagcaaatgaattctgaaatacttttgtaattattgttccctgatggatttatttgctatgttaagaaatagtataagactttgggcatctatataccttttgtgtttactgaatattttatatatctggataatttttaaaggtgtctttgaatttaaagttactatggcaggtgagaagtgaaacacttcataagatgtgattgacatttttctttcatacgctttgtgagacatttatatgaaacatttactttgatgtttaaaaaacactgattgtttaaaaataatctattttaataatcagaattgctttcatttaaaaatatttgtttatttggccatgataatcatttagaatagttaatgtgaaagttcaccgtagacatagttgtttctcctttgttttcttcagctctgaaatggttaatttcatggtttctcacttaaaataaagaagtaagaaaaataaacttacaggcttcttggcaagaggttagagccctaccaggaagaagtagccttagactttcaaagtaaagtcttagtatttgctcttcctgttcttttggtagctaaagtggcatttccgttactttgtgttctgtcttagtatgttcccagttaaactgctttatacgtttctctagagaatcaaaattttggacttgaccttttagtattttgtatgttcactgtgtatgtgaatcattttgggcagttagatagttctttaaaagagaatcttgatgaacctaagcctttgtattaaaaattatgttcagagttgtgatttgttagattatcagaaaatgaaggatttctcaagttatattattatcaagatatattatatcccccacgaaagtggtacatttgttaaaattgatggacctacattcagacatctttaccacccaaagtccatggtttacattagggtttttttttttttgagacggagtttcgctcttgttgcccaggctggagtgcagtggtgcgatctcagctaactgcaacctttgcctcctgggttcaagggattctcctgcctcagcctcccaaatacctgggattacaggtgcccaccaccacgcccagctaaatttttgtatttttgatagagatggggcttcaccatgttggccaggctggtctcgagctcctgacctcaggtgatccacccacctcggcctcccaaagtgttgggattacaggcgtgagccactgcgcccggccaaggtttactcttgctgtttgtatgttctatgggtttggccaattgtatggcacatatccactgttgtagcggtacaatgtttatctgccctgaaatactctgtgctccccctcgccatcccttctcttccccagccactggcaaccactattttttgttaactgtctccatagttttgccttttcaagatgtcatagttggaatcatacagtctatagccttttcagattttcttttttcacgtactaatatgcgtttacgatttcctcaatggcttttcacggtttgacagcttttttttttcttttgcacttgactattctattatctggatatacccgggtttatttgtccatttacttactgaaggacatcttggttgctccctagttttggcaatcgtgaataaagctgctataaacatcaaacatctgtgtgcgtgtcttttgtgtggacataagttttcagttcgtttgggtaaatagcaaggaacacagttgctggatcatatggtaagaatacctttagttttgcaagaaacctctaaactgtctttcaaagtgatggtaccattttatattcccaccagtaatgaatgggagtttctgttcacattctcaccagcatttgatattgtcactgttaatgggttttggccattctaataggtgtgtagtggtattgttttaatttgcattttcctgattatgtgactttttttcatatgcatactcgccatctttatatcttctttagtgaggtgtccgttaaggtcattgtcctgttcttaaagtcaggttctttgttttcttattgttgaggtttgagagttgtttattttgaataacagtcctttatcaaatgtgtcttttcttttctttttttttttttttttttttttttgagatggagtcttgctctgtctcccgggctggagtgcaatggggccatctcatctcactgtaagctctgtctcccaggggttcaagtgattcttctgcctcagcctcgcaagtagctgggattacaggtgtctaccatcatgcctggctaatttttgtatttttagtagagatggcgtttgaccatattagccaggctggtcttgaactcctcatctcaggtgatccgcctgcttcagcctcccaaagtgttgggattacaggcatgagccactgagcccggctatcaaatgtatcttttgcaaatattttctcccagtctgtgccttgtctttttcattctcttgacaatgcctttcacagagcagaaaattttaatcttaatgaagtccagtttagcagttctttctttcatgggtcatgccttcatcattgtatttaaaaagtcatcaacaaactcaaggtcatctagattgtcttctatgtcaccatttgggagctttataattttgcattttacatttaggtctgtgatccattttgagttaatttttgtgagtgtaatgtctgtctcctgattcattttttttttttttgcctgtggatatctagttgtgcagtactatttgttgaaaagattatctttgctgcattgtattgcctttctcctttgctggcagtggttcttaaggtgtggtctggggacttttgggggtcctcaagaccatttcagcaagtttgtgagttcaaaactgttttcatatactaagacattatttgccttttctatttttattctttcaagaaccactgtacagtggagttttctagaggctgtgtgatgtgtgtgtgatattgccataggttgaatgtagtagcagataatgataattcaactatttcctattaaaccacaaaatagagttttgccaaaatgtgaaacagtgccactcttctaaattgtggggttttttgaaaatactgttatttttcaaatgaattaatgttgataaatttatcagtttcagtttctaacagtaaatattggtagagaacccccacatgaaagctcttggctcctcaattttaaaagtgtgaaggttctgagactaaaaaaatgcacctttagggatgagtgtgtattagaagggacaaaagagtactcaaagaggaactagatctaagggatcctttgaattctcaaagtaattttggatttgattttgtaggtaacagtgcctcaacttttggaagatttcaagcaagagatgtggtatcataatccctatgtccactttatgtccataaatagattggaaggagtgttcagtatgacttggaaaggaaactgctggggcaaaaaagtcttaacaataatatttaaatttttttcccaaaggccttaaaaattagttattaattggaactcttgattatttgtcctctctcttttttttttttatgtcaaaactatccttttttgtgaaagttaggcaggttaggtatcaattgtgccaaaagttcttgactaccaaaccgttagcctttgcacatatgattccttggactaaagacagggtctggctctgtcacccaagctggagtgtagtgtcatgatcatggcttactgtaactctgaactcttgggctcaagggattctcttgcctcagcctcctgagtaggtaggactacaggtgtgtgccaccatgccctgctaaagagaaaggggtctctttcctaggctggtctcgaacttctggccttggcctcccaaagtgctgggattataagtgtgagccaccatgctcggcctcttttaaactgtctttaccttgctcccattaatattcacatttaaggtaaccgctttcataaaaacatcactgaataactccccctggtcctgtcagtccagcattattctcaccatttatagagtttcaaatattgttaaactgtagtggctatcttgcttttatgtattttgggtttatgcacatttcctccacagaataggaattgttttcggtattgttctctatctcttctccaagtacctagtcagcaaccccccatgggtgctcagtaaatattgaatgattatacttaacctcccttcatagctcagactattccatgaacaatttatggacataaaaatctatgccagtagacatttaaggatattttttatggtgactatggaaattgcctggttacaaatttatatatagagtcagtaacattgataaaaacataacaaattactgtttcatggaactcatgaggcattaagaggcttatttagttttgtttagatacaaggtagtgtcttccaaaacattgttacttcaaaatttttgtagctgctccagttgaacactatattaaaatgcacatttttgaggacatattcttgaaattaggaatgtaatttttaagaattaaacagaggaccagaaatagatctgaggagtttatcagagctgcttccttgcacaactctagaaggtgcctgtcacacctttttgtatgaaaggtgcctcctagagtataactgtacagtagactcatttttgatataagaagggataaagcacacttaacagatgatatcaaaatgtaaaagaaaagaagtgtctgttttagaaggaagctgtatgagataataggcaaaggttagggtggtggtagcaatggtggtaaaaataggatcacttaatctagattacttaatcagtaagttgattccaggggccagtgggaattgctgaaagtttcatctgaatacatggaatttttagcagtgattaggggaatggtgctggtatttatagccatgaacttattacttgaaagcatcctagggacccaagtcttaatcaaggggcagttcttccaagtagtggttgaggaagttgggtatgctttccaaaacttctttcctcactaaagattgcagatatactctgtaagtgacttcacagaatatactcaattgtcatattttaatttacatgtttcttctgattataggtcccacgtgattataagttctgagatcaagggtcatctttgtgggggtgtgtgtgtgcacttaaaattttatgtgctggtaatagttatcttgtggatatttaagaaataggaatgtgtgccatattttaaatacaccttatatgcaaaaattttaatgtaatttaagtatatcgcaaaaaataaatagcgggtggtattcacactgcagaggattggcaagtctttttaatatacttcaaacaattgttggcagaaatccgcctcatgcactgtattgaataatttgaaacattagcatttaactaatccaaagctaagataaagagattttgaggtgaggtgataaatatatgcggttgtccttcagtatctataggggattggttccaggacctcccacagataagaaaatccaagggtgctcaaatccctgatgtaaaatgacattgtttgcatataacctatgcacatctcctgaatactttaaatcatctctaggttacttaaaatgcctaatacaatataagtgctacataaacagttgttatactgtattgtttagggaatgatgacaaggaaaaatgtctgcgcatgttcagtagagatgcatttttttggtatattttcgattcatgattgaatccatgataatggaacccattgatatggagggctaattgtgtgtacatacacacacacacacataattttttattcattatttatttatttatttatatgtttgtttgtttttgagatggagtcttactctgttgcccaggctggagtgcaatggcacgatctcagctcctacaacctctgcctcctgggttcaagcgattctcctgtctcagcctcccgggtagctgggattacaggcgcgagccaccaggcccagctaatttttgtatttttagtagagacggggtttcaccatgttggtcaggctggtctcaaactcctgacctcgtgatccgcctgcctctcggcctcccaaagtgctgggattgcaggcgtgagccaccgcgcctggccccacacacataattttcttttttgcaattatttattttttttcccttttagagtacacatttttttgcaattttaaaattgagacataatctacataacataaaattcagttttaaagtagagaattcagtgttatttagtatgttcacagtgttgtgtgcaaccatccccattatgtaattctagaacattttccatcacccaagaaagagatcctgtatctgttaacggtcactcctaagctctcctcggcccccctgcaaccattaatccactttctatctatgaatttttctgttctgtacatttcgtattaatggagtcatacaatatgtggccttttgtgcctggcttctttcagttataatgttttaaaggtttgtccttgtagcacatatcagtactttattcatttttataggtgagtaatactcccttgtatagttacccacatttcatttataccttcattagttggtggacatttgggttgtttagccatttgggctgtgaagaatagtactgctatgaacattcacatacaagttttcgtgtgaacatattttcagttctcttaggtatatatctaggagtaaaattactgggttatatggtaattctgtgtaactttttgaggaactaccaaactgttttccacatcagtgacactgttttacattcccatcagcaatgtatgaagattcctgtttctcctctactttcttgccaaacttgttattttcaggattttagttttatgatttttaaaaaatagtcatcctagtgggtgtgaagtgttatgtcattgtgattttggtttccatttccctagtggttaatgctgtttagcatttctttatgtggttattgactatttgtatatctttgggaaaatatctattcaaggtcttttgcctgttttaaaatttgatctttatgtattctggataccagaagagtactttacatacctcacatactagatctttatatgatttgtaatttttttccccattctgtggcttggcttgtcactttcttgatacaatgtcttttaatgcacaaaagttttaaattttcaagtctaatttttcaagggttttttctttttttttttttttaaagacagagtcttgttctgtcacccaggctagagtgcagtggtgtgatcttggctcactgcaacttcgcctcccaggttcaagtgatcctcccaccttagcctcccgagtagctgggactacaggcatgtgccaccatgctggctaagtttttgtatttttagtagagacagggtttttccatgttggccaggctggtcttgaactcctgacctcaagcgatctacctgcctcggcctcccaaaatgctgggattatagacgtgagccatcacactctcacccagcctctgattttttcgattgtgctttcgatatatctaagaaatcattggctgattcaaggttatgcacctttacaactctaagagttttaggaagaaattttagctcttagatttaagattgatcaattttgagttaacttttgtatatggtatgaagaaacacatttgtattaaggaaaaccaaagatatttgggtttttaatcttttgaagttgacatggaatacaactctactacctctgtgtaatgtggaaatggaattgtgcaggagaaaaatgttacttgatggcaatctccatgactactgggtatagtttggtgatggataactggaattatttgggtcattctttcagctggataaaccacttaatctgatccagtttatattttttacattttcagaatagtcttagatatatgaagaaggtaacaaatagttgcatgactatcaataagttgttttggtccacaaataatagtgtcattgtatgtttccatggtatctttttttttttttttgagacggagttttgctcttgtccaggctggagtgcagtggcacgatctaggctcactgcaacctccgcctcctgagttcaagcgattctcctgccttagcctctcaagtagctgggattacagacgtgtgccaccacgcctggctaattttgtattttagtagagacgggggtttcaccatgttgtccaggctggtctcaaactactgacctcaggtgatccacccatctcagcctcccacagtgttgagattacaggcattagccaccacccccagccagcaagcaattttttaaaggtagatttttgccaacatttaaaaaaaatcatattttttttggagtgctaaggaaaaatggtgacagtccagaaaatattataaagatgagtgggccaggcacagtggctcacgcctgtaatcccagcactttgggaggccaaggtggatggataacctgtggtcaggagttcaagaccagcctgaccaacatggagaaaccccacagcctgagcaacaagagtgaaactccgtctcaaaaagaaaaaatgagtgacacttgattcttaccttaaaaggagcctgagatctaatagtgtaaaatgtgcaaactaataattgattataatacattaaggtaaatgcataataaatttttacataaagatcaaagtaggagagagtaattaactttgaaggaggttagtaaagacctcacagaggggaggtaacaggaactttaaggatgaatggtgatttgcagatgataagcagtgacatggggcaaaaaagcgctttatggtgtgtttgtgggaaactgaatagttttgtgtggtagaatgcaaagtgttaatgggagtaaggggagatgaggctggagagggagctcttaaaggagcaggacttgtcttgataaactctgggctcttcagtgccatcctccgtcttcattttagagccctcctttctcccatttattagctgcttccctagctttagataccagtgctgtgaaactagcaatgtattttttccttttcacacatagtttgtagtgaggttgttgagaaagacaggaaagaaggaatgcatgattctgttggcacatgtgcagggggctaaatataccttgccacccaaaattggacctccgaatgttgttatacatagtgtttggctctccaaataagtaaaatcaggcatactgtgaactcatggcttttgtgggcttgtctgggaattgagcttttattgagttccaaatttatgaatgaacttaacacaaactatcttattgggtgatagtatgaataaataagatttgttaaatcagtttgaagtcagtaagaatcttcgtggcctgtttgatttaattagtgacttttatatatctgaaaatgatatattgtcacttgtgcatttttaaagctggatttctaccaaacaaggctttgttagtcttggatgggtgctttggctcatccctgtaattccagaactttgggaggccgaggtgggcagattgcttgagtccaggagtttgagaccagcctgggtgacatagtgaaatcccatctctactgaaaatataaaaattatttgggcatggtggcacacacctgtagtcccagctacttgtaatgctgaagcgggaggatcacttgagcccaggaggcagaggttatagtgagccgagatcatgccactgtactccagccttggtgacagtgagaccctgtctcaaaaaaaagactttattcgtcttaaggaaattaatatgctcattagcattacatattgagtcttgttaaaataaaactttagacaaattaaatttggcagttaatttgagcaaagaaacaattcatgaattgagcagcaccctgaaggagtaaaggttcagagagttccacccagcaatgtggatagtcaggatttatagacagaaaaagaagtgacatccagacatagtctgattggttacaggtccacgtttgtgtccacgtttgccttatttggacatgtctgagcagcttgccgcttgtgattggcagaacgcttagcctcgttacaagaatatactcgagttaggttgcagttttaacatactgaggtgcagttccctgcttatggaagcagctttaggccaaatttaattaacagtgtcactattcaggttgtgttgagattattgtgaaacactaatctgtcctcagtctagtagggtagatgacgtatgcagatagctgtattgccagacaatgtgagataagtacagatcaaatgatgttaaaaatcagataagagagatactgcttttgataagggaagataactggaccttaaatgataagttattaggaacactaggcatttcaggtggaggaaagagcatgagcaaacatttgtagacaggaagctgaaattgtgtttgaggaacaaagagatttgtaaatggggtgcttttggactgtgagagggacaggttgggtgcaatgagaaatacagtcggagcaattgtctgaggctagattgtgaagggagtatgacttttaattatatgacctttagatatagctttttggctactgtaggtcaagttggaccatagttagagccaatttttcaaaattacactttatctgtagtttctgctgccagtgtgaaaacaggaaaggcaaggagttttgctgatctggaagctgagatgagattttgctgcttcaagtttttgtattaactttattatagaatgaatgaatggtggcaattactgaggtttggggatttccgagtctctagattgcacaggaatcattgaagaagtcttctcaacagaaataatgtaaacctaactttgatctgaaggaagaaattttataaaagaaaggaaactttcagtcttcagggattcacaaagtctgataaaaattggtgtattagtctattctcgtgctgctatgaagaaacacccaagactgggtaatttataaagaaaagaggtttaattgactcacagttctgcatggccagggagacctcaggaaacttacaattatggcagaaagggaagcaaacatgtcctttctcacatgatggcaggagagagaagtgccccttataaaaccatcagatctcatgagaactcactcactatcatgagaacagcatgggagaaactgtcgctatgattcagttatctccacctggtcctgtccttcacatgggtattattacaactcaaggtgagatttgggtagggacacagagccaaaccgtttcagttggtttagttaggacatacaaaatggggagaatagctaacctttaaggaaacctttctatgtcttgggcaattgacatgcattgttaacacaatgtttatacaaacctattcatcagatagtcttattggctttattttccacatacttaaaccaaaacactattagtaagaagacatagagaataaatctgacatttagatggcgatgaagaaccttgactagaggtcaggcaatctgaaggggagcttcttagctcacagaaaacttatatggaatgagatatagataggagagagcttttctttgaggaatataatttatgtaaatatgtaagattacattttgagatgtcaactttctatactttttttcttttctttttgagatggagtctcactctgttacgcaggctggagtgcagtgtcgcgatgtcagctcactgcaacctctgcctcccaggttcaagtgattctcctgcttcagcctcccaagtagctgggactgtgagtgcacgctaccatgcctggctaatttttgtatttttagtagagatggggtttcaccatgttggccagactggtcaggaactcctgacttcaagtgatccgcccacctccatctcccaaagtgctgggattacaggagtgagccaccactttatcttaagataaattttccatatgcttcaagaggagtaagctctaactggaatgtagggtactgaccctagctccatatgacctcacaaaaatctgttactaaaatagtttattttctaaattaccttcttactctgttattctgtgatgctataattgtgctcctttagctttttttgttgtaggcttggtcctttggaaacgaataccagaaacagtttctctctgagcctttgcttcattctccatcagagtattctgtcccatttactactatatcattatttgaaaaacagtttgaatttgcatatcttattatcattggtaggaataggtggcattgtcttatgtgattcttgttttaggaggaaatgggcaacaaaaatgtgaattttcagctgggtgtgttggtgcatccttgtagtcccagctactcaggtgactgaggtggcagtatttcttgaggccagtagtttgaggccaccttgtacaacatagcgagaccacatcacataaaaaataataacaataaataatttttttccagtgtgtatcttggatgtaaaaaaaagggagtttctttctacctttattaaaaattgtcttatatgtgttgcctgttgttcatattgggggatcagctgagggtgtgtaaggagcatcactaatccatcaccatttatgttctaccacagtgacataatcttaaaattattaagtgatgaattgatggataattgcttcaccttatttttatctcttcattttaattcttcagaaacacagaaatgtaaacattattattgttgccaggatccttaatttaatttgcatgatggaaggactgtgtttcttaaattatatgaatgctgtgtatatgtattgtagaatggggaattgcatgtatctgtttaatattagaaatctgtaataggtcaaggctgcatcagtttttgtggctgtaattgcttgcacatttttggcttataaacttttgtgtaccagtgacaaccattaagagccagaaaagtttgcttttacttgcagtacatgtacatctagttttgagttatttgtcaaaaaagggtgaactttctttttggctttttttttgggggggccttttgtgacttgaaattaagcaacttactgatatagtttttttttttttttttttttgagacagagtcttgctctgttgcccaggctggagtgcagtggcgcgatctctgctcactgcaacctccgcctcctgggttcaaggagttatcctgccttagcctcctgagtagctgggattataggctctcatcactacgcctggctaatttttgtattttatttttagtagagatggggttttgccatgttggccaggctggttgtgaactcctgacttcaggtgatccacccacgttgacctcctaaagtgctgggatcacaggcgtgagccacctcacctggcctgatgtagtttagaataatctttagttgtgtccaatatgtagttttacctagcaaactcgttttaattgttggtacctttttttttttttaacttctctaagttcatctaccttcagattgcatctttggaaggggatgggcagaattttggaaggtagcagttctcttagatgaatagaaaagaggccaggcatggtggctcacgcctgtaacccctgcactttgggaggccaaggcaggtggatcacctgaggtcaggagtttgagaccagcctggccaatatgatgaaaccccgagattgcgccactgcactccagcctgggtgacagagtgagactctttctcagggaaaaggaaaaaaaaagggaaaataaaagaaaatgaatttctccaattaacagttactggctttatttcaggcgagctgtcatgggggaatttgtctggttttgagatataagatcagtgtgaagatttattgatacatacaaaatggagtgggttgctctgcaatgaatttgtgtgttaaaactgaatatcaaagataaaataagttaactggatagttgcatttgatcttttggtatggaaccggagtaaagatctgatttatgtttttttttgtttgtttttttgagacagtcttgctttgtcacccaggctgcagtgcagtggcacaatctcagctcactgcactgggttccagtgattctcatgcctcagcctcccaagtagttgggattataggtgtgcacccaccgtgcctgactaatttttgtatttttagtagagacgggcttttgccatgttggtcaggctggtctggaactcctagcctcatgtgatccacccgccttggtcttccaaagtgctgggattacaggtgggagccaccgcacccggccctctgatttgttctttacgtggtcactttgcctcccattttcagaattggaagatatacccacattatccttattcccatttgtacatttccttattgaagtaaaaccagctgtttaatgactgaaaagttacagtttagcaggcagtaatttttttttttttttttttttttgagacggagtttcactcttactccccaggaggctgaagtgcagtggtgctatatcttggctcaccgcaacctctgcctcccaggttcaagcgattctcctgcctcagcctcccgagtagctgagattacaggcatgcgccaccacgcccggctaatttttgtatttttagtagagctgggatttcaccatgttggccaggatggtctcgacctcctgatgttgtgatctgcccgcctcagccccccaaagtgctgggattacaggtgtgagccactgcacccggcctatttttcttttattaacattagctttagtaatttttcttcacagaactatgtatttgtgtatttgttgtcaggtttggaatttgtgttggctatcaatttaatataaagtcttagactttatagagtataaaccctcatttatttttgttcatcgtattcttgcaaaatactgttttgacttggtgacctagagtggatcaaggcactatcttcaagtggtttctgtagtagcctaacctagaaacactgcctgacatagctgagtggcaatgaaaaacagccataggtactaacttaaaaattagctatagaattgcaactggcagctaagttagaaagctatttatagagcagcttgggatactaagatactccttgactgcatgaaggtgcagtgcaaggagagaaccattgcttcgcatcaggagattggaaaccttttttttttgagacggagttttggccttgttgcccaggctggagtgcagtggcgggatctcggctcactgcagcctctgcctcccgagttcaggagattctcctgcgtcagcctcccaagtagctgggattacaggtgcccgccaccatgcccggctaattttttatatttttagtagagacgaggtttcaccatgttggccaggctggtctcaaactcctgacctcaggtgatctgcccgcctcagcctcccaaagtgctggtattacgagtgtgagccactgcacccagccggaaacgttttaagagagaaacttactaataagttgcttcctgtccttgggcttatagacttaatctagaattgatttttctttgactttcttcatcagagttatattttcataacttaatgactaaccaagaatgtgttataactgttgaggccccttttaacgtagtttaccccttctgctattacttagaattgatagtaattacatctctagggcaaaagatgactggaaaattgctttgtgttcttctcatgtaacatcatataagacctgttcacctaaaatctagtgagttgatttagtttgttctctgacattcttggcttctttaaacttgcttataaattaaggcttgcagtttgagtcatttggaaatgggcaatgcccagaactttcgcaacttgtgaacttgagttgaataatgtgtcgctttcctcatagtctgtcaactttagttcattgtagccacaaagaagatgattatgccaatgaggattatactaaaccagacaagaggtggcctactgtgtatactaggaattagatttgtgagaactaaacacaacactgaatttgtgaaaatgtgtgcagtttagagtaattagagaaaatgataagtctcactcagaccacatggaaatgggggtagagtgtgtgtgtgttgtggatgtgtgtcttcatctatcctgctagtggaaaggttactgtttgaaaaatgtagttccaacacagccactagtttgtgctactttagacaagtatttaaatctttgcaatagagatattataatagagcattccttgccttggcacaaggctgttgttaaattggaagactaaggatatgaaagaattttgtaatgtataaagaaatcttggccaagcacggtggctcatgcctgtaatcccaacactttgggaggccaaagtgggaggatcacttaaggccaggagtttgagaccagcctgggcaacatagtgagaccttgtatctacagaaaatttaaaaattggctgcatgtgctggcatgtacctgtagtcccagctactccagtctgggtgacagagtaagaccctgtctttattaagaaagaaagaaatcatatgtgcattataaagattttgccactcttaagattgagtgcaaggatctatggtaacacttcccagttgatgaagaaattgggcattagataatgaaggttttgcagcagtaattgagtttgagctattttcatgacagtgtattggaaaggtgatagaggagttgtctcctaaaatgagggaaaacatcaatacaaaatgatggtaagaaagaaatgaaaatatttgtaatgatgctttaaagctttagggtacttttaaaataccctaaatatatcaccttactaagccaagatgttgtgaaaattaagtattagtcctattttttaaatgttgaaatggaaactgagtgactaattaacatgcctgaaatcacaatggtgaatcatgaatctcgaatttgattctagattttttttgctcattctgatgtgttggttagtcttgttatagtacagttgtagcacatggaaatggatgggaccatgcatggaagccagagagtctagagcagaacttcagtgatggcaaattaaaatcttcattatcagtatttgaagcagatattgaaaatgaatagctcttaggacagactatcaaataaatgtgagccagaagatttttaatgggagaaattaactttaatgaaatatcttgtagaaagagttaaaaacaagatacctgccaatcccagtcactctggagagtatctaatgtagcaatgaaagtaaaaactagttaacattctccagtgtttgtcaagtttaggaagagattaacttgaaaagctgtggttgggtagaaggtttatttgaagatcgtttggcatcatagcaaaaaaaagttggtgaaagattggtactgtagaatgatgggagaaagatgattaaatttcccttcctacttgtctagaccacttaaaatgtatattactttctcacacaagccaggataaagatacactctttaagaaatttaggagactcttcatatatccattcatagatagaatgtggttttgaaaataaatgggatattgtataaatatagatctatataaaattttataattccttttaagaaagacatttgtcaggaagtaaaattgtcagactttttagtgctgagaaataggaaataggtgaatgtgggttatatggagtcttttttttttttttttttttttttttgaatttcaagacagggtctcactatgttgcctaggctggagttcagtggctattcacagttgtcatcattgcatactacagcctcaaactcttgggctgaagtgatccacccacctcaacctcctgagtggctgggactacaggtgcataccactgtacccttctaggaatcttataagaacaggtgtatggttatgaggtgtatgaggatagagatattttttgtcctggtgattatttcttcttgtagaataatcctggtgatttttccttcttgtagaaacttaaaggcgtaatattaaacttattaggaaaaataactctggctttattttgtagtgatttattaatggctttattttatagtgatatattaataatgtattaaaattgctcatattttccacttagagagtattatttcaaaatttaaagccatgtagataggttattatttggtgctacatccgccattactgcagttggtttccagcagtttgaaaaatgatttttcagaaatggctttcacttgttactcagtggcttacagcaacggtccccaacctttttggcaccaaggagtggtttcatggaagacagtttttccacagactggcagggggtgtgtggagggatggtttcgggatgaaactgttccacctcgatcataggcattagattctcataaggagtgcacagcctagatcccttgcatgtgcagttcacaataggggtcgcgctcctatgagaatctaatgcccctgctgatctgataggaggcagagctcaggcagtaatgcttcctagctcaccagctactgtgtggcccagttcctaacaggtcatgagccagtaatggtccacggcctgggggttgggaacccctggcttacagggtcttcacatgcttactagctacagttacgtcacttaatcgtgtaataaatggctcgtgtaattttgagtcacttaaagtgatcagattgttttaattgtgaagcatgtgaataaataaatgagatttccaccgtctggtactatatacgtaaaactagaggctttgcaaaattaccaagagacgatcccgtttgatgtgtctttggtttggcacaggtggagcagacatgtgagatatagaatgaatgggaggccttcacacttactcactatgtggaaggtggtagttgatcatgatggtcagttccataggcctccaggccactggtgacacactaccactgttgccataattcttaaaagtcattttatgtggggctccttcctagcaacctccctcaaacacatagctccatcccttccaagagctaagaaatttttagcacttgccaccatctatttgttcatttgtttactgattacattcctcccattagtatataagctccgtgataatagaaactttgtccactattgtatatttctaactcctaagacactattggcgtattatagtatgcagttaatactagaataaatgggatttctgtttgttcttactgaggtttgcaaagcttcatgaaagtggaatataaagattctcgttgttctgtgtgcattggggacatggaacggaacttgtgttttctgagtgagggagcctctggcagagagtctaactgcaatccattattccctgtgactgggcagaatttaaaaatttttaagagaagagatgaaaaatcttctggattcctacttaatttagacatgggtttggctcttaacgaaaaactttaacctacctacagggaaggctttttcgctgttacccttacttctgtctcctggatcttatgagtggagaaatgagcctttgtttcacttacaaatccacaaatatttatgctgtcatatgaacacatgtataaggcgctgtgtcacattgtggaagatacaaagagacaggattcctgagaatttaacaaagttaagaatgagtgttattaattaaaacaaaaatgggacatttaggttatagttgagaccatgttcttgttttttaaacgtgagatgtttttggacacagaggtgaaaaattctaatgtctctaactcccccagaagaccttagattgatttttctgagaagaaatttgtgaatgatttgcatagagattttctttgaggttaagaaattagatgagtttcccggggtgaaaaaaacagaagcagagattattgttaaaaatggtcatgggtagaggggttagagggcaaagtaggcagaatagaagcatgtttgtgttttaaggaggctaagaactagaatatagcactcataaaaggaaaatgcaaatgcactgtgaatagctgctactggtagtgtattaatttcttagctacatgtaaacttttattagtgtgcttataactaaggtgatgtgtaatatgtcatccaaacttgggtcacttttaagagtgaaagggtgtgctatctgaatgggaccctggacaacaggtgtgaaccaggactgttccagcaaaaccaggacggttggtcattcctaactaataacgtacttttctccagacttagtcccaattcctttaacctctccagaattatctataaataattatagatattataccataaatgttttttcctttatagtactctgatctgcacttgcagagcctctcagttgttggtttctttttccctgtcttgttggaaagaaaggagaatttttctgcccccactctggaccctgcttgggttcacagcattggtggaggtaagtagtattctcaatgtattgttagttgactttcattttgcttaggaaatgaggtttctgtatttttctgatccagtactagatttttttttttttttgagagtcctgatgatatttaactgggctaacgaacagttagtaagttcttagcatgtaatacaaaaaagtgtttgtaattttggcatttgttcttaaattacttgatacttaatatgttttctttcctataggtggggttgtcattgtgaaatttaagatcttcaaagaagagaatgtaatttataccatgaatatgttattttttcatgttggagcactgtaatactttcagtttgttttcttattgtttaaataaaatttttaattcttatattaagtgatgagtttttattccattaagtagctttttattgtcttgtatttctgataaatttaaaattgacatagaagtaataaatctttgagatggtgcttaccaaaatatgattttcctcatcccttacagtaatccttatttggaatctaggatgggcctaaggtatctaggtttgaaaatcaccactttagagtactagaatggaatcctaaacaatctcagatttaagaatgtggtttacagatgagcctgaatgcatctgtgttcttgccagggtcctgttgttcctctgtacagtctgccatctagtggtaggaatgcagagtttaccagaatgccaacggaaagctctaggtttacactttcttatattaagaaggcttacgtagtaatttaaaacattttgataatcagaggaggggggaggaacaactctttcatttgaaaatacaagtcagtggcagtgaagtcagagtattccaagagtatatgtttttctatagagcattttcatgacttaaactttccacttttgttctaagagtttttgtatttatgacattagtgggtaaagagacaaatgaaagataattttaagagacagtagattagactgatctgaaaaatgtgttttcagtgttgattaaaattttagagcaattacataatgacttcatttaaaacaatttagtttgcacttttaaaattaaagtttgaacagttcggtaaatttggcttgggttcagccatgacttaagaggctaaatttcagacatatattaatatatagtatcttaggagtttgctttgtgtacccagttctatctgaattctttcttctctacatattcccttttcagttcctcatctttcctctgccacaaataaaaaggatgtcagtcctttctctgccaggaaaatgccttttaaaaaatctcttctgtgttccgttcttgaagtagaggctttttattgaggtagttcataatatcagtatagtggcaggaggaggaatatggggtggtataaacttgaaaaagcaattatgctgctctctagattgctaatatatttttttccaaatttgctgcactgaagcttagactaaatagaatattgttgctttctacagatgtcttctaagttacatttcatttactagtattaatttaataaatatttaaggtgtatcctgctaggtgctggcaatttgaggatgaagaagtcatggactgcctttagtgagctctctcataggagagactgatatatgagctagtaattgtaatgaagtgtgaaaagtgctgtaactattgtatgatgagttaagagagtatgaaattgaaaccagggaaaatttgctttcccctccaaaacaattgcctggtctttttgccatctctgaatcctatacatacagattacaatcaccataatgtattgtgaggctgtatctttacccccaaagacctcagtttagtaggggagaaattttgcatcttctcagctttgtatatctaagtatttggcatatacttaggtgaatccattgtttatttgaattgcatccgggtcatttccagcaaaagggatagctctgaaagtgtgtggcttcatcctgtgtctcacttaaagcattttggaatatatacacacacttaaacatatatacacctatactgtttgtacctgaatgtaaggtaaccccaaatataaagcaagcctgcattttcccagagacattgacagcccctcaagttttatttatttaacctatttaaatatgtaaatgttagggatatagatgaagcagtcagcctcataatattgaaactcactagttagaatacatatgaaagattactataaaaagtaatctggctgagtgcggtggctcacatctgtagtaatcccagcactttgggaggccgaggagaaggatcccttgagcccaggagttccagactagcctgggcaacagagggggagacctcgtctctataaaaataaatcaataaaattttaaaaagttattagaaagagaagtaatctgtgattttaaaatagtagtttcttttcgccactcatacatacctcaccacatgacatttgactcattttacattcatgtatatattggatattttgtgtttttttggtcatccacagccccttttttaaagttatataacatctttccttttgtgtaagatctttctaatttacattagaaattttttcacagactatcaccatccattcttataacactaagacagtttgtttctttcgttcctcatgtatatttctatatttctgatctctgcatctgcaacataactttattttgttgccttttttttttttttttttttttttgagacggcgtcatgctctgtcgcccaggctggagtgcaatggcgcgatctcggctcactgcaagctccgccacccgggttcatgtcattctcctgcttcagcctcctgagtagctgggactacaggctcccgccaccatgcccagctaatttttttgtatttttagtagagatgggatttcaccgtgttagccaggatggtctcgctctcctgacctcgtgatctgcccgcctcggcctcccaaaatgattttgttgctttttaaagttctgaagacacccaacacaattttgcaattatgtggtatatattcccaggaatacttacctctgttaaattttttatttcttcataagcacctgaaactagcattgttggaggtcttttcaggttaccttcttcaggaagaactttgttaaaataaacagaccagataatgagatgatttgtgaagacttatggcagtttttctattgaatagtttttagagagggaaagtgctgtcattttacctggcaattttacaaatggtagaattatttttacatttctggtggggggaggattgccttttaaaatttattttaatttatttttttttagacacagagtgtcactgtgtttcccaggctggagggcagtggttgttcacaggcatgattatagtacattacagccttgaactcctgggatcaagggatcctcctgtcagccttccaagtagctgactacaggtgcatgtcaccatgttccactctatttttacattttctaatttttaagtgtgggaatcttagtccattcatgttgctaagaacacagtgacagaaatagcatatctagttgtgctaatatactgatttttttcctacagctgcactttttttttttttgagatagagtctcactctgttgcccagacaagagtgcagtggcatgatcttggctcaccacaacctctgcctcccagattcaagttattctcctgcctcagcctcccaagtagttgggattacagtcgtgttgtcaccacgtccagctaatttttgtatttttaatagagctggggtttcaccatgttggccaggctggtctcaaactcctgaccttgagtgatccgttctccttgacccccaacgtactgggattacaggcatgagccactgcacctggtcttttatttttaaacgttaagataggactttgacttaccttttttttttttctgagatggagtctcgctctgtcgcccaggctggagtgccgtggtgtgatctcagctcgcaacctccgcctcctgggttcaagcagttctctgcctcagcctcccaagtagctgggattacaggcacctgccaccaagctcggctaatttttgtatttttagtagagatggggtttcagcatcttggccaggctggtcttgaactcctgacctcatgatccacccgcctcggtctcccaaagtgctgggattccaggcgtgagccaccgtgcccggccaggactttgacttactttgggtgtggggtctggagattccttaaggctcatttaccattgtaagagattgaacttgtgttcaaaatactgacctacttctggcatagtggctgccaaattctcaggtactttaccatgcaactcttattctttttttgttttgttttgtttaatttttttcggatggagtctcgctctgttgcccaggttggagtgctatggctgtgatctcagcttccttttacctccgcctcctgggttcaagcgattctcctgtgtcagcctcccaagtagctgggattacaagcatgtgccaccatgcctggctaatttttgtgtttttagtagagacagggtttcaccatattggccaggctggtctcgaactcctgacctcaagtgatctacctgcctcaactttccatagtgttgggattataggcgtaagcctccatgcctggcccagccactcttattcttgtaccacctcttcctcacatccttgaggagataaagaatgtgtcatggctctcctttctgctcttgatcatgataacgttctaaagggtgtggaataaattacagtacagaactggtgtgtgctatgtgacatgagaggtactgagattagtttatggaagtaacagtgttatagttcctttataaattatttttctctaacttcatatatgacatagttgctaagtcattttggaagtgttcgattgtgtatgcatcaccttgtatttgggcaaatacaatatatacaaaaaaatattacacatacataactttttttttttagacagtgtcttgctgtgttatccaagttggagtgcaatgtcgtgatcacagttcactgtaaccttaaactcttgggcttaaactatcttcccgcctcaacctccactacaagcagtaattaaaaaaaaaaaaactagggagctgggtgcggtggctcacgcctgtaatcccagcactttgggaggccgaggcaggtggatcacaaggtcaggagttcaagaccagcctggccaagatggtgaaaccccatctctactaaaaatacaaaaattagccgggcgtggtagcaggtgcctgtaatcccagctacttgggaggctgaggcaggagaattgcatgaacctgggtggcaaaggtggcagtgagccgagatcacaccactgcactccagcctgggcgatagagtgagactccgtctcaaaaaaaaaaaaaaaaaattttcttttttttttggctgggtgtggtggctcatgcctgtaatccccagccctttgggaggccgaagcgggtagatcacgagatcaagagattgagaccatcctggccaacatggtgaaaccctgtctctactaaaaatacaaaaattagctgggcgtggtggcgggcccctgtagtcccagctgcttggcaggctgaggcaggagaatcgcttgaacctgggaggcggaggttgcagtgagccgagatcacgccatgcactccagcctggctacagagcaagactccatctcaaaaaaaattttttttttttggttgttgttgagacaggatctccctgtgttgcttaggctggtctcaaactcgtgacctcaagcagtcatcctacctcggccttccaaagcactgggattacaggcatgaaccacaatgcctagcctcacacatacagttttaaaaaatggaattgtactgtgtatttttctttactataacttttgacttaatatgtggtgaacattttctcctgacagcttttattttttgtgccatgcattcgttggcctcatagtatttcatagtcagactgtagtgtcatttgattaactcttcactcttggatatgtccacttaaattatgaattaggtcccttagcttcattagtattgttctaaaagccatctgattatttttgtcaatctttgtcattgtactcagcgttccatattctgtctttaagagtatttccccagttattaaagtccaattatgttggttagatttcttaaggtgtaagtcagcctgtgaagagcatagttttgagttaattctactggaagttatataaaaataaaacattgtgtttctcacagaagaccccatgaactttacagataaaattttaacagttacatcttaatttggaccatattttatgatccctttcacaaatcattggagtaagaaataagactgttcatttcatttcctggacattgacacttacgactaggcaaatttgcctgtgtttaactttgattagcctatgtctaatttcaacttgcatagttttgaaatacttaaaacaattttgctatatgaaaaaaattttgctgatacttcatataaaagttccttatcctctgtttactattttttgatgaatatgctttttgtttctactcccaccaaggaaaaattacaaagatttgataagtgaagcaaaatttgattaaccagttaatttgccttgccttccatattaattttatctccaattttctttttttttcttttttttttttttttttgaggcagagtctcgctctgtaggccaggctggagtgcagtggcatgatctcggctcactgcaacctccgcctcccagactcaagcaattctgctgcctcagcctcctaagtagctgggattacaggcgtgtgccaccatgcccggctaatttttgtgttttttttttagtagagacagagtttcaccatgttggccaggctggtctcgaactcctgacctcaggtagtccgcccgcctcggcctccgaaagtgctgggattacagatgtgagccaccgtgcccagccgtatctccagttttctagatgactgaataaatcaattttaggttgtaaatttatgagggcaggtgtaaaaaagaagttctcgttcaaaatgacctttttgaaagggattactaaattttatatgtattactgtgtttggctaagtgattgtggtatgttgatttaaaaacaaacaaacaaatactggtttaggccaggcttcttttttagaaaatcttattcgggtatcagtgtggttttgatgtagcctagtgagttgctgtttagatgggaacttgagaactctgcattctgatggcacaggccactggctgggttgcctgacttgctgtagaagtgaaccctgagtgtcctaatttaagtttctaaagttgatgaactctgcctggggaaatctatataggctgaagttggtgaactctgcctggtgggagagtttgtaaaggcctacactaggaatatgactgtaagattaatgaaaccatttggtaactgcttagttctaaattttttgtactttgttaaaaaaaaaaaaagacttcctcagaatacaaaaatactgttttgcatttcactgtttttctattgtttttgtttttaattagttttcagtcgagaacgtgtattaaattggctagttgagcatttacttgctgtatgttttagtggatccttatcctttgcaaaaatttaattctagtcattaatctgtcacttagctcctgtgaccttgcctgtgtaaatacagttaacatcagctttatctacctcagtcattgtttgttgaaagagcatatgaaataataaaagagcatttgtgtttgtatggtgggtattggttccttctgctttctctacatggaaaagtgattgtcatttctatggtaggcttatttttaggcctattgtcttcatccccttaaatattggaaatctttgtaaattctcactcatacctaaagcagagaacctacgtgccatgtggtacttgttttttttttagtgtgtgtgggattcagaaattgttaataatgaatattcaagaaggtacttcagtttttatgttattgagataaataatgaaaagaaaatataagatctgtcctcattttggtaacttattggttggcaagggaaatcgttacagtttttgctttttaagaaatagtatcttctggattgagagtgggaaaagcagttaactattgagagtccccgataagtgttacttttgtttggaacagtttacttttggttagtcacaggtgggaagaatattttccttcctgacttggagctcaaacttggaagcattttcagggtactattaaatgagaaacattgtacagataaaaaattactgtatggagaaaatgactggctgagttaaatactatgggaggtatagactgctaattttattcaatatcctccccaccccacctgtcatatttgtataacttggttttacatttggtctattctggattcataatctcagtgtgaattcttacttaatttttcctgttttattatgtgtgaagaattttttttagcttctggagttatccttcaaaataactccagtttttctgtgatcagtactaaaagcatactatagtttttaataagcattatagtaaaaacctttatttgttagatccccttttaatttgaaatttgaaaatttgcacatgtattgggctcggctttgtttttcaacctcttgggaatagcaggttgtacagatagttgtaagatgttgatttaacttaatgtaaggacacaatcttggatgcttttgaaaaaatgtcatgttaagaatacccatatgcataccaaaatgaatgtgtcttaaaaaatatgactgatctttatgtttgaggcattattctaggtctttggggatagagttgagaacaaaaaagccctgcccacatggaacttaaaaacattttaattgagagagaaagacattaaacaaattaagatgagttcagtggcaataaatgctttggagagaaataagcagagtaagggggataatgagggtttagaggtaggggaatgcccaaggctttgttattttgcgtaaatattcagggaagtttatctaatatggtgacactttagcaaatagctatgggaaggaagcgaagggagcaagcagcataggtatctagcagaagagaattctaggcaggaggaacaacagtaccaaacacctgagataagagtgcttggcatatgggaggcattgcaaagaagatggcagtgatgcagtggggggaagaacagatcacaaagggaatatagtatggatatatgtacatatacatacacatatgttttataacatacatagtacagtatatatatatacacacacaccatgcaccatgcactatatagtattaaattgtgtgtgtgtttgtgtgtataaagtactgtcgttgaaactgaagtctagtgtaatatgttcagtgccataggccagttataaagtgctatgaagatctagagaaggcagagattaaattccattttttactctcagaagttgaagcatgcatatccaagttggatttactgtttcatttttgttgcaaatagtctgaattgtgaaagctttgtgtcattctgttgttccatgggcactctgttttgttctttgttctttaagcagtattggccaccgtagctgcttatctaaaatgcatgtgtttatcagatattaacttatataataattggacctattaaaggaaaaattttaagtaaatgttggtagttacattgtcatttcttgctagcaatcaaggccaagttagatcatttgaattcatatttaatcattacacactgaagattaaaagtgaacaaattaatgtcatgaataacttttttccctttattgtagtatagctgagacatttatacattacattttatatatattttaaaagtaactcatttcttggttttctcctctgttatatctctaaattggattatattatattacattttttattgaggcagagtctcactctgttgcccaggctggagtgcagtggtactatctccgctcactgcaacctccgcctcccaggttcaagcaattgtcctgcctcagcctcctgagtagctgggattacccatgcccgccaccaagcccagctaatgtttttggtattattagtaaagatggggtttcagcatattggccaggctggtctcgaactcctgatcttgggtgatccaccccacctcaggtttccaaagtactgggattacaggggtgagccaccgcacccaacctattttacattttcttcattgagtttacgaataatatctcttaaacagattgtaggttactcttcttaagttttattgagaatctttttttccagttttgttctcagtattacctagttatcaactgatctgagctaattcagtagaacagaggggagagaaggagtataaatcttttgtatgaacaaacagatccaactcaattacagaccagatctctgccctgttatcttcctgttgcaaagacagcattctagggtggatgttcataaagatagtttgatcttcattttgttcattcttctgtatggatgatttctttaaataagctttatttaaagaaaaatgttaaagttaattttaaagagatgaataataccagtattttaatggaaggtttttaagtagtaaggaaatagaaggttcctcaaaaccttgaaacaattcattttgagatgaccaaagtacttgagagagaattataccctgagggagtttgatttattttttggtattgttgatcatttatgtgattctaattggtaccctgcttcttaggtagattatggtagtctcaattgctctaattgagagatttttaacaacatctccaaactattactgctccactttgtgttaaatcttttgcctgtttgtatgcagatctggtattaacaataaattaaaaccacagaggaaattaatcatttaaaaattttttattgcagacttaattcagtgcacaaatgagatgaatgtgaacatcccacagttggcagacagtttatttgaaagaactactaatagtagttgggtggtggtcttcaaatctctcattacaactcatcatttgatggtgtatggaaatgaggtaagcagaatttttattgaacaagtatactgatgtgttgacttattgttagctagcttctctcactgaaacttcagaaacagctcccaggtacaaaggtcaaggtgcctagccagaaatataattatagaccctgtaatttgaggaaagatagcttgtaagccagaaagcaaaaagtgggttagagcacagaggacatcaataatggatcaagaagcaaagattaatgcctagaaatgggttccataagcatccctggtttttgctggtcctgtttatagactatatattttgtctatatccatttgttcttttattatagtccagttagattttttgtttgtttgttttgagacagggtcttgctttgttgcccaggctgaggtgcagtggtaccatcatagctcactgctacctcaaattcctgggctcaagggaccttcccacctcagcctcccatgtagctgggattacaagtgtgtgctaccatgcctggcttatttttaaatttttttgtagagatgggggtctttccatcttggcttaggctggtcttgaacttctgggctcaagtgatcttcccaccttagcctcccaaagtgctgggattacaggcgtaagccatcacacccagctttagattcttgtctgatctcatatagttgtttatggaagcactttgcctacttcaaagctgtgatatttaggactaagatggcatttgctgagagggactgattgaagtgtgccttcttcagcagagaggtgtgtctgaagcctttgttgcctaaaagggtaacaaataagatatatacgcttttgaaaatctgttttgagagaatcatcttactttccgtgatagcctagcagctaattttttggttcattttctcagctcaataaacttatttgtaaaattgtattaacaggagcttttcaagaacatctgagtagaactagataaatcttcttcggtatgtgccttagaaaaatgcagcccgggaagataaccttctagagatgagaaagaactttagtcattggtattagttttctgagcgtaatgacttgttgacatccatcacgttgtgtgttattttgggcttttcagtattgaaactattttttgacaactaccaatatagcattattaaagttcaaaattaaagcaagaatttacccacaactttattgttccagcacatcttacttttggcacattttggtcttccctctagttcttgtccaaaagtatttgtattttttaaatggctataatcataatgtagataaaatatacttagctttttatataatattacactatcagcattgccatgttgtatttttttatcatctttagtaactatgtaattgatcgtatagttcacaatttttaaactattttccttgctagaaattgagttttctgattcatcgttataccaccacattgagtgattttatttgtagtttttaatttttaaaaatgatttcccctaagtgttacctgaaatgtgattactaagtcaacagacatgaccatttttaggacttatgttagttgctttctaattcattataaccagttgatagagctaatagaaatgtttggctgtattagcttaaatgtaacttgaaacatcttaactaggataatagtttttacttttagcaagaatatgtttagttaagattatgattattctgaagaattccaagcgtgtatgtacttttcttcttcttctttatttatttgatgtagtttattttttaaaaagaaaaagccacaaatataaccagctacactgccagataaacaaagtatcaataatggctttcagaggctgtaaataaggtaattgatagtactagaggcaaaatgttaataaagacaaaacagaaagttgacagtcattttgtagattgactgacaaggggagaaagatagcattttagtgtgtttttttgatagtgtgttttttgataaactcatgtttagcttcctgtaggcagttaaagcaaattccatgctctgttcattttttatgctggtttgtacaaccttcaggtttttatgctagtttgtacaaccttcagatgttcccattggcaggtgccattaatttgttagaggctgtacataggatttcactatactgtggtgattggaataccatggagcggtgattctcaaaactgagtggggaagggggatgattttttttttcccttaggggacatttgtcacaactgaaggggatgctgctggtatatagtaggtaaaggccagggctgcttcaaaacatcttacaataatgcacagaacaggctgggtgaggtagctcacacctgtaatcccagcaatttgggaggccaaggtgggtggatcacctgaggtcgcaagttcgagaccagtgtgaccaacatggtgaaaccccgtctctagtaaaaaatacaaaaattagccaagcgtggtggtgcacatatgtaatcccagctactcaggaggctgaggcaggagaatcgcttaaacctgggaagcggaggttgcagtgagcgagatgacacctttgcatgccagcctgggcaacaaagcaagagactccatctcaaaaaaaaaaaaaaaagaaaattaaaaacagtaatgcacagagcagtctccaacaacaaagaattacctgattcagtgtcagagtactcaggttgagaaacctggccacagagaaaaatctcaaaaggtaaggctgagtgagcattgtgttatagacccttaacatgaggcaggtaggtacttttatactgttgttcacttaccaactgggtgacttgggtaagtcacttctggagcttcctcaataatatgatagtaccttcatggtaaatagaattgaccaaggctcttactatagtatgacaagttatagatgattaatacatgaaaatgtagagttaaaaatttgtagatgaaattagaaaagagaagtaccaagcatggatttattataaagtatttaataccattttgggtaaaataatctgaaatatgttctttaaatattttgttatgaaaagtttctaatatacacaatagtagagtgaatggcataacaaatgcttatgtacctaatcacccaccttccacattgccattctttaaatgaaggtttaggataatccatttcaggttaccgcttatgacccaaaatgggaacctgtgaagccttattacttgccagagtgttggcatggtgctcaatttaataccattttgaatatcattaggatgctgttgaaaacaaaatcaaaacttgattaaagccatatatgtctttgcagctaaatataatgaacgtagaaaggactaataaaatgaaaaggaaaatttagatttattatctctaaaatcatgaatgaaatggcctggtagacgaaattatttacattaatttagaatgcagaggtaaagaagagtcttatcaaaatctattaaaatcatagtctaatattgtcttacgatatttttataactttttgaaacactattttaggataattgtgaaatatgagtcttcagtttacacattgattttcaaaatcctggtttgttagtttggggtgatctcagttgtacaagtctaatttggaggccgggcgcagtttctcatacctataatcctgagagtttggggggccaaggcgggaggattgcttgagcccaagagttccagaccagcctaggcaatgtagtaagacgttgtctctacaaaaaatttttttaaaaatgtgagctggacatgcctgtagtcccagctacttgggggcgagggtgaggggtggatggtgggtggtgcttcatactgagatgggaggattgcttgagagcaggagggtggaaagctgtgatcacaccactgtactccagcctggatgacagagcgagaccctgtctcaaaaaaaaaaaaaaatactgatttcagaggtgatggtgtacatcctagttgattattagcctctacatgcattaaaaaaaaaatgaagaagaaagtaaagtaatcctaagaagcgaagttgaaaggcatttctttagctatttagaggctgtatgtgaaggagactaaggttatgtactatggtaagcacttcagagaccattttggcaatattgagaagatgagcttttacatatgtgctggcctaataattcatccctaggtatatatcctgaaaaactcatatactcatatacttatgcatggagaccatgaagaaatatgtcaatacaactttgttaataatagcgaaaattacaaagtatatccataataaataaatggatttatgatgatgtattcattagaatattagaacatcatttaagatgaaatgttaagtgggacaattcttagggaaaagttgagttaaaacacattgcaaagagtaagtacactatgatacttgtgtaaatttcaaatagaaaacacttggatagtttatagatacttgtatgtctagtaaaatggtgaaaacctgtgtgaaagtaacgtatacctgtttcagaaaagtactcacctctgaagagggagggaagggagattgaaggtgtggttcttcaatggaggctataatgttttgattctatataagatgtgaagtgaacatgtgaatttgtttaatctggacagtgggtaagaggatctctattgctttcttgtatgtttagaagtattttttttttaaagccaaaactttggtttaccagacggctgtttaaaatacagatgccacctaaaaatgattagctatagttttagtatgctgtaataaaaccaaaactactgcttccactgcctatttgcttttattgttttgacttaatactatatctgtgggcattaggctttaataaattctcgcatgctagtgaaaaatatgtattatgtttttaggtttggtaactagttaatggaaagagtgaggatgagaaatttaaactagataagcttaatagaatgtgttaaccataacttttcctcctaattttcgaattagagttggtgagatggcagtaccttaatatgatgtaattttttttttccagcgttttattcagtatttggcttcaagaaacacgttgtttaacttaagcaattttttggataaaagtggattgcaaggtaaagataacttttacattatagaaaatcaaaagaatgacacccacatgatgattactccagagtagaactctgtcttttagaacatgtgctactttaaaccttatattttagtgaaggttgtaggaaagaaaaaactgtcttttaatttgaagattaataataatcttcctaccagatactcagagctctctgagacggagtacagagtagttatttgagagcatgaattctggagctggactgtctaggtttgaatctcatctttgctgcctaccagctatatgaacttgggcaggttacttcacctctgcatcagtagaatcgagtaatagtgatagtacctacccagtaagattgtcatgagacttaacctagttaattactacaaagtgcttagaacagtgcctggcacacaagacatgctatgtaaggctgggtacggtggctcatgcctgttattgcagcactttgggaggctgaggcgggtgggtcacttgaggtcaagtgttcaagaccagcctggccaacatggtgaaaccccgtctctactaaaaatacaaaaattagccgggattggtggtgcacacctgtaatcccagctactcaggaggctgaggcaggagaatcgcttgaacccaggaggcgaaggttgcagtgagccaagatcatgccactgcactccagcctgggtgacaaagctagactctgtctcaaaaaaacaaacaaaaaaagaaatgctatgtaatatttgctttcattgttattatattatgtttcattccaagaaatgtagttgaaatattacatgttttagtagctaaagtggatataatttgttgagatgaattgttccttcatattcgtagctattttcttatttatgtttttttgagacgaagtctcgttctgtcaccaggctggagtgcagtggcatgatcttggctcactgcaacctccgcctcccgggttcaagcgattctcctgcctcagcctcccgagtagctgggactacccgcgcatgtcaccacgcccagctactttgtgtatctttagtagagatggggtttcaccatgttggccaggatggtctgcatctcttgacctcatgatctgcttgcctcggcctcccaaagtgctgggattacaggcgtgagccaccacacccggcctgctattttttatttagtaacttgaaatggacataatgtggttatagctgtccatgcacattgtcttaatgggatctgttttacttagttctgtaactaggctgttagcattatagaatgttagctttagggagaacctcataaaggatatgccaaatgaattgggaatattcaacagtgaggctcaatcagggaaatgtctttagagaaggtgagatttgtgctgggcttcaagagaaggatgagaagatgagttggcttaagcacaggtacaatacatgaatgtgaaagtaaggacagatacacagatgtatatggatgtgaaagtcattcacatggatatgagtatttaagatttacagagcaaatgaatgtgaatagaatatatatgaatggtgtatttgagaacatgtagtggcagatagccctcaagaagctgttcagagccaaaatcaagcacaaaaattttttatagagttggaattttataatgcagtagagagaggaggggagagggaattatgtgttaccaggaaagcatcatagcttagtcaagttagatcagagtaaaccaaatcttgaagatgctgagactgtttcagttgttctggttatctagtgtagagttaatcagggcctgaactgtggttcttctggaggtgtaaaaaaaaaaaaagatcaggggaatttttttttttttttaatgtgactggctgtatttgagtttggaggtgttcagtccaatacttgtttccctttggtaagtgcaggtattgcttaaaaagaatttaataccctatcttccagacattctagaagaccagtaatctatatgtaggacccatgttacaaaatgcattatattttaacaagagttacggcgctctaacttaaggaaaaaaaattaaaacagtagaccccctctcttgaaaaaaaaattttttttttctttgagacaggatctggttctgttgctgaggctggagtaagagagaccggggcttgctctgtcacctaggctgggtgcagtggtatgatcgtagctcactgcagcctctaactcctggctcaagcggtcctcccttcagcctcctgagcagctgggattacagatgtgcaccaccacgcctggctaatatttttattcttaaatattttgtagagatgggctcttgctctgttgaccaggttggtcttgaactcttggtctaaagcgatcctcctaagcctcccaaagtgctgggattacaggcatgagccaccacacctggcctctttttgaaatcttaaacagaagccagatatatattatagataaaaatggagtgtctctattttcaggggcatggaagaaactgcctactcatcctttaattttcacttcctccctcattcagttcattttaactttaaaagtctatggaaaacaagatgcagagcagtgctctaggcagagtttatgcatatatccaagtaggttttttgtgtcttattagcgactgatttatcattttcttaagatggaaattaagcaattctagtggtaaggtgttaataatttcactctttttatgtagacgagaggttgagccttgaaggatgagaggtgtttaccgtcttaggatggggtatagtagatagaaccatatgaaccgaagagctgaggaatgtgagcatgtaacacctgacgtgtacagtagtaggtatgaagtcatatgggagcagtatttttttttctattttgttcactgatttttctccactggtacttaataggcactcaataaatattttgctaaataaatgaactggtgatgttgaaatccagttagtttacattttggttggttttggtattgtcttttaaaggtagcaaagaccaagtaattaaatttgttagatgaatatgagataaaatgggttcacttttcaatgaggagcaaaaatttatagacttccttgagccaggtaataactaaaacacaaagtttttggtgtttttagaaaataatattgattagattttatgttgctaaagttttcaagtcaaggtcatgatgaaacaaaatcttagaatgatttatgtattcatttagaaagtttcattgaaaacattcatataattgtttttgttacaccctgaacttgcatgttgccatttcttatattacacagtaattttttatactttttataaggttggcacatacaagttatggttctaaatacagctaaagattttaggagtataaaaattatataaagttgcttgatttgaggaatgggattgtggttccataggatgttaaatttgagttgtgagattatcaagttgtgtaaaagaacgtttttctaattcctgatgaataaagaataggaatattgagagaatagtgaagttctaagggaagaggttttttttttaaaactacataggacttatctgatttaaatatgaagccttaagagaatttaatggtaatgttattaattagttacttaatttacatactaaattgaattgggatatcaagacattttatagccattggatgcaatgagttgtttttctaggcatattgggatttttagtcatttataaaaacttgtctctctctttgttttgtttttgtttttgtttttttacaggatatgacatgtctacatttattaggcggtatagtagatatttaaatgagaaagcagtttcatacagacaagttgcatttgatttcacaaaagtgaagagagggtgagttaagctttttttgacatctaattgatttgaatttttaaaaatgtaaaacataggagttactagattatgaattatgaaattttagccagttttaaaagatgagcctcatttttctttgatgaggtatatcaagtactttttgtggtaggatttgtttttaagttctttttatagcacctttattgagatatcattcacataacaaaatttatcattttaaagtgtgtaattcattggtttttagtgtatttacaaagttgtccaacatcaccactaatttcagaacatttttatcacctccacaaagaaactctatacctattagcattcatttcctattccctcttcccctagatcctggcaaccatgaatctactttctgtgtctctgggcttgtctattctgaacatttcatataaatgaaattatacaatatgtgacctttgtgtagcatgatatgtccaagttatagcatccatgttatttcatatatcagtattttattcctttttctagccaaatcatattttactttatggacatatactgcattttgtttatctgttcataaggtgatggccacttgaatagtttctacttttgcctattaggaataatggtgctgtgaacattagattttatgtggattatctttttaattctcttcggtgtatacctagaagtggaattgctgtgtcatatggtaactcttatgtttgtcattttgaggaactgccaaatcatttttcaaagcagttgaatcactttacgttcccaccagcaatgtatggcactttcagtttctccctattcttgccatacttgttattttctgggtttttttttgcctttttttttttttcttaaatggtagccatcctagtgggtgtgaactggtgtcttgtgatttttagtttgcatttccctgatggctaatgatattgagcattttttttgagctgttgaccatttgcatatcgtcttttgaaaaaatgcctcttcaaaccctttgccctgtttttattttttattttcactttttgagacagtggcaccatcccagctcactgcagtgtcgacctcctgtgctcaagcaatttttccccctcagcctgctgagtagctgggaacacaggcatgcaacactatgctcagttaatttttaaaaaaattttcatacaaatgagttctcactatgttgccaaggctggtcttgaactcctgggctcaagcagtcttcccattttggcctcccacagtgttgagattataggcttgagctactgacctggccttttgctcatttttaaattgggttacttgccctttttattgttaagttgcaagaattttaaaaaatatgttctgggcaccagtttcttatcgcataaataatttgcaaatatttttctcccatggcttgtcttttcagtttcttgttggtgttttttgaagaacaaacatttttaattaattaagtgtatcttttttttcctttggttgcttgtacttttgtaatcatgtctaagaaatcattgtttaatccagggtcacaaagatttactcctactttttattctaagaatcttgtattttttgcccatatagttaggttcttatctatttggaattaacttttgtatatggtgtgagaggtgagtccaaatttattcttttgtatgtggatattgagttatcccagcaacattttgtgaaattactcttctttccccattggatagtcttagtaccttgttgaagatgagttgaccataaatgtaaaggtttatttctggacttgcagttctgttctgttgatctgtatgtatatcttcatgccagtaccacattgtcttgattactgttgctttgcagtgtgttttaaaattagaacgtgtgagtcttccaattctattctttttttttttttttttttcccaagattgttttagctgttctgggccccttgcattcccatgtgaatttcaggatcagctttttgatttctgcagaaaagatagctgggattttgtgggggattgcattgaatctatagatcagtttggggagtattaccttcttaatgattaaatttctagtctatgaacaagagatgtgtttctgtttatttggatcttttttcatttctttcagtgctgttttgtatttaagctttcttttaatcttaaatgcagaagatgcatttaatttttgctgcaccctaaataacaatcatcttagtacatgatccagtcacatgaatgatatagtcagtgcttctataagtgataacacctgatatgcagatttttttcctaggatataggatgaggcctcaggagaaagccactgaagacattcttagcagcagcgatgacccttgtagctatgaagacctgtcttgaagggaatctggcatgtacagaaatagtctggtgaatgccttcctgagccactctgctgctcagtgatcccaaaggtctaagcaattgatgtgttcctttagattgttctattgaaattttaaattaatggactgaagtgaaaaatttaattaaaatatagaggtaacctcttagttatgcaagaaaatttaaagctgaatttaaatgttctatgctgccattccaaatccatcaggaggtgattattttggaatatacctaaagtaaattctacagattttgtttcatatatttaagcactttgtagaagattatggtggagaacttttttagaagtctgatttttaacctctgtatcctgtccaataatatttcactgtaaagtgtcttcagtgaagttgatcttcagtgtatttacagatttcagaataatagatttttaaaatggtaacttttgttctaatttgaagggccagtcttgagaatagttggtgaatttttttatttaatagagcagtcttttttaattggaggaaaatagctcctgattaagtacaataaaattagtattgacttagttgaatcaaggaggagccataattgagtggggaccaagaagaagtgcaaaagtggcattatacacacacatatacacgtcagactgtataaatacaaaagaaaaaaatcaagaatatcaggtataaattgaggacatgacagcaattgaaattattatatcatggcaaaaacctcagtaggctacaccttttggagaggactctcattgtaagtagtaaagtttgatttattaagatttttttttatgtttacaaaagtaataaaatttaagaaaaataccatcctaattcatagaaaatgttaacattttagtgtgtctaaccttttctgtgcgagtaaatagaaatatgtatataaaggcacatagaaaattacataaaaattggatcagattctttgaaggctgcttttcttcccctcctgtgtattttggacattttcaatgtctgtacacatagatccatctcatttttttcttttttttttttaagtcagagtctggctctatcacccaggctggggtgcagtggcgtgctcttggctcactgcaacctccacctcccgggttcaagcgattcttctgtctcagcctcccaagtagttgggactacaggtgcccgccacaatgcccagctaatttttgtatttttagtagagatggggttttgccatgttggccaggctgatcttgagctcctgacctcaagtgagctacctgtctcggcctcccaaagtgctgagattacaggcatgagccacctcatctggcctcaatccatctcattcttatgaatggctgtagaattatgttgcaggtgtacatctgatttattccctttttttaatcttataaaagcagtggattgaccatccttttatgtatggttgcattgagtttttctatagaataaattattaaaattgatgagtcattgagatatatatacatttaacattttaatacaaaacaccaaattatcctttataaaagttatactaaattattggcttaaatagttatttgtattcttccatcatcatgaaaaatgcgttcatatgtgttcattttatattagttgattgaataaatggtgatattgagcacactcccccttccttttgaatgccatacttgttttattaattgtcttttgatgtccattgacagcttctctattgggtttttcactcttttccattgtgtttaatagtggtaagaactcacaagcttttttagtcagatgaatctaggtttgaattctagcttcacaccaattagatgagagacttcagtgagatactttagctggtttactgacttttaaaaaataatattactttaaaataatttcacttccagaaatgtagcaagaatattagagaacttctgtatactttactcagaaccaccagtttttagcattttgccacatctgcatttctctttctgtgtatattcacacaggcgcacacacacatttttttctgaaccatttgagagtgggttacatacctgatgccttttatagtttatatcttttaatactttggtgaatattttctaaaaacaaggatattttattacgtatctatcagcttgctaaacttctttcacatggtggcacacaaactgttaactatttatacaagagactacttgaggctaaagggttaaaaaggatcaacatcttggcacacttataaccctttctaccatactagtatgctgtggcaaaactgggaaggccttacttaagctctgagttatttcatctgtaaaattacgatgttaattagtactttcctgtcaggattgttgtgagaattaaatgggatattgtatgtagtgcttaacacataacaaacactcaacaaatgaactttttgtatattaggaaaataaattgttataggttatgagtatttttccttgttttttaacattgttaaaagctttacaatcttaggtgatcaaaatcattatcttcatttttatgttttttatctttcaagcaagctcagtgagctaaaatgattatgttttcatcagttatatttatggattaggtgttttatattttaatcttggattcatttggaatctaccatggtaggaaaaacatgaggtagaagctaacttttttttttttttttgagacagagtctcactctgtcacccaggctggagtgcagtggcgtgatctctgctccctgcaacctccgccttccagattcaagcgattctcccacctcagcctcccgagtatctgggactataggcgcatgccactgtgcccggctactttttgtattttttagtagagatggggtttcaccatattggccaggctggtctcgaaatcctgacctcgtgatccactcgcccctcagcctcccaaagtgctgggattacaagcgtgagccaacgcgcccagccttagccaacactttttaaatagaaatatagtttgggtggcaagaagaccagacaattgctttttgttattttctgttccagaatgaaatattttgggagttaagagctgagagcttatgtgtttcatgtaaggagacaaggaaagagaagaggattcgaagatacttaggagaggattttattagagacggctaagaggattgctggcaatgttgagtattcatttgaggttgatgatcatgagtttatagttttgccagtttgcccagttgtgctgttttctttaccagcactcagctatgtgtgtacaggcatggattagttaggtgtttgctcagccaggatagtgaatttgccagatgactgaaatgcagggaagaaaagaggtgcaagaaagttaaaggtatttgtaaaggagtgattatattaatgatctgtggaattctaagctagatgaagaaagtaaaaatgagaaaggatcaatgtgggtagtggtggagttgaaacattgaagtttctgatgaggtcaaatagtttttaccacagggatatgtgaccaaagcagctgaaaggttaaaaggtaattgtcacagaataaggtgtctgaattttacctttttttgttgttgttcttcaggggtggggctaggatgatgtggtttctgggggcagtaaggttagaatcagggattttgacatcaaggtgttggattggttgtccatgtagatgttgaagctaatgacaagaaagactgagccaatgttcaaatcttctgtgatggagaagtaaccagaggtaaaaaaatgacatcagtaagaagagttgcaaaagaaggaatggtgtcctcagcccaagctccagcagctgcttccagccaatgctgtttagcacttgagcggaaacaggcatccataagttaacacattagggagaattaggccgaagctgatcaataggtgactacttaaggcagtctagtatttggttattaaactttgttgtgtcctacaaagcacagttgttgctttttatagcttaattgttttttggcgtctgaggtcatagttcatggtttatcgtagggtagaacagccatttataagtataggtcatttgtaaattaggggaacctgacatattttttggaaatgccttgttactcaaccaaacagtaaatcagtagaatgaggatttgaaaatgatagggcaatctctgaataatacttagtgtgatatataataagctcttaatattagttgtgtacgttagccccagtacctttcatgtactggtttttaaatctgttttggtgctgccaataatttctctatctttagaaatatctgtttggaaatatttaacagactattttattaaaggctgtccattgaaagtatctcttgtgtaatagccagattagaatgatttggtaaaattgttctttattttgtaataaagtagttttagttataatttctgaattaaaagccattgctgttgggtcatgaataaaatactttaaataaaacagagctctaagactttgttaactcttggcctacagagtgtttaactgttttttgacttgaggcaaatgattattttatttgtaattttaaaaaatggtaaaactgctctttacacaccaatgattgtgaggatcagatcatttcatcttgtgaaaatacaagctatagaccttgctgtataatgtatacttttgcttttatggctcatgctttatgttcttttttagttctaaatgagtaccttgatatttgacatattgtgttgcctgtttttgttttttctgtatgatctctgcttcagttttcatgttccataatgacttaaaaatatgtgacatttcatagcaacttggttctctgttttagtagaaaaccagggggggagtttgaaatgtagatttaattgcagattcatttgtttatttctctggttttttcataacagggctgatggagttatgagaacaatgaacacagaaaaactcctaaaaactgtaccaattattcagaatcagatggatgcacttcttgattttaatgtgagttatgcttttgtaatttaagattttaaaaaattaggtcattataattcatgagaatttttaacctcaagttttcacagactctagtttttcacatcctgatatcctatatggctaaggattttttataaaatagtctcaagtcaaattactttctgatttttatgactgttttggatttatttctttagtgcttctctagctctagaattttaagatatacaagctaaagtggtgaaaggattgatctgaaaatatattttcttttgataatggcttttagatcttgaaaatgtacagggatattttttaaataaatagccaacttaatattttacttttgtctatttaatgggactcaaagcatggcaattattcagaagaagaagtttaaatagcagttataatagcttattatgtagctattgcccaagggcattgtgttcgctggaatttttgttttaatgaccatgacttgaaccaagctgccagctttgtcattcatttataatgtgttagaagttaacgttttcaactctgttctgtttttttgtcatctatcttaacaatgttttgtttattatttatttgtcattttgttttagagattgtgagtgcaagttagtgaatggaactgtgacagtttcatgctgaaatagatttttcctttaaattgtttaattgctagtttttaagcttcttcagggcaggaactaggtcacttttgttctctgttgtacccccattgcctattaatgtggcacatagtaagtgttcagtaaacattcaataaatcttacaggtatttcatagactaaaacagagattatccaactacagcttactgcctgtttttgtatgttttttaagtggttgaaaataattaaatggtattttgtaacaggtggaagttacatgaaattccaacttcagtgtcctcaatagtattattggaacacagccaagctcactgatacatattatctatggctgttttatgttacaacagcagagttcaaaagttatgacagagactgtgtggcccacagtctaaaatatttaccatctgaccctttacaaaaaaaagtttgctgacccctgctctagaaggcatggggtactgatgcagttattcaacattattttggtttgtatagaatctcagggtccaaccatgcatatttttcttaatatattgtatttgtttaaaatttcttattcttttcaatgtctgtattgtactttgttatataataacaatttatctaatcctcctgttgatagatgtttattctgtttttttatcctaaacagtgctacactcaattctctctcctctctctgtctcttgtctgtctctccctctgtgtgtgtgtgtgtttctatttgtaaacctatttcaataggtttaacacccagaaaaagaatgtggtggttcaaataatataaacatttaaatttttaataaatattgcttatattccaaaagggtgagccactaacttctcaacaggtgtctgtttttgctttttcatcttttttttgtttttttgagacagcatttttctctgtcaccctggctggagttctgtggcatgatcatagctcattgcagcctccaactcctgggctcaagcaatcctcccacctcagcctcctgagtagctgggactacaggggtacaccaccatgctcagctgccttttcttggttttagttttttgtagagacaaggtcttgctgtgttgcccaggctggtctcatttgaaactgccaggctcaagcaatcctcctgcctcggcctcacaaagtgctgggaccacaggcatgagctaccgtgttcttttcttttttcattcttatgggcactgagtaatatagtctgatgttcaggaaaggatattttagtaatttgatttgattattgtattttaatttacctgataagtgaagttgtatttcttttcacgttattatccatatgtattttttattttgtaaattgttttcatttactttatttattattaggattctccctatataatggacatcagctctactagatagtctgcaaataacttttttaccagttttttgtttgccattcaattttgtgcttagtttttctatatataacgagttaattttcatgtgctaaaaaagaacttagaattaatttggtttatctttttgatttattccttgagataaaactaaaaatatttccagtattcttttagtcaaataaatacaattatctggttacagcaaatttaataataataaataatgttcatttatatggtagctactgcaccgtgatctttatgtatgtattagagaaaataaatgtatttttcactaacatgcctaatgcatgaatttactgtatcttaatttgaaggaaatctttttgtcaatgtcatttaaaacctaagattagctaattttattttccaatttttccctaggttaatagcaatgaacttacaaatggggtaataaatgctgccttcatgctcctgttcaaagatgccattagactgtttgcagcatacaatgaaggaattattaatttgttgggtaaatactgctgtagcctaataacatttcttatcttgtgtcatatggataaacaatattgactgagttgttacttaaagctggctaaaaatttattatgatatattcattcattgtaacagttaatttggagaaaagagttttatacctaattacttctgcaagtgattacatatttttatacccaggatgttcagcaagatgaactttattttttagatgtatctatgttttttccacccattttattaatttttagaaatataaaagtgcctttaaaatttagctgggttaagatagtaagttttaggctgaggcaggagaattgcttgaacccaggaggcggaggttgcagtgagcctagatcgtgccattgtactccagcctgggcaacaagagcgaaactcagtttcaaaaaaaaaaaaaaaacaaaaaggatagtaagttttatgttacaggtattttaccacaataaaaaaagatgggaaaaaaacaaatattttgtcccagaagaatattgttttctcataatcaactccataatgaacttttaaaaaatttaaatctgttttttatagtctgaagtaacgtggacttactcagggatgctttaatctatagggatagggaaatttggcttattttttcacaagtgaaaaataaaggtttttctataaagctttggaaggcatagtcttcaatactataattagtataaattaaccttttctatgtatacattaaacttaaatgaactttctgagtgacatttgggcatggtaaagttgttatcttagataatatactattagtaagattggaaatagatgttagtgctgttttaaatggggtcaagtgtggtacgtgtttacacacaaatatgtacttaggtaattgtgaggaaaagtactatggcacaaactaggaatatgagtagggtcaagtaatgtttctttttttagtataatagcacctctattctaatttgctttaaatacctaagctaacttaacactgatatttttctagtagggtatgtatgctcctttagagacctatttggagctattacctactttttttttccttttttgggtgttatattttgatgtgaacaaaagaatttttacatttattttgtcagaaaaatattttgatatgaaaaagaaccaatgcaaagaaggtcttgacatctataagaagttcctaactaggatgacaagaatctcagagttcctcaaagttgcagaggtaaactgtctttaagtgactgtctcctaacttgcctttttgtctgtaagtatggattttgaagtcatcactcactatccaaataaaataaatgtcttcaatttagtattcaatcattattatgctgtattgaattctgtggcaagatatgaatatgataaagtagtgaataaaatacatgctgtaaatttaattcaatagcgagtattgaaaagttacctgtttttacattgtttacttctctataaaattaagtaggtgacatacagtagtgccagagatttttatggttggaatgaaccatatatttgagaatgtttattgttaaatgtggtagagaatatccagtatcagtgcaggtttctttccagtgagacagctggagccatagttcaaaatgttttcgttggctgggcaccgtggctcagacctgtaatcccagcattttgggaagctgaggtgggtggatcacctgaggtcaggagttcaagactggccaacatggcaaaatcccgtctatactaaagatacaaaaattagccagtcatggaggcgggcacttgtaatcccagctacttaggaggctgaggcaggagaatcacttgagcccaggaggcggaggttgcagtgagctgagatcgcaccactgcactccaggctgggcgacagagcaagactctatctcaaaaaaaaaaaaaaagcttttgttccccgacagaaatggattttgtgtatttattatcattgattgtgaaaactatgaatgtaggtaataggatatctaattttgcagctctgcttaaaaataattttctgaaattgtcacggaaggcaggtgtggtaatacttgcaggcattatcttgctaccacagaggcgttcttaaggggtttttttgtttgttctcccattctccagcctctacccatctccaccaaagatttcttcctaggataatttgctcaattatgtcaaagcagttactttggaattagcaacatagtgattctaggctttgttactgtggtgatatattattctatattagatgcaataggacagaacaggatgatcaacaatagctttgttattagtctgctgttttatgaagcctactgaaattaattttgaatttaaaaatgtttcaaggagaaagatcctttccgttttttaagggtcagtcacgtactaaaacagaagaaggtggtgtttatgctgtgattctagtaaattcttcaagtaagttttaatttgttgaccttccctcttggccttttatgttctttgcatttggtagttgtagttacaaagttaagttttttttgtttgtttgtttttgagatgaagtcttgctcttgtcccctaggctggagtgcaatggcgcaatcttggctcactgcaacctccacctcctgggttcaagcgattctgctgtctcagcctcccgagtagctgggattgcaggtgcctgccaccacacccggctaatttttgtatttttagtagagacggggtttcaccgtgttggccaggctggtcttgaactcctgacctcaggtgatctgcccgcctgggcctcccaaagtgctgggattacaggcgtgagccatggcatcccgcccaaacttaagttgtaagcccccttctgtactccagatctgctgttaacttattcttaggtgcaatagactgtctgctatatatgactttttttttttttttttttttttttttttttgagacagagacttgctgtgtcacccaggctggagtgccatggcatggtctcgtctcgctgcaacctctgcctcccaggttcaagcgattctcctgcctcagcttcctgggtagctgggattacaggtgcccgccaccacgcccagctaattttagagatgaggtttcaccatgttggccgggctaatctggaactcctgacctcaagtaatcaacccaccctggcctcccaaagtgctctgattataggcataagccaccacacccagcctgctccatatgatttaagaaaaatatgaagagtcccttaccttacgctttttttctttttttttttttttggcttttttttttttcctttttctggagaacggggtctcactatattgcccaggcaggtctcaaactcctgggctcaagctatcctcccgcctcttagcctccctgagagctgggattacaggcgtgagccaccgcgcccggccagagtcccttaccttaaaatattctgttttgagactgtgtttgggcttgcagtttaattagaacgccttagttcctggaagaaggcaagagtaacctcttgaaacatgtttgaggaggacaaatatatcaggcagtgattagtaacatctgagtaataatgaatttatcagattttttttttttctcctgagatggagtctcactctgtttcccaggctggagtgcggtggagcaatctctgctcactgcaccctctacctcccgggttcaaacgattctcctgcttcagcctgctgagtagctgggattacaggtgcctgccaccatgcccggctaatttttgtatttttagtagagctggggtttcactgtgttagccaggatggtctagatctcctgacctcgtgatccgcccacctcagcctcccaaagtgctgggattacagacatgagccaccatatctggcctttatcagattttctgctgacatcattctgagaccagcccctgagaggtcacaaaaggaagggagactgattagaaaatgaaacacagccacgggacagaaaatagttttctaattggggtgctagaatacacaggaaccgtttctatctttttttgctggaaattgcctagggcctgagcatcatgaaggtatattggaattggtttgagaagacagttatatcctgattagatatcacttgacatttatgtaaacctggcctacctgacagagcatgagtttttaaagtgttatctgtggtgatttccagggaaagcatgttttatggagaaagacaaagtcgatgtcttcaggtttgtttcttaaatttttttttttttttgcatcaaagagcttgttcatggtcaggctttctcattcttaccatagtgtttttatcatattacacatagaagagaggggagttttcagattgtgacaaggtagcttacatacaggtgttcagaagacagggatggtaacttagatttgttgactttccaactctagtttccctactgttaagaacttttagggccaccaaataatatctaagccattggaaatgttgagtatttttggagattaaatattttcctgattcttaagaagtctgtttaaaatattactggtactagccgtgatgtcatttttccaaattttatttataaaatatttttattataatttattaaatacaatgcttttcttacagcaagttggaattgacagaggtgatataccagacctttcacaggtaagtttattgttaaaataccaatccactatctgttgtgtacaagttgtgaagagtattaagataagtaacatatagcccccattgtcaaagggatcaatgcagtttttgaccagttttaacattttgatgtattcctgaagattgttctaacactatgaccacgtaaaatgatctgcttaccacttatatttgttgcctacccactgtcataccatttatttaatctcttcaatcactctttctttcccatcatcattgtttaaaaaaggaaaaaaaaactttttggaacctgaatttagaaaatgatatttagaaaaacaattttcactataatgctggtagagaattatccagtatttatttttcctgttttaaacttccactttgactgtttgactcaggtgggagtattaatttagggataaaccacaaaacataagattaagagagtagggtttgggatacgtcgaaatttcagtcccggctgtgccattagctggccctgtgactttggggaagttactttctattcttcagtttcatcatctgtaaaatgaagatacaacagtacctacctcagacagtaagtagttcacaggattaaataagttaatgccaaaaaaaaaaattagagcattaaacacactcaactaatgtttgctattttaatattgtctttatcatcatcatcatcaaaaaattttctaggaaaaaacttcatacctgctggttgttctggctgattctctgttttctttacggagtattaagaatgaaagtacctggcataagctatccttgtaacatttccatcaactctctcatttgttgacatctgttttaccttgttttgaattattccaggacatttttttgttgttgtttctttttgacatagagttttgctattgtcgcctaggctagagtgcagtggcatgatctcagctcactgcaacctccgcttcctgggttcaagcgattctcccacctcagcctcccaagtagctgggattacaggtgtaagccaccacgcccagctaattttcgtatttttagtagagacggggttttccatattagccaggctggtctcaaactcctgacctcaggtgatctgcccgcctaggcttccgaaagtgttgggattacaggcgtgaaccaccacacccagcttccagtacatcttttaaacgccttgttaacagttattattgagtttctctgtactcacttgttctgattcttccctctaatgtcaaggctaagagtatgcaataaatctagtcatgggttatatgtaagtaaagaatcctgtatatgtccacttgaaataaattggctttattaagagcaagcacatgattctgggttgaacatgagacaagtcattgcttgaataacgtatattataaaatgatttggcaactttagattcacctgttacccaccccatttgttatgcttcccttatgttttatttaaaaatcattgtcctcaggctagatgtagaagttacaggccgtcatcatgtatctgtgtatgttaatattcaccctattgtaattagagtagggttctttaacctccgttcctcttttcctctgtattgatgatctctgagcaaaggtaacttgccaggcattctttggctgattcagaaaattttcaaaagtgaacaaaacaaagctatttacactttagggacgatggtggtaatgcagaagagtgaaaatttgagattatttactcttttttttttttttggtaatttcttttaaggtgtaaagcatcacattttcttcactctttgggttttgttgggggagggagagaaaagataggcttttgctttgtcacccaggctggggcgcattgacaaaatcatgggtcactgcatcctcaccctcccaggctcaagtaatcctcccacctcagcctcctttgtagctgggaccacaggcatatgccaccacacccaactaatttttttatttttttgtggagacagggtctccctatattccgcaggctggtctcaaacaactgggctcaagcagtcatctcacctctatctacttccgaaagttttgggattacaggtgtgagtcactgtgcccagcctcctcactctttgtcgtgtggatttgacttttgaaaaatagccagatatatttagaagggattttagaaatggtttgtcttactaatcataacttggtagtttaatatttttatttgtaagccacagcttaaacccttcagaaaaaagataaactacagtttctatgaccacagtttcagtccaggatttggtaccatagtagttaattatgtagtctttaaagtcagagataccttccctatcttggcttctgttgtgtatcagatatgtgatcttggacagattacttaatcttcactgtctcaggttgtttatctgtaatatggatataccagtagtgtctacttcatagattcagtgactactacaaggtagctagcacagtacctgttgtgtgagaagagctttttaaatgttaaccactatcatcaacatcctccttatcatctctgaaagctcttaagacagtgctttgcttgctgattagcaaacatttttgctggggctgtttgaaagtgtatgtatactctcagttcaacaaagaagttcatcttccaatgtagtatttggttttaaatggttttctactgtgtctcccttgggctagggtcctggtatatagagggaatagtggatgaaagaagttgttaaagccatcaatgatagagaaattagcaggtattgcccctttaactatttttagatcctgtatccagaaactgtgtctcaaatcctatagaatatttagggtaagtaaatgctactggtgcatttgcttcacttagagcggacagttcttagtctgcacactgaaaaggtttccttttgagagctttcttcatattaagttgagatttgacctatagcctgagtttaaaattagtcttccattaaaaaaaaaaacgtaagtattcatttcaatgcagtttgataaataaacatttatgtaaccaacacatcattcaagataggaaaattctatttccccaatccttatgcccccttccagtcacttcttacccacctccacagtcactgttttgatttctaatagcataattttgttggttcttaatataagcgtaatcatacaagtatttacttttgcattctggctttttttgctcatcgtattgtttgagatctatgttgttgaatataccattaattaattcttctttattgctgaataatatttaccacaattttgtctatccattttccaaatgatggagttttggattatttgcagtttttgactattgtaaataaagccacattaaacattaagtcttttcttacagagataagtttttatctctttggggtaaataggaatggaattgggtcattaaggtaggtgtgtatttaactttgtaaagaacaacctaatccattttcaaggtgataaactcctactagtgatatatgagagttccagttgttccatatgctcaccaacatttgatactgcagatgtatttaactttagtcattgtagtaagtgaaaaggtgtatctcattgtgattttcattttcatttccctgatgacagtgttcagtgtcatttatcagtaattattccagagtcatgtttgaacacattcagttgctcatcaggtgcttattaagtaccttctgcatgctcagtagtatgtcgagcttttaggagtatggttttactttaaaatttaagtacttgcaagatttttaaaaaatgtttcatgtttacatagttttcagttcttaacgtttttgataatgtttcttaatatctccaactaggtcacgtttgtataacaaaagtaagattgtcattcttattaagtagctaaaactccactgttaattagtacatgaagaacatacctgtttatttttgttgctctctaattagatgatacttgatttaatttgaccagtggcctaattatcatgaaattcttaatatttgtacaattgcaggcccctagcagtcttcttgatgctttggaacaacatttagcttccttggaaggaaagaaaatcaaagattctacagctgcaagcaggtatatcattctttgtaggccaaaaagccagagtgatttttctgaggcagtagatgaaaccagctcaagttccaagctgtttaatttctctatatcttgatttcattttctataaaatggatttaatcataatatcagcctcatagaattagtattaggattaaatggattaatacatgcaaattcttgaaattgtttctgaccttcaataaatgtcagcatctgttaagataatgacagtgactgcatagtttagaattgtgtttatgatgtcaaaatttctcctaaagatgctaatgcattgttttatgtggtgctttgtagttataagatacattttttttttcttcccccgaggcagagtctcactctattgcccaggctggagtgcagtggcacaatctcaactcacttgcaacttccacctcctgggttcaagcgattctcccacctcagcctcccaagggtgggactacagatgcatgccaccacggccggctaatttttgtatttttagtagagacagggtttcaccatgttgagcaggctggtctcgaacccctgaactcaagtgatctgcacacctcagcctcccaaagtgctgggattacaggcatgaaccaccgtgccaggcctataattgcaagatactttcgtattaatttgctcaatcctcacaatagccctgtgaagtatgtagtagcaatgctgggactcaaacctagaatatctgacatcaaattgcatcatctctgcctaatgccagttcatggggttgattattgatattttatattttaatcactttattatgttttaagctaattcctcagactaagaccatttaacctagcaaattgaaagtaacagaaatcatttcatatcagtctggtaacatgatttttgtattgggttaagaaattacttgagttattctcatgttttcttatgaacctttttttaaaacagcatgaagaaagaatttgtatagtgagaaccttcctttggttctttttagactttctggttgtttcagaacttttgatctttcttttagtaataaaatttaaataatttccaaagggaaatgccgttattggattttagtactcatttttaatcctagatttgtactttgaattttctagtaagattttcgaagtagcagtcaaaacaataagtctcatttatttgagagaataacgaaaaaaagagccacgtagttcaggtgcaccaatttacctgaaatgtttatcataaaatttattggttttcttgcatttctgtcacaactatgttattcttcctttgtcttctgaattgtacctttttattggcttatttataatactaatattacataaaatttaaaaggtagtttttaccactttacgtgcttaagagtagaaactaatgatgtttggtgtgtggtaaaaggaaaattaataaagctcaaggtagttcttcaggttagaattctttaccacttgttttacttagcctagagttaacatttggaaagttaatgttgaggtttatagtgtggatacgtttttgataaaagggaaaggaggtgccttgccagtgaaaaatgatacattgtacatgtatattaaaaaggaaattctggtttggcaaaagggcagcacatagaaagatgccaaatggcctgatgactagattgaaaccagtcttcttttgaaggaacctgaagtcctctggggatgttgttataggtgaaacatacctagacttacgttacgtgttactggtatgcatgttttggtgttcctgtggcactgccgaaacgtaggctgtaaattagcagagggttttccctgtgataaactcaacactttttcccatcagggattttgtgggattatgtgggctctttcccaattgcactggtttcctctcttggggcttggaagaggcaatgtgccccactctgttgtgaaccctttccaaagtcaaacacttactctgaaagcagtgagtgtatattaagtcaagatttttctaattgctttaatcctgtagatcactaggtagaatatttcatctgaagtactggatttgaatccagaagttaagtttataattatagtgcctatccatggcaaggttgccagaccatttcatgacctgggtgtaatgtgaagtgtttagcaaaaagccaaattatctctgttcaattatcctagggcaactacactttccaatgcagtgtcttccctggcaagcactggtctatctctgaccaaagtggatgaaagggaaaagcaggcagcattagaggaagaacaggcacgtttgaaagctttaaaggtaagtttgtgcattctccttatttcgaaaaatgagtacaggtgttcattaggtaaatggggcctctgcacagacttagagtcttaaatgtatagctacctaatgggctgaaactcagtctaacttttcgtcctgacatagaattaggtaaaacagaatatctgctatcagaacaaattagaaaatgcttttttcagaggctgtacaaagaaatctggtttctggaatccttatggtagttccctttcttaacaggaacagcgcctaaaagaacttgcaaagaaacctcatacctctttaacaactgcagcctctcctgtatccacctcagcaggagggataatgactgcaccagccattgacatattttctacccctagttcttctaacaggtaggagtagaagttaaggttacctttgaatatgtaggttcaaagacttctaatagaaattttgcagaacttttcaggtttacttttatttatgcttttataatctattcacacaaagaggtggcgataaatggtgatattggtataatacctaaagataaagtgatgagtttatattttacgtatttacgaaatggaagatagttaaatcactgatttatactaataggaatatagctgttatctctgggccaacttttcattgtgtaaaaattatgattaaacacatttatgaggcatctaatggttcaagaccctttatagctctttgacatatggatatgatatatatttcaaaataccatttcattagatattaaacgtctgtcatatctgtttcctggttttaaactctgtaatctggaacacagtgacagagtttagttgccaggtttcttggtattgaagcctaccagactaactttaataatcttgttgtctaatttaagctacttaacatggaaatataatattgccaggtaaagtaaaacaattggcattttctgaacctcagagtggcttaaagtagttttaaaagtcagattctggtttgaatcctggctctgttagttcttaactttttttgagaaaccttgttttcagatgagactgtggttctcaactttaacatcagaagcatttggagagtttattaaactacagatatctgagtcccaatcctagagttttgattcagtaggtggggcctggggcccaagaatttttgtttttaagatgctcccaggtgactaggttttagcacagtgcattattagcacatgttaaatgttccatagagagtggtgagttttttcctttcactttgttgttgctgtttattaactcacccttaaaagctcatctgcctgcctactgactcctaatagctgagcctaatagctcagtgtaagttttactacgtgaactgcttgctgtatgcatgctcagttgctacctgctccctgaaatcttagtaggtgtttgttgaatttagttcttttttttctttcagctttatgatttgtttgctcatgtatgctaccttctttaatccccagttaagtaacattgaccccattaaggggcaagttctcaacatggagatcttgaaaagaagtctgtcctaggagaaagaagtgaaaagaatgttcattgttcgaggctgaaacaaattattggataaagaactaatttcactatgttttatgtcacatactaaaaattttcacctttttaatagtaattaagggcaaatcttacagcccatttacagaattattattgtatattctatatgttccccaaagcactaaatgcgtttatatctactatctacacaactattgtacatctaaaagacatgtcttcaaaacttttttataaaaatacagttagaaggaataagttctagtgtttgatagcacagtagaattactaattaaaaacaattgtattacctatatcaaagtagctagaagatttagaatgttctcaacacagagaaatgatgaatgtttgaggtgtgatagatgtcctgataattacatggtatgcatgtatcacaatatcatatgtatcccataaatatgtacaattattgtatatccatttaaaaagaaaaacattctattttggagaatatataagttaaaaattaggagctgggtgtggtggcgtgtgcctgttgtcccagctactcaggaggttgaggcaggaggaaggcctgagcccagccgtacaagctagcctgggcaacatctcttggtctgtttgtctgtttctctctcaatctctctctctcttttgagacagtgacttactctgtcacccaggctggagtgcagtggcacagccatggctcactgcagcctcaacctcctgggctcaagcattccctctgccttagcttcccgagtagctgggactacaggcgcactccgcaatgcccaactatttttcgtattttttcgccattttgcccaagctgatcttgaacttttgaactcaagcagtccgcacgcctcagcctcccaaagtgctgggattacaggcatgagccactacacccagcctccagaccccttctcttaaaaaaattatctgtactgtgtttgaattcttagacactctggggtcatgttttgagttgttcattaaaatcacatagaagtcggccgggcatggtggctcatgcctgtaatcccagcattttgggaggctgaggtgggcgcatcatgaggtcaggagatcgagaccatcctggctaacacggtgaaagcccatctctactaaaaatataaaaaattagccgggcgtggtggcaggcgcctgtagtcccagctacttggcaggctgaggtagaagaatggcatgaacccgggaggcggagcttgcagtgagccaggatcgctccactgcactccagcctgggcgacggagcgagactctgtctcaaataaaaaaaattacatagaagtcttgaggtagaaatatatcatgtaagccaggcatggtgcctcccgcctgtaatcccagcactttgggaggctcaggtgggtggatcatctgaggtcaggagttcgaggccagcctgggcagtgtggtgaaaccctgtctctactaaaggacaaaaattagccaagcatggtggcatgcacctttaatcccagcttcttgggaggctaaggcatgccagtcactggaacccaggaggtggaggttgcattgagccaagatcacatcactgcactccagcctggacaacagagtgagactcttgtctcaaaaaaagcaaaacaacaacaaaaaaagaggctgagcacagtggctcacgcctgtaatcccagcactctgggaggccgaggcaggcgtatcacctgaggtcaagagtttgagaccaggctggccaacatggtgaaaccctgtctctattaaaaatacaaaaattagccggatgcggtgctgcgcacctgtagtcccagctgcttgggaggctaaggcaggagaatcatttgaacctgggaggcagaggttacagtgagccaagatcacgccgctgcactccatcctgggcgacagagcgagactctgtctcaaaaaaaagaagaaagaaatatatcatgtaaatagtgtgttgtgtgatggggtggctctattcataaatgcatgtaaaattttttccctgtatcattgatacatagtttggacactgaggcactagaagtgaggttaatgagtattttactgtgtagtgtattgcaaatgtgattcaagttctgtgaatattaaaagtaagaaaagagttttattaaaaatattaaaattgctgtgatattttgtattttagaatcttgttgtttaggttcattttaatagggaaattagttttttctaggggaagacattcatccttttcagaagagctactgttctttgaatcttatataaacttaagatatgatattagattatttttccaagcctccttagaaatatgctgtcatatgaagaaactgttcctcttttgagatttatattaatgagacttttctcccttgtttttaatgtttttatctgtggtgggtggagaaggtgacactaaagtagcaaagtttttctggtaaataaaacacgtttccaaaatatctttctagcacatcaaagctgcccaatgatctgcttgatttgcagcagccaacttttcacccatctgtacatcctatgtcaactgcttctcaggtagcaagtacatggggaggtaagcattgatgaattctattttagatgttacatgcatctctcctcctcattctgtggtgtttacttatttgtagttttttattacacttgatacatgagaacttgataagtattaaaatggcaatgaagcaattttatcccttgaaggtatgttcatttattataaataatttaggaatttatgttcaattaaattatgaaatgacatttaataaagataaaactaaatgtaagaggaaggaccaagtgtgtttttaactatgagattattcttttaatgttgaatttttattccataaccagaaaatgcatggtggttatttcgattttggtgtagaattttttttttttaacttttggggaataacttatctttgtgttaagtatatgatatagttctaataaaactcagatggtattatcacacagggaacatgttgtgaccataattgtctcgaccagctttatggtcaagacataaatgttttaaatgtttttttaattaagacctgaaagattttgctagtcaaagaattttccccttgtaccaataagaatgtttgctgcccttaagcagttctgaagtgataggcttatctctcatagcaagataagttaattattctaatgagtttttatagtatataaacaaagctttttttcattttattttaatgatttgaatttaagaacattttaaattatttttttgaaggaactatatcctagaaagtaagctctgtgaaggcaggttttaaaatattttgttccgacaagtagtttgtaaatgtttgttgaataaggtggggcacagagcagatagtaaaaccctaaaacactagatttcatggtaattttgtgagcctgaacttgatttaaaaaactaattgactttgaaggctagtttaatttagctaagttttaagatctgagagtaattcctaaaaatgacaagatattaatagtttaaagttaagtattttagaattatttcagaatgaactatagatagtaaattaagattaagaaagcagtttcttaatatcctaatgttatgttctgatttttggattcttaattattttctgccttattgtgaattgctttagaaaaggttagtagaattaacatgaccatttaagcagtttcagcttatttccttttttaaagaaatgtagtagtctttttaaaactaaggctgagttgtttttctaaatagactaaaaattttatagaaggccaaataaaaatatattaaacatttcaaagaagctgaactgcaattcctgttttgtctggacaccatgtacaactaaaaatgacaagttgaagtttctacttgaacttgttaaagtcacatatgaaagcagatagactattactgtggaagaacaattctaagtaatttcagtctgtaagaattgttctatgtcctgttataagacattattccatcaaagtctctatgtgacagactgcaatatattggaatacatttaatcatgttttacttttctattttcggttattttgctttgtatgctgtttctgtaaaaatttcccccatattaagtcctataaattaatcagaattaaatcctgtcttaactttcatataaggatatttggcttctgagttggtgataaacaaggttttgacttctgcatgatactgaagagtactttaagccaagaaagttctaattcaagtcagtactcatatccaggacaatcagatcgatatattttttttaatttttaaaattaaagttagactaaactaacttaaacttagactgaaataaagaaatctcatataaggccaggtgcgatggctcacacctgtaatcccagtactttgggaagccaaggtgggcagatcacatgaggacaggagttccagaacagcctcgccaacatggcaaaaccctgtctctactaaaaatacaaaaattagccaggtgtggtggtacacatctgtcatctcagcttcttgggaggccgaggcatgagaatcacttgaaccccggaggcggaaattgcaatgagccgagatttgtgccaccacactctaacctgggagacagaaaagaaaagaaaagaaatctcatgtatgagaagcttagatcataacattaaatgcttaaggtattttgaagttaactatttacttgaacacttaaatatgtaacattttacatataatgctgctgttatagtatatgacaaagcaaaggtatgatttttttcataatccccaaatcttgtactgttcttttattggcttttattagctaaaaatgaatgccaataacagacgtagtatttaatttagttcttttaaacaccacagaaatgatgcgcattcctagtcatagattagtgataagatagagataaagggaagaaaagtttatatgtatatatgaaagacatttaagattctaccttttggtagaatgaaaatgggagaacacaagctctcttgttggcctcattgtattattaatgagccttgactttttcaacaaatgttgtggagtctaaacaagcagtcggtattgaatactaatatctgagaagacctaggttttcatcaccctgaaaattttggatgatagcaaactttgaatttttatatctaaaaatatacaatattatcagtttggtacactgttgaatatttgaagcaagatttcagattttagtttaggtgtaatagaattatccattctgaagtttaatttgctttacttttagctggcatgaaacacaaaacacttgatgaaaaaatttgattatctgggcaggtgcagtggctcatacctgtaattgcaatactttaggagaccaaggcaggaggattgcgttagcccaagaatttgagaccagcctgggcaatatagcaataccttgtctctaccatgtttaaaaaaaaaaatcagtttagtgtgtgtgaatgtaggtatcagttgtttaggacttaaaggcgataatatgactgtggtgccattttaatccttgttttaactttttttggatttttttagatgactctagtgtagcataaaattaaacttttgcgccaggtgtgtggtggctcacgcctgtaatcccagcactttgggaggttgaggtgggtggatcatttgacgtcaggaatttgagaccagcctggccaacatggtgataccccatctctacaaaaaatgtaaaaattagctgggtgtggtggtgtgcacctgtaatcccagctactcgggaagctgaggcacgagagtcgcttgaacctgagaagcagaggttgcagtgagccaagatcatgcccctgcattctagcctgggcgacagagcgaacctctgtctcaaaaaaatgaaaaaattaaacttgaatgaataatgaaaaaaaaagggacaaaactatatttaaaaattttagactgggtgcagtggctcacacttgtaatcccagcagtttgggagctgagacaggcagattatttgagcccaggagttcgagaccagcctggacaacatggcaagaccttgcctctacaaaaaaatcggaaaatagccaggcatggtgccatacacctgtggtcccagctactcagaaggctaaagtggggggattgcttgagcacagaaaggtcgaggctgcagtaagctatgattatgccatggcattccaacctaggcaacagagcaagactcttatttaaaaaaaaaaaaaaaaactttaagggatttcgaattgccagtttaataggttaacttgaaatagctggagcgttattattataccttaatgaattggtttttattattatagtgtaatgtccattaatagattaacatcttgtagattacctgtagtgttttgtcaagtagattaggaactggttttccttatctgattgatctaattatgaatgcatttgcaaatatttctgaatattcttctctaaggtgtttcacgtaataggaagtgattgaaattaggtgctagataaaacctatctgtcagtagaacagcggatgactggtaacctttcctgaacatgtgttttctcataaaccaatggatctgttacagaaataatgtgtctttaaaaaattacgtatttcatggctttttttgcgtgaaaaacagatattttacttgtctgacaaaatataatgtacttttaaaactctatgcagctgttaatatcatgtatttaaaaacagaacattcggccgtgtgtggtggctcatgcctgtaatgccagcactttggggaggccaaggcgggtggatcacctgaggttaggagttcgaggccagcctagccaacatggtgaaacccccgtctctactaaaaatagaaaaatgagctgagcgtggtggcacgcgcctgtaatcccagctactcaggaggttgaggcaggagaattgcttgaacccaggaagcggaagttgcaatgagctgagatcacaccattgcccttcagcctagacaacacagcgagttcgactctgtctcaaaaaaaaaaaaaacaaaacacacccagaactttcagcctaactggccaactgtaagcttaatgcaactcctttcttatgcaagaagaagctagagtggccatcagtatatatattagctaaaatatatatatatttttagtactaaaaaccaatgtccttgttggctcatgcctgtaatcccagcactttgggaggccaaggcaggaggattgcttgagtccaggcaggtgttcaagactagcgttggtatcatagcatctctacaaaaattaaattagccaggcatggtggcacatgcctgtagtctcagctactcggaaggctgaggtgggagcatcacttgagcccaggagtttgaggctacagtgagctctgattgtaccactgcagtctgcctgggcaacagagcaagacccactctcaaaaagaagaaaacaaaaaaacccaccgtgcccccctgcaacttcttgtaactatttaactattttctagtttctatttctgaattactgttttctgattcttttttcccagtgttccatttattgggggtggaatgatgggaaagatttcgagtttgaatagcataatcagcatattttgatagatttgtaggacttttttttttttagtgtgaattgatgttccataagaatactatatagaaaagttcttactacagaaaaagttgtatttaaaagatgtgttgtttttaaaatcataacctgagtattttcttgatttttttttttcctttttcagacagttgtatttgagcttgtagaatgcttgccttgaattttttgactttaaaggaagtgtgcctatatcatagtaaatgagctggtccttaggccactgttgccttcttaatgttcaatcatacaatcttaagagtaaaatacagtacctagtactatgaagataccacagtatatttcagtgaaggtcaagaactaaactagaacagacaagaagattccactgttgagaattacaggagtatcctcttattttaattatgttacaaagaaaaaattatactatttttgctgctttttattttttctttccccatttagttagctctttaaatcttgagaagtaaggaaaaatagatttcagtcattagaatgataattatcttgaataaggtatcagtataataattatctgactctagaataactttagataaaggatttgatataatacatatttatatcattctagtaggcaaacaacacttttgttgttcctttagcaattcatttaaagactaaagctcttagatagacattcaaaggtgttcgcagtctattaagtggacattctttcatctctgttcttaattatctaaaattctttcccccatccttagatttttttcttcatctttattttttattttgaatctatgcaggaattatctgcacatgccaaaaacagcttcttagccctaatttgtcattaccctctttttttctttgaaagtttactcacaacacacataccaattgtcaatatcaattattcaagtaaacacagctataccaccacgaccagcacactcacctaggacagggaagattggtgcaagatgggtggctctttatagaaacatcttggttattattccattttttaactacctgactgttggctttgtggtgttaacaaataaaaggattttttctaaggattcacttaaaaatatattaaatgcaattcttctatcttgatgattaggtattttttgtttttgataatttagatatttaagattaataaacaataatatagttactacttttcactttgcatcttttgactaattacaatactaatttatttacttcctttcttcattttgctataatacatttggactgcacagatcctttctctgctactgtagatgctgttgatgatgccattccaagcttaaatcctttcctcacaaaaagtagtggtgatgttcacctttccatttcttcagatgtatctacttttactactaggacacctactcatgaaatgtttgttggtaaagtaccatttaacctttttttccaatcaatgtttatactgcctaactatattttacgtgtccattaattattttaaaagcactgcaatagttactttagattttaatatcaaattctaaaactaaccagccataatgtagtgaggtttttaaattgacactggtatcccaattttatttatacagacttttaggaaaatttctcttgatgttgaactttttttttttttttttttttggtgtttggttctctgtcgtgttatagtgcaatactctagctgtctagtatcacatgcagcttcctgttttagtttggagaactggttgaaaagtaacatcacttaaacttacatgtttatatgtgattatatttttctctttgtgcttgggagagagggtggttaatcactcttagcagctatctttaatattttatttctcttttaactgttgcacgtcacagttttatattgtccaaaatctatgcatatcttttatcccattctgaaggatttcactttattgatagtatggagataaaagtaggaagtatgtgtttcattttaaatagtaaagcagaaacacgacttggatatcctgtaattacagtataaaaaggcagaatttcacactgaggttatatagggaatagtaagttttaaagtatatgctgaagctgaaataaatgtttttgaattctgctgaaaaagatgctaactctgctccccctcagccccaaagatgatgaaatttcttttgttcagttcagagaaacagcttaacggtgatgtgaatttaaatatttgattaaaacagcatgcagaaagtcatcagtataccctcaacaaatcatgtgaccacattctaaatattctcttagatatatataagtgagaggaaggaagagaaggaagaattaactagaaagcaagttagtagatcagacaaagttccaagtcaggtgttgtaaaaatatgactagtctaatagcttaaaacacatatatatccaaagtgtgataattcattgcagtaattccttcatgtcattttgatacaagttgccagcccttactctataggattaagaacaatccagaaaaatcagaagagctatgtatctagatagcctctgaccttgacagagggaagacatttatctgatacaatgatcagtgtaataggtagcttgtcctcattgaagctttaagaacactgaattgtacataaaggagagtcgtggtcttaactatgctgcatatgtgagtgtctgtgaaagtgtgtaggcttgctttcttagctgtaaaaccacacattagaggacacgatagtgttggctaaaaagccaactgcctaatatttcttttctaatgagatacagtgttgggtttttctttctaatttatgcaaacggaatatgtttttttaatacttcatggagccttaagttctttttttagcaagttgtaatttgaagaatgccaagtgcttgggctccccccattttttgtttttcttgattacccatcccactcataactgttcctcctcttctctttcttttttttctcttcttcctcttcttcctcacgtgcctccctagctgcttccctgattctttccttccccttcccctctttttctccctttccttactcctttcctgccttcctgccttgtatgccttgtcagaattttttgtgtcacttaagtttgtcctaatacttcctttatgtgccttgtttcttctactgtagccagctcatttggagctagataacagtatctttacaacttatttatgcaggaaggattttttttttcttaaaatgagtttttataaacttggtaagaaaaaatatacttatttgctttcagagaacacactagtttttgcctaacttcatttgccttaattaaacacttggtggttttatgaatagttgcttatcatcttcttactttactccattctcaaaaccttaaattttcagaagcatgaaaacgttttaatattacaaggttatggaatctgaagttttgtattatctatgtctttccacatatgttcaaggccagtgtggtagcaataaaacctcaaaagtccagctgatattttctgtgtgcatagtagttattactgtagttaagttggcattaaaaagaatgtttgacacaactaaagaattgaggctcttgattacaagaattggacaggactaaatgtattttaaaatggaatttattagggcatttgatggtatatgcttggagcctagtgaacttaggtttgaattttagttctgcttcatgaacttgactttaagcaagtatttaacctttttaaggctatgcaagttgggataatagtgtcttgcaggattgtcctgaagtttacatacatgactatgtaacatctagcactttgctaggtatataaaagtatcaaaatgactactactaaaaaccatctcgggagctgggtacagtagctggtacccataattccagctaattaggaagctgaggcaggaggatagcttgaggccaggagtttgaggccagcctcggcaacatgcaagaccctatctctcagaaaatttaaagaatttaaaattcttgtatatgtggaccacatcataattagaatgtacttctcacctaaattattatgtagtcatcaactaaaatcctaaacattgattttttctttattgcttttagattttaaaattgccaaagattattcactttttttggtctaatattagcaatgaaaagctcaagaagttcataaaatttgggttgtttttaataatagttatagcaatagtaaaaaatttctttttctacttactatattatgtaaggtgaaatacttgggattaaactgaaaaccctaatagattctagaatcaaacaaatgggggttcaagtcttggttctgatgcttactaaatctttgaccttgggtacattatgtaatctctctttgtttcctcatctgtaaaacagggataataataactatgtcatagggtttatgtgaggtttaaataataccctgtttataaagcccttgcttagtgcttagtagtgtttaataaatggtagtagttactttgacaaaaaagtatgagtcctaatttattgtgaaactaccaccaaaatcaattaacaatccacccaaattttgtaaaaggtgtttggaatgtctttctgtccccaaagcttgttgatcttgtacttttcaattaatttattattgtcctcttgagatttaacctgcaggccagtggtttctaaatgataaactgtggattggtgctggttagtgagaaagttttcactgggccttggtgaaatggaagagtaagcaggacaatgtaatgatatcataaagttaaccttaactcagagctcagcgcctgctctttttagcatgtgcgcacgcgtgtatgtgtgtgtgtgtatttctgtaaactttctcttttagaatagtgatactagctgggtctttttgttttaaataacttttaaaaattaaaagttggcgagggccgggcgcggtggctcacgcctgtaatcccagcactctgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagtggagcttgcagtgagccgagattgcgccactgcagtccgcagtccggcctgggtgacagagcgagactccgtctcaaaaaaaaaaaaaaaaaaaaaaaaaaaaaaaaaaaattaaaagttggcagtcctgatagtttcacaaaaagtcgataatgtgcattgaaattatgatgtaaaactctaaccttgttggtgtatgtgtttcaggcatgcagtaattacttaaaagatttttactttggaaatttggaaataaactgcttgcctccctgataactgtgtgactttaagcaaatattaatagccgattagctattgcaatttattaatttctttttttaacttttttttactttttccctctgtttatagatgtttttaaaacttgagatacaagttctgggttactttatagtctttctaaccttgtatacttttaggtaattatgtcataatttcacagattggtacctctaggcacctcaggagatggctcctctttttacagaaagtaatgaagtaatttctgtgtgactataaaggataggcttatctcttatatcaatcatattctagaaggctgaggcaaagtagcaggagaaaatgggaatttgatatattggcctaattttaaattgttgttccatatataatctaaaagttagtgacatcaatagccaagattattaccagaatgatttaaagaacattgtttgtactacttacactctgatgatagcatggacacataattaagcatgatggatttttttcttgagtagatacattcgctttttatgtaaagagttaagagaacaaccaataagctgatggcataattcttaaacaccttgcacacttaaaaatattattaaattggtaagtctaggattctcagatccttttgatgaatagtcagaagatttatatactaaattatttcgtattttgatagtgttttgtgttctcattgtatgaccaatgtctttgacttaatagtagtttaagggttacgtgattatggaacaagatcaaactggtacattctctaaaaatgtgtgcgctacagaatagtcattataggatgtgtaaaatgctactttaaagtagtatcattagtgtggatcagcttgtatggttctttgctaataataaattgttgtttctgtctttgaggaccttcttggacatctcaccaaatcttgtcctactttttacagttttctttgagatcagtctctctagtacagcatgacatcattatactttatgtcctggtgttacacattaagaattcaaagtgagattctgacctgaatagaggaggggaagaaagggatcctaaatttaggacaccaaaagtttaacttctccctaatggtgtagtttttaaccttctaatataggtggtttttgtttgcttcttgggttttttatattctgacttagtagaatttagaaaaggaagagaccttaggagccttatgacattccacgaggtgaaataatttcttctttgtgatccttgtgaggttgatatttatttggatatactcaatgattgaaagttctccaaatcacatgacagacctaatatttttaggggattttaattcttttcagcccctagacattcagaaccttacttaaatataacctcacataattggaaatcttatatttgttaactctgtataggctgatcttaaagatgtgagcttattgtctgtgtaataccactagcattagtgtaacgcaggcaagaaagaataaggtctgttaatggttttgtgttgcaaaactagagtcaccttaattagtatgcttgagtttgtgcttgtcatccccactgttgcaagtactaagttgaagttagagagtggttgagagttgaaagtggcatatcttttttctttgatgttttaaaagcatatggatacaggtggacataaggattagtgagttggaacattcagaatcccatcactgaacttaagctatttcgcttttgattaactgttgaaggaaggatggagagaaatacggaaaatgggtaggtgggagggagaaaaacttttatcttggggctactagaagtttcatacttgttttttaaagcaccacagaattcttactgcattctcagctgatcccttaaatgttttgcttcatgcaaaatcttgtaattttagatgtgtttagttttttaaagattatctgcatataaaattaaggtaaaagataagcaaagatttctgtaatgaagcatattttcagttcagtgtgagttgctcatttgttaattttgtcagtaggatgattttgttagggaaaacgcaatcactgcgaaaaatgtgatatagaaaacattttgcttgaaggattggctttgtttttgtgtggggaatttagtgcattttccattctattgtcatcattattaaatagtcgtaaatgtagagttattaaataattgagcttttttccattttggtttactcaggattcactccttctccagttgcacagccacacccttcagctggccttaatgttgactttgaatctgtgtttggaaataaatctacaaatgttattgtagattctgggggtaaggaaaaaaaattttattaaaaatattataatgtcctaatttagattctgtgtaaggaaaaataatgctgcttttaaaatgtttagatatattaaactggggtagccaaagaaattgtcccatccccccaagcactagatgagaacttcaaggagctgtttagtcattattcttttattggtgccaatttagactttgggaagagtgagttagtcctagagcaaaataagagagaaaaagagatttagctctgtagaatgctaagttgcttgtgactatgtgtagatgttgtgcctttttaggcatacaatttttacttttactgaaatgaataataactgtattgtctcttaatgtatgaaattggctatgtttgtaaactagaataatataacttgtggtaccttgacttgtttaaatagtctgtgtataaacaattagaatgtattaaataatcaggcctgtgggtacaggagctttttattgttttatgaatgattcttattatggttcatttgtcttaaaggaactttatagatctgtagaaccaggtttccactttgtgttttcattaataccttgttaatttgaagtgcctgtaaaactttgacactcataattctgttcttaccatcggatggcctttgattttggttagtaattaacttttagccatttagagagaatatattgagatgttcttaattttataacatataattagttatccttcaaaaactaagaagcaagcctataaagaatatgtatggactaagaatttatttttttctatgcactagtaggtttatgataatatttttttgctgcggtaggttttagtttgtcttgcctgggaaagtggaaagagagaccaatcattgttgtgaactatcatctttggtgactttctttttcaaactgtaatattcctagatcatactattgagtcccatagagggtttgtttgattggattttcttttattttctataatttggtgaggaaaacttaaagaattttattttcatttttaagaattgttctcatttactagatgggcttatacaattacagtatttagcagtttcttagatatagttcactcttacattctctgcttttaaaaaaaaggtctcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagctgggcgcggtggcgggcgcctgtagtcccagctactcgggaggctgaggcaggagaatggcgtgaacccaggaagtggagcttgcagtgagccgagattgcgccactgcagtccgcagtccgacctgggcgacagagcaagactccgtctcaaaaaaaaaaaaaaagtctataaaatcttatttcttaacgtaaaaggaacttttttcaaagttccagagagctattttttaacctatattgctttagatataagtgagtcttcagaaaattttgctgggctagcaggagaattacatttgttttttttctcttttataatacttctctcttatcccctttaaccctaatgtaattttgtcatgagataagagatgatttctgtcaaagcaaatacagccttctcagtcaattcagtatgaagtggtgactttcttcattttccatttaaagacatttactaatgtctattttttggataacttttccagtgaataaacaaggagaaaaggcaaagacctcctttagaaaaccatagcgtcataaagttccttacaaattctatttcgtctgtttgtaactttaaggctttgatgaactaggtggacttctcaaaccaacagtggcctctcagaaccagaaccttcctgttgccaaactcccacctagcaagttagtatctgatgacttggattcatctttagccaaccttgtgggcagtaagtagtctttggatacgttaatcttcttttatgttgttttattaaactgcgtctcgtgttataaaatgcttttttgtttttctcctttcctagatcttggcatcggaaatggaaccactaagaagtgagtgtttaatatacacattgttttctccgtgtgttatttagtgttttctccatgtgttatttggagggttgatttggctttcctctcaaaaatatgtgtagagatatcaagtctgcatcttttttttttttttttgacacggagtctcgctctgttgctcaggctggagtacagtggcgcaatctcggcccactgcaagctccgcctcccggattcacgccgttcttctgcctcagcctctcaagtagctggactacaggcacccaccaccatgcctggctaatttttttgtatttttagtagagacggggtttcgccgtgttagccaggttggtctcaatctcctgacctcaagtgatttgtccaccttggcctcccaaagtgctgggattacaggcatgagccaccacgcccagcctcaagtctctatcttactctgttctatataagtatatagctaaggaaactttataattagagacatttaatattctcacttatgtttatttaaagtgatgtaaattggagtcaaccaggtgaaaagaagttaactgggggatctaactggcaaccaaaggttgcaccaacaaccgcttggaatgctgcaacaatggtgagttgaaaaagctcctgatagactaacagttgaataatttagttaaatatgtaacatgaaaatgtttttaaagtgatagacataaatagaaggattgttactgagtttagaagtataagtaattgtatttctttcaaaggaagctggttgcctatatttaccagatacattttagtggctaacaagtatttaagggttactttgtgccagacatattccagtaaataataatgttttattttttataatcctcctattaatgtgttagtcactattattatccctattttacagatgaggaagtggaggctcagagttattaagcaatgtgctcaggattacagagatcttaaatgatgagttgaatttttataacctaggcagcctaactatagaacatatgtccttaatcactactctatattactgacctcaaattttttatttatttttctaaaatacaaaatcttgtgatttcattattggtaaagaaactatacttgcttcggttttgtcatataatttatatatatgacaatgtgtttggcaattatatatatgtcatataacttacacagttgatactcattatttgtggcagttaagtacttaagtcaccccaaacactgaattagtgaacactgaacccttgctgggggaaatatatgcatatatgtatatgtcacatagacggtccttttagaaaacctcattctagtatattctatttattttatgaaagaggaaataaagttcagaagtgttaagtgacttgcttaaggctgtcgcactaactggtgccagagttggaattttagccctgtccagctggccccagagtcagagtttcttgcagtatgatggactccccatcctccttctctatcctctggtctggtatgagagctgaaccaaggcagagtgtcctttgttccatctcagctggaggtgaactgtattggatgagtcaaatttttgcccctctgcaaatgagcatgaatggccttgaaagcaccaggagtgttgatttttggtgtcacaaagtttatcatgtaggtgaatttgcaaatatggaatccatgaataatgaggattaactgtattttctaattaaataattagcatctagtaatgaagaggttttagtatgttttaattactgtaaggtatggtagacccagaatagctctgtggctattctcctgtccttggccagtttctatcttaccaaccaacaaattttcgtcagtcaaagaaaactccttgtggaaaagtttgaagcattctttctccagacagtaggctagtagctgtgttttgattacacgggctacacgttactgacagctgtcctgttactgttagaggctgcggttgtccttatagccacttccagagcactgccctgttttccgtgggttaatgatatgttaaaattagtaggactgagctaaaaatagtatgtttgttaaaatttgtgcattttattatatagcttaagacttcataaatggaaagtaatattgagatttagctacctttttaaggcagtgtttttttgttgttgtttttgttttctttcagacagtgttcattgccatcactaattttattattttgtattttttttttttttgtgacggagtcttgctcttttgcccaggctacattgcagtggcgcgacctcagctcactgcaacctctgcctcccaggttcaagtgattctcctgccttagcctcccgagtagctgggattacaggtgcccaccaccaggtccagctaatttttaaatttttagtagagactgggttttattatgttggccaggctggtcttgaactgctgacctcaagtgatccacccgcctcagcctcccagagtgctgggattacaggcctgagctaccacgcccagcctatcatcactgattttaaaactttgcatttaagtagtttagatttttatacacacaaatacacaatcttaaacatgtaaatgttgctgtcttgagggaattggagcatgtatcaccccacttctaaagattttttttttccctaagtgcaaagcagttgaaaagcagatttaagttgaaatccatctctttgactctgaatccagtcttcttcccactataacacacctcactgactagggtatggtaggagtttagagtagtggattttatggactcgtgtgaattatgacattgatgatgtatgaggaatgatataaataccagtgctgctattaaaatataatgaatattttcttatattaagttagtattaatctatatgaagtattaggagttcatagatagcacttaagactgactactaaaatgtagtaggtatttagtcatgtagaatttgtatttaagttgataaggtaacagtctttatcttgctgtgttatatatggtaatgtgtatcatctcctaaggattttgcttaaatatttatatgtattttatggagttttctttttaatggctaatgtttggggctgataatgtgattcactacttaagataaactgctgcttttgacatttctttacatttctaacctttttattaatccttaaacactgtcaaggtttttcagtgttttttaaatttaacacaaattcattggaattttattaaaatatatattatactacaaattcttttaattagtgcttgctttttttctgtggtagacatctgatgcaaccctgtttatgcaatgcccaaaattttgcactgttgacactgttgatagaattgatgttttaatggtacttgtaatcaataaactattttttatataaagagatgaggccaaagactacaattcccttgtcaaccttgatagtgttttagtatagatgttctttcattagatactggaaatacaagggattttaggtagttagtgaatgtacatgtgaactaaaatgctctctgtgtattttctgttgtgtaagtacttgttctaatccagtgttattgcattatgtaattgttctccctgggaaaaacagaatggcatgcattttccacaatacgtaagtgaccaaaaacgagcctttttgcaataaattggcatgctattaaccactgctgtagcagaatctcataacctttcagctattacttgttttcacattcagattttcaatgtgccagaaattcttcctagcatctactgatttcatgggtgtgttgcagaattgattctgatggtggcatgggaaataccgattttttttcttgcttaatattccgccatttgctgccagatggctgggtgtctgtgtgtgtatctgtgctgccactatgcacttgatgacttctgaatgaagggaaatgttgattgtggtaatgtttaaaataacaactgcatgaaatcttacaggcttctgctcttcttggcagtttgtctactgctcttgcagatcttggttttaagtagggagagaccaataagtcctacacgctcacccgaatactaaacttataactattcactttagtgttatttttttaaagttatatttcatttaatttctccatgcatatgttcaaattgccatataatttcagttattttatgttttagcagtgttattggtctttcacctttattcaatttcagttttcattatgagaaacacacacaggaaatgttgttaagacagcaactatatctaaaatgattctgttctcaaattgtatgtttacagataatcaaagtagtaggaagaggggaacttaaacatcatagtgatagatggttcttttaaacatgaaagcataaactgacctaattgattgttcctcttaaataatttttggaataaattagaaagctaacgtacatactctatataagaactatggctcatagaaatagtcatactcaatagtagtttgaaacctttggagttttttgaaaagagtgagtaagatccttagaaactaactttttggaagatcaggttattgattgatttgagatctttacatttttttctttgaatgctaaagcaatcaggtacctaagtaagaaaacattcaataatactttttctgggtagacattttttaatgatagtgataggctttaaattttagaactatttagaactatttaagatacttttttaaatctaaagatttttaaagctgtaaaaagcatgatgaaatcttagatcactgctgtatctaagtttaagtggtatagttatccttctaataagtctgcttttctgctaatttcaaaacactttttttcactgaccattaatcgacagttcttaatgatcacaagtgtcacttactcacagctgtcttagcaattctttttagtggaactacagctactaattccttgaactcagttgacacacatgagttatactttcttgttcatttttcctttcactatgttaggcaccccctgtaatggcctatcctgctactacaccaacaggcatgataggatatggaattgtaagtattttcctaggtacagcttttggaaaaaatattgattcatatataacatgtttttattacaatttaacctaaaaaagaatttagtgctcctcatactcctagccctagtgcctaatgcagtagaaccatagcattggtttcataagtatgtctagaataatcattatacaagagatcttatgcattaatgttcatagtattacttggtttatttttctcctcgtaactttgctgggccttttatatttcaaacattaatgttaattctaagcctttgttgctgtgaccatatattaaataccagtgaggtcttataacctgatattgtagggcatgggagggattaacacttgaattgtatagagataaatttagtctgataaaggctagagaaattttcctgtgacaatgattattacagtacaaaaacagtcttttaacctttcaaaatgccacaatgtgcattttagattgcccttagtttcccaactctcagtatatagagactcaattagaaaagaaatggtgctagtagcttcaacccactggtatgtatttgaggaactgttcctggtagaaggcagtaccgtgtcccttggtattgctactgtgcctgctatgttacttctttatgtatatgatatggaagtaactccttttatacatgtggagaagtttcacagctttttttcatagtcattgcattaaaatgtctgctgaggctgggtgtggtggcttacgcctgtaatcccagcactttgggaggccaaggtgggtggatcacctgaggttgggagttcaagaccagcctgaccaatatggtgaaactccgtctctactaaaaatacaaaaattagctgggtatggtggcgcacacctgtaattccagctacttgggaggctgaggcaggagaatggcttgaacccaggaggcagaggtcacagtgagttgagatcatgccactgcactccagtctgggcaacggagcaagactccatctcaaaaaaaaaaaaaaaaaaaaaagtctgctgagaaactcaggccataaacttaaaatgaagctctaaatgcaaatagtagtctgcttgaaacaataaatagaacttcttgaaaggaaagattttagagcattgcattttaaccaaaacagtattctgtttgtgcattatttttacactaggtattgtcacttactaggttaattttataccctgtagtggtaatttttaaagaaacatatttggttgagattgtattttcagttactcaagaaagagttaacctctggtttgtagtttaagctctttcttgattcttatatgaaataaaatggaagaactagagcaggcttattcagagaatcaactgtcttcacttgtgatcacttgcataatggcaaaagtacttgatttgttatacaaatttactttgaaatttcttagcagcgaagacagagtcttaagttttcttgatgtctaaacctgataaatttggaaactcttagtcttaatcattttatctgttgtaatacaataaagtttacattttgcaactcattgaatagaaaaagttaggctttgttactacattttaaaaatgagcatgttaaagactttacttaccaaaagaaaaaaaaatactctcgaaagtttgtagctgttagtcttacttatattcagaggaagttaccctttgagtcaagcaaaggtactaggacctgtcatccctgttgtcattgttatttacttagtcacaataaggaagataggagtcagtatcttttgatatttttctcttttttagcctccacaaatgggaagtgttcctgtaatgacgcaaccaaccttaatatacagccagcctgtcatgagacctccaaacccctttggccctgtatcaggagcacaggtattacacactacatgtaactgtggtaatgtgtttgatttggaaggaatatgatactataaaacccttttgtacaacttgagaaacaagttactagcactttctaccttcattatggatattgcttgcttcatatctttcttatataagagctttaggaatattgattatttggagggaaaggataagtagatagcaaatactaaagacagaaaattcttggtaacttatagttggtagatccaaaggatgatttttctgagattaaggagcctacttgctcttcgtgattctggtgtagtatcctttgtgaacctcaaaaccattaactcagagctttagttccttggctaatggctagaatgatgctacagcagggcgtgttggccttgagatgcttgtgaaactcttggcaactctccaaaaagttttgaatgttattttttcgttagataactttctgccactgaggattgttttcaaaaaccaaaaaaaggagtcaaaaagcttgaaatgtcatgctaaacttagatggtttaatccagagactttcctcttgacgtgtttctaaggcttttctctcctagttcctgaaaatacaccataaatatacattgttttttgtcccattattgttgcattagaagaattttttttttttaatgttttacccgttacggttagaagatataggaaattcctttgttattcacttctctggtggcatactctgggatgaggctcttgtgaagtgataggatggtttatccttctgtgtctgtggctctgctcgtactgttttgacatctagaagtagttaattatatgcaattgttagaacacccctccttttcttaaatggttgctaatgctaactgattggttatgtgtttaatgcttgaaaacatttgaatgagcatttgcttagtggacttgttattcccctttcacttgaatgcatatatattacatttgccaaagcatatagtcttacattgccaatattagtttatttgatccaatttgaatctagtctctgtgcacggtagtcccctcttctctttgggggatatgttccaagacccacagtggatgcctgaaaatggggtagtactgaaccatatatatgctatacatacatacctctgataaaggttaatttataaattaagtacagtaagagattaataataatgaataatagaacagtaacagtgtactgtaataaaagttttgttaatgtgtgctcttgctcacggacatgcttgctctctccctctctgtctttctcttgaactatcttaatatcctctacttacctattttcagaccacggttcactttgggtaactgaaaccacagaaagtgaaatagtggactgtatttcatagactagtgaagcctaggcaatcctttcatttctcagccgttttgaataatgcgtctcttaataaattgatatctctgtttggctgagagtgggtagtgaatttagttctgattaaggggtaaaattcatgttggttgcaattaatacatttaccaacatgcctctttttttaccccaccctttgtccatgttaaaatgacttcctccttgttctttaatcagttaagtatttacagtgaaaattgaaaataacttggagtgagggtaattgacacagtcattacttttataagtcagtcactttttgtgcatttgtttttataaaatagactatgagtgtttacagtatttatagtaattgttattgaacttttaccagcagtaatctcattactggtttaacttgataatcttttaagaagtatatggatgatttccctatctgttgtagatgttttcttgatacacagttaatgtctttttcatgtccttttgttttttattttgttatttgtacatttaacttcagatatgtatcatttactttaaaaattattattattattttggtacaagagactaagtgatagaaacctaaatgtatttaagtaattttttttaaagctatagtccatgctaaaaacttattagggaccttcgactacagaagtgtttttcctgatatgtagttaaacccttcacccactctgcatcttgatttgcaggctgttgtcagaatatattgctaccttaagcttggatactaccagacaatttccaattactttcacatacattgtgttagccgattctttaaggtagatgggtctgctctcaccgtcacatttcataggtaaagaagacagacttggaagggttcttcaactaattaaatggtgaaatcaacttatccccaggtgtgtctgattcctagtccagtgctcatttataccacagtctctctgctagtggtactgagcccttactggccaatacggtagcaccatcttctttcgtcagcagtgaacagtctgcacactccttaggtttttctgctaaattgtaaaccacatttacacattcaggatgtaactactatagttgtaaagaatattctctacagttttgggtaataaccttcaaccttgaaacattgtgtatgagttttgctttttaaaaacctaaacatttttttttaatgttggcaaaaatctacctttaaaaaatttcttgttggccaggcacggtggctcacgcctgtagtcccagcactttgggaagccaaggtgagtagatcacctgaggtcgggagttcaagaccagcctggccaacatggtgaaaccctgtctctactaaaaatacaaaaaattgctgggcttggtggtgcatgtctggaatcccagctacttgggaggctgaggtgggggaattgcttgaaccagggaggcagaggttgcagtgagcctggattgggccattgcactccaggctgggcgacaagagctaaactccatctcaaaacaaacaaaaaattgcttgtcatccagcatctgctctgtttttgttttgttttttttttttgagacagggtcttgctctgtcacccagactcgagtacagtggtgcgatctcggctcactgcaacctccatctcccatgttcaagccatcctcccgccttggcctcctgagtagctgagattactggtgtatgccaccatgcctggctaatttttgtattttttttagagatggagttttgccatgttgcccaggctgttcttgaactcctgagctctagcagttcatctgcctcggcctcccaaagtgctgggattacaggtatgagccaccgtacccacccagcatctgctcttaacccaggttttacgtcctgttgccttctaaaacccacataaccgtttcacagaaacaccagaaaagtgccagaatttccttgtgcatgaaaaaaaacagggacagaaataccttttcttaattactttatatcagaagagaagtgaatgagaacattagggtaataagtttctagttgaaagataaaatttgaaatgagtacttaagtattactgaaaaagcaaatgaaggaagcaaattgataactaggaaaataaaatcaggcagcaatgaaatggcttgaagaagctttggtctctctacatagtcatttgaatcatttgaaagtcagaatcttaaatttgttaatgttacttttaattattttgtaattcctttgttctgcatgtatctaatcacaaagtctcactaattattcctctgctataattagacccacccttctccttgcattctacagctttcacccagtcttggaacctctttattcacacttgttttgcaatagtcactcatgttctctgcctccccgatttaatccgttttgtaaatattggaacaatcttttgtaggcagtatttgtaatacccatctccatactcaaacatttagggaggtgaatcttttttgtgtgtgggtaatggagtctcactctgtcccccaggctggagggcagtggtacgatttcagctcactgcagcctctgcctcctgtgttaaacctcctgcctcagcctccccggcagctgggattacaggcacacgccaccacacccaactaatttttagtagagacagggtttcaccatgttggccaggctggtctcaaactcctggcctcaagtgatcctccctcctgggcctcccaaagtgttgggattacaggtgtgagccactgtgtccagcctaaggaggtgaatctaaatataactgaacatttaaagccttttctcagctttccttccatcttaaaacaacctcatgaagcctccctatttataagagtaataatgagttaacggaatattcaagttcttcgattccatgcttttacaattctcaataagtatccagtgttctgctgttatttgtcttttccataagtccttcacctgccataaagtgggtttattctttgtccagtcttcagtcatctggtgtccctttcacatccttatgagatctggaattcttttccttattctgcattattttttcttacagaccttgtgactacctggcatccatccagtctagcaagggctttctttactagattataagcttcatgaaggcaagcttctctggcatgtttacttctctgtccctagttcctagaacagtgcctgacatgtaatagtttttggacattatttgttaagtaaatgaatcaccttgtaaacttacctttttcatcatataacttactctgcccctccttaatctctcatttcacttacttgtaaccattataataacttgcagtggtgttcaaaattggtttgatttgttggctaatagttatggtgagctaaaacattagacggctcacctgaggaatgaagacagctttattttatgtttatgattgaacatttttaataattaaaaattaaactgttggccgaacacagtggctcatgtctgtaatactagcactttgggaggctgaggtaggaggatcacttaagtgcaggagttccagaccaacctgggcaacatagtgagactgtctgttttttaaaaagaaaaaagtaaactgtttatctttgaactagataaggtttttctcatgctttaaagcatgtttaatgattctcagccagtctcttggattaattttgtccgtagaatgctagccgaaaccaaaagatttttcttaatgaattaccttttaattgttctttcattgttttgttccctttttttcaattggattaaaaaattattaagggcagagatcatccatctctttgtatggggtaaagtaaatggtagtttaaatgaaaaatgaaattccatcaaaatggaatcttttaatcaaatctaatttctacagctgttcccaaaattcttccttgctctttgaagtgtttgttttgagagctgttacttacctaaggcataacttgtagctcttggtctcttgcctgattactattatatcaagttaacatttttgagagagctctagccctctcagatacctttatcttgttgccatttagtgagacattccagtgtgttgtgtgtcttacattttatctaggttactctaagcactgcattagtgcttgtttatgaggaagcagctaacaccttccagatggctgttagctcagacttgattcaattcttcaggaaattgtcattatggctttaattcagtagactgcgctgtagctttgaacttatgaattcctatacacatacccttttctccgtgtgtgtgtgtgtgtgtgtgtgtgtgtgtgtgtgtgtgtgtgtgtgtgttgagtcatttttctgtattttttagatattttcatggaattgtttaacaacagatactattgtttttctgtttcatgcctaacattgtagctgtctttattatgttgttctacattagtgcatcttcctagatgtttaacttcatgataaattctaggtccttgtggttttccttttgtttctcttctgtgcttcctcacagtcttactatttggttacttggtacagattgctagtgtgtctggaaaggggactcctgctttctcttactggtgctttacataaattgaaatgtccattgctaagccagtagttcataaactaattctttagttgcaatatacagctattatgttattaagcatgaagacagttatagtttcaattttcttctgaaagtcattgtgatatgaaataacactttttaaatgaatgtttatatggcagtttaggtatttttgaagctctttgggggtgacaagggttgttgttgtcatcttatttccttatatgaaaaattcccactgatcacatatcaatctgcctattttcccagaagcaatatgaaaaatacagagtattacctttgggcatttaattttaaaattaactgttggtttcttttttgttgtttttgtttgtttgttttgtttttttgagacagggtctcactctgtcccccaggctggagtgcaatggcacaatcatggctcactgtagcctcagcctccagggtagctaagactgcaggcacacaccacaatgcctgactaatttttaattttttgtagagcaagcatacatcagactggtcttgaactcctgatctcaagcagtcctcccaccttggcttccaaaagtgctgggattataggcatgagccactgctcctggccaagttttgttggtttcttgactggtattaggcctttttttaaaggaggactgccagttttgtttatggaggatatggttaaagatgcaaaatggctgctgttttttgttgtttgcagtggctaattttaaatcagtctgacatcagttaagtgtctgaaaggaaatgatggcttgttgtgagtgctttttatccttctaaatgggaacactgttgcctttagatattcgaataatttaagtcttagaaaaagccttttaaagtactttcttgtatttaagaactagtggctgcttttaggtttcgttttggttttgttttttggttttgttgttgttgttttattctcttggtgtgttaattgtgagtattggcagtacctcctctgtcagccgatctctccagctggatttctgtgaagaaggctttttgccttgtaagcaatgtgttgtgctcattcatccttgcctactgcagaataccatgagggacgtttccttggggattgggatgtagtaccataggtgaaaactagctcctagtacacacacctgaatcattcgaaatagaaatgttagaagtctcatctgctgatcactattgctaacaagacaacttatagaataagaccttgcttattactaggtttttgctgaggacattctcgaaaaggtagaaatctaatttcttgtcttaataaataaaaccagaaagtattcttaaagtccggggtgcctgtgaagttctgcagaatcttcatgacgaacatcagtgaccatgtataatactgtgtatacagaaagaatgggaatgtattgtctcacatttactagaaaagttcctttaaaaaattatttctctactccaactttaactttttcttgtaaattcaatatagccgtaaattctagctgaattgaaattaattgggatagcagagtttgaagaggaaaaaaacaccagccttggaaccagcagatctgcattagagtttatattatagtttcctaggactgctgtaacaaagtgtaccacaaacttgattaagcatgttaaaagtttttaagctcttaaaaacagaaattaaaacagaaatttgttttctatcacttctggagaaatcagggtatcggcagagccatgctccctctgaattttctagaggagggtccttccttggcttttccagcttttggtagccccattcgttccatagtttgcatctgtagccatttagtctctacctgtcaacatggcattctctctatgggtctctacctccacgtgcctctccttataaggacactggtcatcaaattagggtcactccaaagacctcatcttaacttgattacatctacaaagaccctgtttccaagtagggtcaaatttatgggcaccaggggttaggacttcaacacatcttttggggggtcacaattcagcagtcttgacttgactcctcagctaaccatgtgttgagagcaaattctctatgtaactttgagccttagtttccttacctgtaaaattgtggtattactttgtgtactttatcattttgctgtaaggatcaaatgaaaatatttgaaactgactaagaaaatatttaaaggttgccctgtttttggaaattgttcctattccctgaattgtccttattctctaattctaagaggagaattgggcacagtggctcacacctgtgatatcaacacttttggaggctaaagtggaaggatcacttgagcccaggaattggaggctacagttagcaatgatcacaccactgtactccagcctgggcaacagagctagaccctgtctttggggggggaaaaacagttttagagaggttcagatacaacatacattcaaagtggaatgctcccaggtcactgtgtggcatcccctaaaacaaaatgcgtaatgcgggccgggtgcggtggctcacacctgtaatcccagcactttgggaggctgggggaggggtgcagatcacgaggtcaagagttcgaaaccaggctgaccaacatggtgaaaccctgtctctacaaaaaatacaaaaattagccaggcgtggtggcaggcacctgtagtcccagcaactcaggaggctgaggcaggagaattgctgaaacctgggaggcgaaggttgcagtgagctgagatcgcaccactgtactccagcctgggcgacagagagtctgtctcaaaaaaaaaaaaaaaaaaaaaaacaaaaaaacaaaatgggtaatgcattcaaggtgacagggttaatgttggcattactttgttatgttgttgatgggcagaaacccaaggtggggttttgttgagcataaacacaagaagcaattatttgtggcactagacttaacccaaaggacagacccctacatgtatatagtagagaaatcctgtcttttagcactatctcacaggggaagctgaggaatcacattatctttaatataaataaatgaaatgcagcactgtataatttatatccttaagcaactggattcaacgtaccactaatggcctggtcatgttttaaacattaccccaaaacagcctaactgttctgtgactcagtgtctctgtggaatcctatttagtagcaccatggtctctaaatgttttgattacacatcagtattaggaaaacatgtttgaagcattgtctaagtctgtttgtgctgatgtaacagaataccatagactgggtagtttataaagagagaaattattggcttacagttgtggaggctggaaagtctagtatcagcgtactgggatttggcaagggccttcttggtgcatgatagtatggtggaaggtatcacacggcaggcagaaaggcagagagagaacaaaagggggcgaacccactcccttgatgagaacctaaatacctcttaaaagtcctaactctcaatgctgtttacaatggcaaccaaatttaaacaagagttttgtagggaacaaacactcaatcaaaaccatagcaagtatgtaccatgactgtatgtgtatttataaaatacattcatatatttctacagcaatatatatgaggtacatttaagcatgtaaaaataggaatttttaaaaataggacagttgtaataatttctttgtacattccactttggagactgtttttatatggagcttgttttatcaccaaaaggcattttaattttgcacactttagaattcttacaatgtgtaattgactgctagttgctgaacaaaggacagataaagtgtttcctgcacctgagcagcctaaaggtgagtgtaatacagatgcacaagtgactggttgataatggaatgagaccccttataagaaagacataacagagcacggcagaggagcaagaacaacacagaggcaatgacatttgagctaggcctcttatatctgtagatgaacatttgatggtaggtagtagggaagatggaactaagaatatttgagctacttaatatatgccaggcagcatgctgagtgcttgtgttcatttaattctcaagacagccataagcggcagtacaggtattgggcctattattctaaatcccattttataagagagttaggattagattcagttccatctttctacaaaacctggcactgtcattccaggcaaagggagtacaatccatttttctcttaagaggttgattttgccaatgagacagaatgaatctctacagcattgttaagtttctacccagtcttttgggtgactgaaaaattcaaatgtaaagatgtggcaaaattggttctctaaggattttaagtacagccaaatgatatgtcacaagttttttcctaaatatccaaccatttagtctttcataagcttttaattccactagcctcactttctgagattgttgatgttttcttgttctaacctgaaattttctttgtttgatgttaacaggagtataatgaaggagtaaccatttttattttatgatagtctatcaatagactttttttaaccttctttaagctaggtgtgtttgtcctttattaaagtcagtttgacccagcctgtacaacattgcaagaccttaactttaataaaaaaaaaaaaaaaaaaaaaaagccaggtgtggtggtgcatgcctgtaatcccagctacttgggaggctgagatgggaggatcacttgagcccaggagattgaggctgcagtgacccgtgactgcgccactacactacagcctgggtgacagaacaagacactgttgatagatagactatatgaaacacgctctataaccaaaaaaatcattgctctggatataatgcaaagattttggtaacattttaccgtattttttcttattgattgattagagtagtggaggaggggagaaggaatttaagagatactatcatcaaccacttgcagattttagtatatttatacgctgctcttctcagtatttcatttttctatacatgagaaaagactatgtctgtattggaccattacaattgaccactttgttgaagacatcttcagttgtgacataggtcattttgatttgaacgaactgatagctataccaattttttttggctctgtgggaattttgggatagagaatgttatttgaagtaaataggtaaaggctctttttgtttttgttttgttttaattttatttgtgatagatacctggtgatgtaatagtagggcttgactggaaagatcaattatgatttgtcttggtgtccagaacaacaaattacatatgctctcttgtaaaatttgatgattttgtgctttatgtgaatagctttatgtgaaagcaacagcttttggttgctggtttgtgtttttaattttttatcctctagtactttaaccttgcctttttatgttctttagcaaccctacatcatgttctttaatttactcacagaaataagtagagtcaagtcagctcttatagttttaaaattctcctacttctcacctaccaagaacccattgcctcttcatgctattttgttcttgattttcctgagcagtaattgggctactgaagcacatttcctttccttctcttatttactctctggggtgactactttctcaccagtgcatggtgtgtctgtgctttggaatagatgccaggaaggggtaggatggtcaggggctgctgtatgtcccactccttggagctgtgcagtcagcctagctagccctggctatggtttcatccgcttgatacagatattgatgataagaaacttattccagggatgttgtcttgttttcttattggtggtctctgtcatgttttagtttggctacatttttatagatatgagacgtgtatgtgttttaccaatttaagagactactaggagttctaataaaaaaccagctctttttctcaaggaaaagtaatccttttcaacattgtttataagcctctaggacttgtctagcagtatgctcacatattgaaaatagatttgtctcttccgtattcttcaggggcattttactgtgggtctgtcaggtcttcagactgctaccctggtgaaaacgtgatttaagaaggtatttcggtgtggggctatcataggaaacttctgattttagatgcagtctatctgcaataagtaggatttgttgttgctgttgttttaactgtaggtgaaaaagaaaatctgcttcagagagaaaccaagttcatcttggagataagtgtggatgttggactccctccagctcagtaactgaggatcactttacttgaaatcgttgtgcttttgattggccgtccgtggttgcgctgaagagggaggagggggagtctttccagtagttataccttaatttgtctctgcatggatgatatttgaaacctcaagcccaggcatgctgctctgtcctcccatctgtagctgcctgcgtgattccatcattgttccatttgtctcttcccattgtctttgaacatttgtttttgggaacaagatatgcattaggaaattactcaaccatgagtataactgatgcctataaattgatcttggcatccagaacaagttgcatatactagtgatgtaatatttgccgaagctcattggctgttcattctctgtagtgcttttccgaaaataaataaataaataaataaataaataaataggtagaaagaaatgaaatcacttggcaccagcaaagaaatcctctataggatttgaatgttgaagtatgaattgaaactatttccagttagtcaacttttattactcactaggacatccctaaaagaaaagctcattttgtaatagtcctgtgcttatatgctttgcaatcttatacagagggagaaaaagaattaaaagcttgttccaaagtaaaaaggttcatgtcgggtttgaaacgctcatgtcagcttaatgaaggatacatgtatgaaaattaatatcttggttcttcaggaatagtctgtgtttgggagaataaagatacatactgaattcagttgtttacttgccttacagtatattcgaattaaacaataggacagattctaagaatcaagtaaatttgtccaaacaggaagcagaatcaaagatcttaagtattccccatattcagggcagtatgtggacagttacagtaggtgacctctaaggtccctttcacctcccacagtacgtgtgtcagctgcagttcgtcaagataaatgagcaggagacaacttcgtgtaaaaagtgtgtgaacctaggacaggacttttcgacccttatgaagaaagaaaggaaagaatattgcagctagatgtgttgggtccggactgaggtcagagttgcacagctttggacagatagcctggacacaggaaaccatgttctctcaattttaaacaaaaatgcaattatgtattccctcccctatccccccaccaccccccatacacacattaaaattcttaaccatgggtcagcttatatcgaccttttgggtaaaagacattattcctttgaaacttcagaagcacgagtttgttttctgaaaaacacatgccattgcataccttttaacttgacatatgactgaaacttttgtcttaacaatccattttctacaaagactgcccttatatttattaaagatgacaaaaccaaaaccacttcttctttcatacattttctgctttcatgttctgtcattctgagatctttttttctttccctctctctgtcttcttttcccccagctgtcggcagcatccagcccctccagtcacagtcctcacagagcttcaggaaaggacccctttgcagagctctctttggaggatttcttataaatcactttaggtattgctacttgttttgggagatggggacttaaatacttaaaaacaattaccaaacattaaacacaattcacgcttctctttcatttctttaaaggactctaggctccctctcctcctcctcctcttcctctattctttaggtgcagaatgaaaagataggacataaggaaaaacaacttttggaaaatatctgtaacataattatttaaagtaatctcatccactgctcacagtaaatggatgagatcggataaagtttgctttttaattaagggcaagtgaatacttaagccctttcgattagaaggattctgcatatgatccacactgcctctgtttgctggaagacagtgtaatttgttcttcttgatgctctagcccccagtttagatataccttctagatctttgggagtttatagtcttctgatttggcaagtttattagcacatctacttcagtaatctttggatgggcagtttaagggaaattgtgagtgaaatatctttgaatgaacagtagtaccctattgaaaaatatttttatggctctttcaggttcttatttatgttaataaaaagacttagtataatattactgttccctttattgtctctaattgtatatcatttggaaataatatttcaaattttgcttcccaaatgagattttgcttgtggtatttgtgcttatggagagatttttctgaacttgtcatgaaaaaataggtcattgatcttctttcttttcctcctccacatgctattcctctatttttagcagttaagtatttggcctggatgtggttgcttatgcctgtaatcccagcaccctgggaggctgatgcgggaggatcacttggggctagtagttcaagatcagcctgggcaatacggtgagaccctagtctctacccccacccaaaaattacccaggtgtggtggcgactgtctgcagtcctagctattcaggaggctgaggcaggagggttgcttgagcccaggagttccaatgagctttttttttttttttttttttttgagatggagtttcgctcttgtctcccaggctggagtgcagtggcacgatctcagctcactgcaacctccacctcctgggttcaagccattctcctgcctcagcctcccgagtagctaggattacaggcgcccgccaccacgcctggctaatttttgtatttttagtagagacggggtttcaccatattggccaggccagtctcgaactctcgaactcacctcaggtgatctgcccacctcagcctcccagagtgctgggattacaggtgtgagctatggtgcccagccattgagctttgatcatgccactgcaatccagcctagacagcagagcaagactctgtctcaaaaacaacaacaaaaaacattatttggaagtccctatatgtgtcaaatattgagctttctggcacataagttgataatactgactttgttttataaacagggtttgtgataagcatgttgtgaacacttctgggccagttaaatggtaaagaccacaaagcatttttatttatgagaagacatcctacaatacaatgaattaacatacccactttttttttccagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaagttttgttatggtattctggtctgagatgcattttcatttttcctttctctttttattatcaatattgtcatttttccctaataaaatatacccaggtgattatatttgttgatctaataacatggaaggtttgttttatatgaattttcaaaaagatgtctctttacactttttgttaccttgtagactcttattgataaatgcaactacttattaaaattgttcactttttgtcttttg

SEQ ID NO: 38076 - DNA, 98648 bp, Homo sapiens; identical to SEQ ID NO: 36981

SEQ ID NO: 38077 - DNA, 28645 bp, Homo sapiens
agttcggggaggcacagggtaggagcggtgagagggccgtggagtcccgcccctcgccgccgcggttggcgggagcgtgtcgtgacgtcacacagggcctctcgaagtgggcttgtgaatggctagattgggaagcaccggcggggtgtcgggaagggtggtgacgcaacatagagactccgcccccttccttggagcgccgcgactcgggctgagggagctcgggccaatcagagggacggccccagaatggcatggtaactattcgaccctttccttgccccggtccgccggcgctgctgggaaggcttcctagtctctctgcccgcacttcccgcccagaccacgtgcggagcctgagggccctcttggaaggtctgtctgtccaaagagtttgcccgaggcttcttcagggccctaaatcctgaccctattctctcctgacccatgctcgccccagcactttctttccctccctgaatttctaggatggacattaggagcattagagatgccctaagggactggcccaccaaagggcctggtacaaatgaggattgttggaacgtctttcccagctgcacgtggagaacccctaattctttttttttctttttcttttgagatgaagtctcgcgttgtcgcctagggtggagtgcattggcgcaatctcggctcactgcaacctctgcctcccgggttcaagcgattctcccgccttagcctcccaagtagctgggattacaggcgtccgccaccaggcccagctaatttttgtatttatagtagagacggggatttcactgtgttggtcaggctggtctcgaactcctgatctcaagtgatccacccgcctcggcctcccaaagtgctgggattacagacgtgagccacctcgcccatgaactaatttttttttttttttttgagatggagtcttgctctgtctcctctttctcccaggctggagtgcagtggcacgatctcggctcactgcaatctccgcctcccaggtacaagagagtctcctgtcgtagcctcccgagtagctgggattacaggcactcgccgccgcgcccagctgattttgtatttttagtagagatggggtttcaccatgttggccaggctggtctcgaactccggaactcaggtgatccgcccgcctcggcctcccacagtgctggccttacaggcgtgagccaccgcgcccagccgaacccctacttattcttaaaggacgggtatttcaaatgttcccatcttctcagtgatacatttgccaagctttcacagcgagttgagctaatgcttgggcaggcctctgttaaagccttgtcactttgtatcctattatttaccctcggttttctgtgccttgggctcttcttggaagtccttctggggcctagcccattagcagaaaactgatattacaagagtgaaaggtgggcattttctagaaactagacctgtttagtgactgagagtctcatagcaggaactgtgcgcagaaagcaaagcgtatactggccgggctggtggctcatgcctgtaatcccagcactttgggatgctgaggcgggcagattatttgaggccaggagttcgagaccagcctggccaacatgatgaaaccctgtctctactaagaatacaaaaattggtcaagcatggtggtgggcacctataatcccagctgcttctcggtttgctgaggcacgagaatggcttgaaccagggaggcggagattacagtgagtggagatcctgccactgcgctccagagtgatctcaaaaaaaatttttaaaaaacctccaccactactcctttgtgagacatgaatgcaaaattgaactgggcttttacctaaaatgtaaatgagtttaaagccatctgggttttcggtgatggcaagggattagagataattgatttatttgtttgtttaaaaaatgggagactgggagtggtggctcacgcctgtaatcccagcactggggagttcaaggtaggaggatcacttgaacccaggagttcgagaccagctcgggcaacatagtgagtccccacctatacaaaaaattaaccaaggccaggtgtggtggcaagcgcctgtggtcccagctactagggaggctgaagtaggaggatcgtttgagcccaagaggttaaagctacagtgagctgtgattacagtcatgccactcccgcctgggcaacagacggagcctccgactgggggaaaaaaaaggtggtgggttgtaaagatggaataagatagtggatggaagaaacacggtacattgtaggtgctcagtagatacttgaaggaagaagaaaatcaatatatggttggccaaatagtaaagttactttaaacaactgactgcagccatcttcccccaactcctccatccaaaacacccctactttacaaccacactcccttgcctttgctggactttagaaagtcattaactctccctagatagttacagtagcttcataactgccctctggaacatttgatttcttgccctttaatctccaagcccaattatttttaaggctctcttctactgacttattttggtgtccctaaggcagggcacatagtaggtacacattagatatttgatgcacgaatgagtgaattattttcttcagtgggggattagtagaggtgttggactttgagtcagagaaccctggtttaaatttggatgcagatttaatttaattcagtttaaatttatttattaatttaatttaattcagtttaatttaattaagaaatttgggccaggcgggatggctcacgcctgtaatcccagcactttgggaggccgaggtgggcggatcacgaggtcaggagatcgagaccagcctggctaacagaaggaaaccccatctctactgaaaatacaaaaaaattagccgggcgtggtggcacatacctgtagtcccagctacttgggaggctgaggcaggagaattgcttgaacctgggaggcggaggttgcagtgagctgagatcgagccactgcactcgatcctgggccacagagtgagactccgtctcaaaaaaaaaaaaaaaaaaaagaaatttaggcaaatttcctgccgggaatggtggctcacgcctataatcccagcacttttggaggctgaagcaggtggatcacctgaggtcaggagttcgaaacccgcctggccaacatggtgaaaccctgtctctactaaatatacaaaaaattagccgggtgtggtggctcatgcctgtaatcccagctacttgggaggctgaggcaggagaattgcttgaaccggggaggcagaggttgcagtgagctgagatggcaccattgcactccagcgtgggcaacaagagtgaaagtctgtcttcaaaaaaaaaagaaaagaaaggaaagaaaaagaaatttgggcaaatttcctaatccctctgaacctcaattttcttttgtataaaatggggataacaaccacatttgccttacagggtcgtagtgagcattaaaagagagaatacatttaaagcacttagcatagtacctggcacagataaggcctcaataaatggtattgtttgcattatttaaaaatgtatcccagccgggcatggtggctcaagcctgtaatcccagcactttgggaggccgaggcgggcggatcacaaggtcaggagatcgagaccatcctggctaacatggtgaaaccccgtctgtactaaaaatacaaaaaattagccgggcgcggtggcaggcgcctgtagtcccagctattcgggaggctgaggcaggagaatggtgtgaacccaggaggcggagcttgcagtgagcagagatcgcgccactgcactccagcctgggtgacagagcaagactccatctcaaaaaaaaaaaaaaaaaaagtttccgggcacgggggctcactcctgtaatcccagcactttgggaggctgaggcgggcagatcacctgagatcaggagttcaagaccagcctggccaacacggcgaaacctcatctctactaaaaataaaaaaattagccaggcatagttgcccacgcctgtaatcccagctagtcgggaggctgaggcaggagaatcacttgaacccgggaggtggaggttgcagtgagccaagattgcaccaccatactccagcctcagcctgtgtgacagagggagattctgtctctaaataaataaataaataaataaataaaaatgttgagttcccattctaaatattctaagacattgattctgacactgaaagaggactcagaaatgtctttttttcttttatttcttttccttttccttttttttttttttgctataaaatggttctgaaagaaatgtcttgaatgagtaagcaaatgagtacattcagtccaaagtacaagtagatgtgcagggaaatagtgcatacttgtggaaagactggaggaatacgtactggatgaggaatactccaaggaagaatttcctgtgactttggtgatttctaaagatacgttgttgggtactttggtaggcaagtagcccatggctcatcattcccagaattcctggctggggaaggacatctttgtgaagccaggggttccttcccacactcctactctgtctaaattctgataacacctcttttaggtatcatcatcttccttcttccgttctaaagacaaggagtttgatgcttacaaacccttttggagccaagccctgtcctggacatcaagagcccagagatgtccacagctcaacactattctggccaaggaaagtccagctttgtcctaggagccccagtatcatacacatggcttgagaactcactgtatgcagctgtgaaggattggtggttagggaggagacagatctgtaaggactgcagaattgtggaaggatgagacttctttccagagaagcagcagaattggagtcagagctaagttcaagttgtagatctgctactttttatatctcgcctaagttatttaacccttctctgccccaattccttgtctatgacatgggcagaatactttgtattttgttttgtttcttttttttttttttttttgagatggagactggctcttttgcctaggctggagtgcagtggcaccatctcggctcactgcaagctccgcctcccgggttcacgccattctcctgcctcagcctcccgagtagctgggactacaggcgcctgccaccacacccggctaattttttttttttcttttggagacagagtctcactctgtcacccaggctggagtgcagtggtgtgatcccagctcactgcaacctccgcctcctgggttcaagcgattctcctgcctcagcctcccgagtagctgggactgcaggcatgcgccaccatgcccagttaattttgtgtatttagtagagacagggtttcaccatgttagccaggctgatcttgaactcctgacctcagatgatccgcccacctcggcctcccaaagtgctgggattacaggcgtgagccaccacacccggccctgtttttttttttttagtagagacggggtttcaccatgttagccaggatggtctcgatctcctgacctcatgatccacctgcctcggcctcccaaagtgctgggatcacaggcgtgagccaccgcacccggccatttttgttttgtttttttgagatggagtctcactctgtcacccaggctggagtgcagcggtgcagtctcggctcactgcaacctccgcctcctgggttcaagcaattctcgttcctcagcctcccaagtagctgggattacaggcttccaccaccacaccaggctaatttttatatttttggtagagatgaggtttcaccatgtgggccaggctggtctcaagctcctgacattaaatgttccacctgccttggcctcccaaagtgttgggattatgggcctgagccaccgtgcccagccaatactttggcttttaaccagaacatttagtctaatgcatttaacgaatttactgctatatatatatatatttttttttttgagacacagtctcattgtgtcgcccaggctggagtgcagtggtgcgatcatgactcactgcagcctctgcctcccaggttcaagtgattctcgtgcctcagccttcctagtagctgggacttcaggcgcgtgccaccacgcctggctaatttttgcatttttagtagaaagaagattttatcatgttggccagactcgactcaaactccagacctcaggcgatccgcctgcctcagcctaccaaagtgctgggattacaggcatgagccaccatgcccagcccatttttcccactatactagtttgaaagttaaattctcttttcctattagtattattttagtgatctccctagaaattaccacatgcattcttaacttaccaaagtgtcatgctcataaatacctttacggaaggatagagtttcctgagatggaggcaggaagagagaacattccaagctagatgaacagggaagcaagcagatgaacaggggaagatttaattgctatctgagtcagagtgaggctagagcaagatgagtgagctgggggtgggtggtttaaagccatccaggaaggatgtcttggtcatgaaaaagatctttgagaagaacaagaataactcctcctcaacccaggaaggacactgattttcctgaggcttcccaggaggcagtggcagagcttggtctaaagctggatgtctttagcagtctatgtccctgcctctatacctaccccagccatgctcactgtgtcccctttctagcaattcctcaatctctgcttacctgtctaaatactgcccattcttcaaaacccagttccattaaatcaacccaacaaatattttctttttatttttgtattttgtatttttatttttaatttgtatttatttatttttttgaggtggagtctcgctctctcacccaggctggagtgcagtggcgcaatgttggctcactgcaacctccgcctcctgggttcaagcaattctcctgctttagcctcccaagtagctgggattacaggcgcccgccaccaggcctggctaatttttgtatttttagtagagatgtggttttgtcacgttggccagactggtctcgaactcgtgacctcaggtgatctgctcacatcagccttccaaagtgctgggattacaggcgtgagccaccgcacccggcccaagaactctttttatttcttttatcttccctcacataaatcaaggtaggcgaggtctttcaaactgatagtgaaataaagagatttcagaaagggtcggtgacagccaaggtcagacaatacaaaaaaagttcaggacgagttcacactgtggctgacatgtctaatcataatgaccatcatgtactgagtacctcccacatggctggcacactgctacattacctctaatacaacaaccctatgatgtggatattcttttttttttttttttttttgagactgggtcttgctctgtcactcaggctgttgtggagtggtatgatctcagttgactgcaacctctgcctccagggttcaagcaatcctcccacctcagcctcctgagtagctgggaatacaagtgtgtgccaccacacccagctagttttctgtattttttggtacagatgctgttgccatgttgcctaggctggtcttgaactcctgggctcaagtgatcctcctgccttggcctcccaaagtgctgggattacaggtgtaagccaccacacccagtgtggatattcctaaatcaattttacaggctgggcacggtggctcatgcctgtaatcccagcactttgggaggccaaggaaggaggatcgcttgagcctaggagttcaagaccagcctgggcaagacagtgagaccttttttttttgagacacggtcttgctctgtcttcaggctggagtgcagtggcgcgatctcggctcactgcaacctctgcctcccaggttcaggtgattctcctgcctcagcctcccaagtagctgggactacaggtgcgcgccatcacgcctagctaatttttgtatttttagtagagacagggtttcaccatgttggctaggattgtctcgatctcttgaccttgtgatccgcccaccttggcctcccaaagtgctgggattacagatgtgagccaccacgcccccgcgagaccttgttttaaataaataaataaaaccattttatagacgaggaaacagaggctcagggctatatggagaattgcccatatttcccaaatcaccagagaattaaagaattaatctaaattagagcacctcaaggtttgggcattgggggtagtctagaggcagggagaggggacccagcctcagggaatggtacttagggccaagagaacagacaaggtgtcaagatagggaacaatagccaggagcagacacccctggttggagctagacaaagaggatgacatgaagccccaaggcagaaaacctgaatctagttgccaaatttggagagaggtagttctttttgtaaagttttgctagtccatttgtcctgggaccttaaagaacaggataggggagaactcaaaatcaagaaaagtagtttttagaacaagacactctgagtgcgcaccttctccagacttcggagcccctcagagtgcgtctgaggtatctctgggtcctccaccattgctccacatgaggcctgtcaaagagagggcctagactgggtgaatgaacaaaagtgaacacatgaaaaagagctctggcaaattaatcaacaaatgctaagtggcattaacagcatatagtggattatgtgaattatctcaggtaccagacttgagtcctggttctggcatgtattagctgtgtaagtaggtaacttggtttccctgttttccattgtaaaatgaggatattaaatagtatctactggcggaggctcatgcctgtaatcccagcactttgggaggccaaggcaggtggatcacctgaggtcaggaattcgagaccagcctgaccaatatggcgaaaccccatctctactaaaagtacaaaaattagccgggcatggtggtgccgcctgtattcccagctacccgggaggctgagataggagaattgcttgaacccgggaggtggaggttgcagtgagccgagatcgtggcactgcactctagcctgggtgacagagtgagactctgtctccaaaaaaaaagagagaaagaaagaaaaaaaaaaggccaggcgcggtggcttacacctgtaatcccagctctttgggaagccaaggcgggggcagatcacgaggtcaggagtttgacaccagcctggccaaaatggcaaaacctcgcctctactaaaaactacaaaaattagctgggcgcagtagcgggcgcctgttaattccagctactcgggaggctgaggcaggagaatcgcttgaaccctggaagcggaggttgcagtgagccgagatcgtatctattttcacaggtttttttttttttttttaatggagtttcgctcttgtcgcccatgcttgagtgcagtggtacgatctcagctcactgcaacctctgcctcccgggttcaagcgattctcctgcctcagcctcccaagtagctgggattacgggcgcccgccaccgtgcccggctaatttttgtatttttagtagagacggggtttcgccatgttggccaggctggtgtcaaactcctgacctcaggtgatccgcccgcctcggcctcctaaagtgctgggattacaggcgtgagctaccgcgcctggccctcacagggtttttatgaggattaaataaatgagataagaagtaagagtgcctgggatatactgggtgttcagaatgtgttattgctgtgaggatttaagtggaaaagtgcgatgttaggtatggctaacttagaggtcctccacccgctgcagatgctctgactacccaccagtgtgcttgcaggaggaattcttggtcccttcaccctccttccctgttgggctgggatggtctttgcaaagggagccaggggtccccctcaagttctttcatgggtcagtcatggtcagggtagggagggaactctggcagctggttttgggggatcaatcctctcattgtggggagacccaaggctggtggctggaaatcctttctgcgctacgtaggacagggcgccctctcctgaacaaaggcgggaacagctctaggccagagtttctgggatgtgcctcaccgggtctcactgcctgcaaaggtgctcttcccattgctgaaatgtccccaaccgccctgacgagcaaagtttgggggaggggcgccagggctgggaggaaactggcttaatgtttcagaagggcgaggctggatagttcggttagaatggaggtgcgaggcaggagagacgggcggatgagaaagaaatccggcccctgttgaattaattttgtgttctttcaacaggtagatggaacgcagctgagaggtaaggcgacaaggtggcttatccaacatgctcaaactcaggtatccagagctcttccggctgccctcacgcagccgaaattagtgggggcagacccgggctgtaaagcatggtttgaggacacgccagattgaggaggagagccaggggtcggggtctccagaagcggggaggagccagcggaggatctgggcgcagtttcctctctaagttccgccccgagagcgccggccccgcccccgccgttcgcgctctgaccagcccgcagagccagcccccgaccccgggccacctgggcccccgggttccgccggcactctcgccaccaccgcgtgggtgagtatgggcatggatgtgctgggctgccgggcagccccactcgggagcttggccgcgcggtctggcctctgcagggccgggccccacgctgtgggagtcctggtacctgccgtcctatcgcacacactctgtttcccaggaactgctgctctctggacttgccgagctggcccccttcttctccctccccagcgtggggccgggtgtgcaggggttgagctctccctttattccgcggggcctcctggtcaggagtcctaggtggggaggatggggccccggggttggaaccccatagagtagttttgaatggcagctgtgccatttattagccttggccttgagtaagtgttttgaacctccctgagcctcagtttcctcatctgtaaaatggaaatatacaggctgtagcacctacctcatagaattatggtgagattaaaagagacaatgtatatcaagtacagagcagggggcctagtattccgtaggcactcagtaaatgtgggttcagactcgaggctgaggagatctctagggactttggagctgaggtagctccaaagaaagcaattttcagctaagtagtacctgtgaggaatgtagaactatctgcaggctgaacaattgcccttcagctccaccctgaggtgtggagtagaatgaccaagttggaaggaccttagaggtaatctaaaccatgtgattcccatgttgcagaactgtggaaacagatctagagtgcttaagtggcttgccaaaggtcacacagctaaatgggaggccaggcatacctccaagaattggaatggattatcccttgaacctcctcatcaactcctgatttgggcagtgcctcttcattccctgaagatctagtcttcaatttgggaatcctagtggttcctcagggatctagagctgcagccttcagggagggatactgggagggaagactagtgctactgcaactgcagagtctaggtttgggctgggtgaggaaaatgttccccatctagggccctaagggacttagagtccatttagggatgatccagggaatgtgttttttttctgggagggtcaccagagccacttccagctccctgggatccctgatgctcctaaaagggagagaggaacttgagcaattggagcaggctgcctgatcaggtctggcagctgggggaaaatgggtgagaatgtggaggcgtagccacctggcttgttctggaatgccaggatggcaacctaactgagatcagggttctttttgagggtgggactaaagggagagtcttgtgggtggggtcaggaagagttgggacttgatttgacaaggtctttgagcccagaagggtatattctttatgtgtctggagccagccctagcttggcaacaacaagccaacgttccagggatggctttcccttcagctcagcacagggctttgaggaagagccagcccttctctctctctgagtgtcttggtttctctatctttacaatgggaatagggctaactgcctcatctatgtagattttggtttttccttttcttcctcctgtgaacaggtgcctcttctgcctctctcactccagtcctaacctgacctttctcaagttcagacacagagaggaaggggtcaaggaaggccagagttgcagtgtgtaactcttcgtgggtcccacatgtatctctttgttatgtgatcctgagcagattcctgctccaactttcccttctgtatactgtgcggagctgggctaggattgttggtatacacttatttgttatagttcctgaccttagctacccttatctaagggggaaatcacagcccccaggaaccctcatctgttcacaggagggtgatgtggacagccccctgggcactgggaagcctccagaagctgaccaagcagctctctccagcaaacagcaatcccaggctagcaccaggcctgattctgcaaagcctttcaccctgggggcacgtgagggagcaggctgggacaagcagggggcttggggttctgtcagcttccatggaatccctgccactgtggactgcggtgcaggcacacagagcctgggaagggactgaaggtgcaggagggccctgggccagtggggaagcaaatgagagctgatgagaggccttgaagcctggaggctgggccgaggctcaaaggcctgggggaggagatgggccatgccatccactggtaggttttagggttggttcttgaaataaagagagacacttatttaaagcagcttctctagtcctaggcctgtcaagctaggcagagaggagtgaggagaagctctcccagtccattcaagctttatcctagcacagatttggttcattgtcttccctctgaaattgaggtggaatgttgtcttgggattctgagtcagtcttcctcatccagggcaagagctatccaagtttaggtgccttcctcctcagactccccaccccacagcacacagctaattttaggactgagcacaagggctgactttatcactgagtgccagcctggctgcctggggccctgacagcatgccactccatccccaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggtagggcatggggacactgatacctcatattcaggccgatctggatcttctttagatcttgaatatcttttaacaagattagccagctctccactggggcccatcaaacatacggggctgctggggggatgcctgcaaattgaaatctcaagggttagtctccctctgccttctgtgaggttctggaggctggagtcactgaagtgtaatatagagtcagtaaatgaattacaagtataacagagtttgacacatgtcccaccccatttactttgatatcctagagaaagtggtcttacatctttcttcctggccccgcgccccatatccctgtccagagggcagacctagagccaaatccttacttcatagaagagcagattctggaaccccagggtttctgggaagtggagagagaacaggattgggctagagggtattttgggcctcttaatgtagcactatgggcttgtgcctgtctctgtaggaatgtgactcagtatatgtgtgtgtgattgtgagggtcatgactgtatataatgggtttgagtgggtcgtgtgtgagagagactatatctgtgcctgtctgtatggagatctgattatgtacgtgtgtatgtgtcctggggtgagtcccgtggcctctaagattccatagatgtctgtgtaccctctggacagggatatggggtgcggggccaggaagaaagatgtaagaccactttctctaggatatcaaagtaagtggggtgggacatatgtcaaactctgttatacttgtaattcatttactgactctatattacctgagacagagacccagcctcagtttcctcatgtctgaaatagaattgattagctgggcatgggggtatgcacctgtagtcctagctcctcaggagcctgaggtgggaggattgcttgagcctagaagtctgaggctggagtgagctatggttttctcactgtacttcagcctgatgacatagtgagacccccatttctaaaaaataaaatagggttgataattcctgtcctgctccttcccagggctagtgtagagctctaggtagaagaaggataggaaggtagtttagggaggatgatgaaatgtgaggagcagaaggaggaggaggaagagactgtcaggttggaaggcagggcaggaaatgaacttaacctaggggctttaggtggagaagaggcagattctgcgcatggaccattggggtccctcagagttctgaaggccccagccagctggatccccacttcatgtaaagagcatctgcttcagagaaatggctaggattagcagtggggtctagctgtgagtatggggtggagccccacttctttacttcatgtgactggagtttcctctcctcctgatttgtcagtgggtagacatgggtgttgaggtatggacacccaatctgatgagacctggggctgggagctattagaaagaactggacgaaaagggcgaacaggcgatctgaagggaaggagtacccttttgtgacctagtacatgacctagtacctattatctcagataatgcatcagatattcctgttacgctagccactcctgatcatcccgcaaaaccctgccccgctagctctaaaatgtcttccctatcctccttggggctaatgtaatcactccctcctctgggtgcccacagttccctgtgttatctatcacatcatatttgtgtctgtcttcccaaccagatggggatctccttgaaggcaggcactgcatttgagtgagaaagtatttgggtttttttatttgttttagaggcagggtctcatttccgtcacccaggccagagtgtagtggcatgatcatagctcactgcagcctcaaactcctgggatcaagcagtcttcctaacctcagactcctgagtagttaggactacagatgtgagccactacacccagcttaattaaaaaaaaaattgtggagatggggtctcgccatgttgcctaggctggagtgcagtggcatgatcatagctcactgcagcctcaaccaccagggcacaagtaatcctcctgcctcagcctcctgagtagctaggacaataggtatgcacaaccatgcccagctaatttttgtgtatgtgtgtggagacggggtctcacactgttgcccaggctggtcttgaactcctgacctcaagtgatcctcccacctcgactcccaaagcactgggattataggcgtgagccactgtgcctggccagaaagtgttggttgaataaatgattaagactccctagcccagtgccctggggaaaggaaggcatggtataagtcaatcatagtccaagcaaaattataatatttgtatagtatatggagttaaacagactaggctgtttgctctgccccttatggctgaccccaagggctgatggcatcaataccctattagctaggttattgcataccttgcatacctattacctgttctgggcataccagttagggaattaagatatagatagttgctggagtacttggtccctctggagcagtactaggtctgtgaccctgagggtatgttgtccccactgcctgagcctacggtgttggttccaccttggaatttttatatttgctctgaatttcccactcagagtatcccagaaatggccagccctaggaataaaagaagcaagctagtccatcatatctgtaattgattactttgcctctgctcgcatatccccagtgatggggagcttccttcctccccaggtagcctgttctaaggaagcttaataactaataattagcctttttcttttattttctttctttatttttatttagatgtagtctcactctgtcgcctaggctggagtgcagtgttgtgatctcagctcactgcaacctccgcctcttgggttcaagcaattctcctgcctcagcctcctgagtagctgggattacaggtgcccgccaccacacctggctaatttttgtatttttggtattgacggggtttcgtcatgttggccaggctcgtctcgaactcctgacctcaggtgatccacctgccttggcctcccaaagtgctaggattaaaggcgtgagccaccatgcccagcctcttttttttttctttcttcttcttttttttcttttaacagagatagtttctcactatgttgcccaggctggtcttcaactcctgagctcaagtgatcctcctgcctcagccttccagagtgctaggattacaggcttgagccactgtgcctagcccaagctttttctttccttctttccttctttccttcttttctttctttctttctttctttctttctttctttctttctttctttctttctttctttctttctctttctttctttttttctttttttccttctttctttccttctttctttcttttctttcttttcttcctttccttccctttccctttcccttgccctttccctttccctttccctttcctttcctttcttttcttttctttttgaggcagggtcttgctctgttgcccaggctggagtgcagtggcacaatcttggctcactgcgacctctgcctcctgggttcaagccattcttatgcctcagcctcccgagtagctgagattacaggcatgcaccaccgtgcctggctcattttttgtatttttaggagagatggggtttcactatgctggccaggctgaagcttttacttatagtgagtatgtacttactttccggtgagtctctgccttggccctggctctgctttgccgtagaactattctctcctcgtggcttcaggtcagccctgtagagacaagaagacagtaatgaggggccttgagtctgtcttcttctttttttttttttcttgagatggaatctcgctttgtcacccaggctggagtgcaatggcacgatctcggcttactgcaacctccgcctcccaggttcaagcgattctcctgtctcagcctcccgagtagctgggattacaggcacaccgccaccatgactggctaactttttgtattttagtagtgacggggtttcactgtgttacccaggctggtctcgaactcctgacctcaggcaatccagttccttcaggcaaccttccaaggaaatggtttccaggctcttccctatcctgaatgtaccgttgaacttggcccagtttgtcactgttctctgctgggccttgatttgggtatagaactccaggtggcctgggcagtacaggcaaaagcaggactattcattcttattcctggctgttagacctctgttgaggcagcctgagctgctattagctgtttctgcacaggtacaggctgaacatcgatatctcatattcaggcttgttgagatctcttttgtatcctgcttctgtcatcataggatttagccatttctccagtgaggcccaacaagccctctcagtcctgctctaacaaaaaacggccagacccctttttgctttctctctttcccttattggaaacctgcctatgaccctggatacaactctcaggaaggtccctgcccccatcactggcaaagaagctactgccagctgacctcagccactatcacttcttccctttgcagagtgttctaggatttatgacatatgcttgttgatcctgggaaggatgtgtgcctgggcaggcgtggagaattgggtactgtgggcgggagggcaggccctgaggagcagggggtgggatcctccagtcttagaatagtcccagtctggctacaaccttcaacccaagacccggattcttcagcaccgagtgtgagtgttccttcatgaggcccccaccccattcctgggtctccttagtggagggaagtatgagtgccgaggggagattgggtcctaggccttttaatatcaagccatctctgtctgcctcagcttgatccagagggaagcccagcttgaggggtcaaggtgtttgggcagtggggttgtgagggggagttgtcggccaggagggagaagagattggaagaagctcagttccctgggtctgggtctgacctggacagagatctcctgggtctggcccaggacagcaggctcaagctcagtggagaaggtttccatgaccctcagattcccccaaaccttggattgggtgacattgcatctcctcagagagggaggagatgtaggtctgggcttccacagggacctggtattttaggatcagggtaccgctggcctgaggcttggatcattcagagcctgggggtggaatggctggcagcctgtggccccattgaaataggctctggggcactccctctgttcctagttgaacttgggtaaggaacaggaatgtggtcagacagggtcagtgggagggctttggccattctgagccaacggtcctttgttagttggcctgaaagaagccatgacttagaacctgaagctgtcaggtggcaagaggccttagtcctggtgtttgatcctggcatagttctgggcctcagtctccccttctgtgaaatgggaataataacctttctacctctgacccttctcctgagtggctatgagggttgtgagagtgaggtgggccaccagagctccctgtccaagccaccgggagcctctcttctgtaggctcttcaagaggtggacctagagtatcactgtgccagggggattcctaagctctgaccctgcctgtctctgctgctcctgccccatctccctctgatccttctcctctgcactgtcttccttttccccttatgccttttctaccctttctgctctggcttttccttatactctgaggagccatctctggaaaaggccccactttcccagacccaggtgtcctaccaggccccaagttgtatccctcgtgctgcttaggccacgccctgcaggatgttctctgcggcctcccagcctttggaccccgatgggaccttgttccggcttcgcttcacagccatggtctggtgggccatcacttttcctgtgttcggcttcttcttctgcatcatctggtccctggtgttccactttgagtacacggtggccactgactgtggggtgagtgccagctccccagcccctgggtcagggccaggtcaggaggtggcagttagggtagaattagatagtggagaggaagtggaggatcagagagagggaaagggacaaggggatgggggaagggtaggtaagtcagagtcagagataattcatggggggagactcagagagaatagaatcacagtcctccctgagttggaagatgatgatagaaatgcaagggagatgacgggcgcagtggctcatacctgtaatctcagcacctcgggagggcgaagccagtggatcactcgagttcagttcgagaccagcctgggcaacatggtgaaaccccgtctgtacaaaaaatgcaaaaaaattagctgggtgccctggcatgcccctgtagtcccagctacttgggaggctaaggcaggagaattgcttgaggctgggaggtggacatttcagtgagctgagttcacaccattatactccagcctgggtgacaggagtaaaaccctgtctcaaaaacaaaacaaaataaaaaaaaaaaaacagcaggctgtgcactgtggctcatgcctgtaatcccagcactttgagaggccgaggtgggaggatcacctgaggtcaggagtttgagaccagcctggccaacatggtaaaaccctgtctctactaaaaaatacaaaaaaattagctgggcatggtgatgtgtgcctgtaatcccagctactcaggaggcttgaggcaagagaattgcttgaacccgggaggcagaggttgcagtgagccaagatcgtgccaaaaaaaaaaaaaaaaacaataacagtgcaagggagttgggggttagagggaggtgataggggaagagaagggattggaatgggcaggagagatcatgagaggaaggaggcagattggaaaggaagccaggactgaggaggtaaaatgaggccagaagatgggagatgtaacaagtggctttggcccagactcggggactgaccttggaggatccatcctcagctctgatctggatcctcaagctttgtttctcctactggcagccccaggccccaccacctgtatccactcagggatctgccagccagaaacctggatggacttctgtctcccacaatcagtccactaggcctttcctgggggcccagggataaaggttctgttgtgctaggggcatggaattagatatggacttgcccttaacatctcaatgttacaagaatcaatccttagacacagactgtcacaacacagtggtctggggttcctattatgattaaaaaaagagtacagtgactgtggggctcagaggaggcacttcacgcagcttggacattggggatcactttcttcttggaggaggggacattgttgctctgtggtaaagaaggctctttgtgaatgccaggccggcaacttttgatattatccagagggcaatttttatcaagagctttggaaagattttaggcaggaaagggacatgatcagatttgtgctttacatatttatttatttagagacaggatctcactctgtctcccaggcgggagtacagtgacctgatcttggctcattgcagccttgacctcctgggctcaggtgattcctcgcctcagcctcagccttgggtagctgggactacaggtgcatgccaccatgcctggctaattcttatattttttttgtagagatggggttttgccatgttgtgtaggctggagatttgtgcttcagaagaccactctagcttctgagtggagaacagctttaaggtcaggggcaagagtagggtataaggaggctggtgcagtagctcatgctcctgggggaaccagagccaagatgcggactgtgagcgtagagaggagggatggagtctagagaggtgtagaaagtgggattgacagcaaatggagtttttgtgcagttggcatggggcgggggacagtacggtagctagagaaggcatctataatgtggggggacttttacctgaggccaaaggaatgaatcttatggtgaaatctgaggtgccgtgcaaggggattttggggaaccctgctttataccatatgagtttctgatctactgtcctatcagaaagggcttatcctcccgtctctcagtactcttagctctgggcacatggggaagtttggggtgagctgtgtacccagtttctcatagctcctgatgttgcttgttgctggtgcagtcgatgagtggggaacttgtgtgctggaatggggctggcggtaggagtacatgtacctgattgtgtgtatgtgtctgtgtgtatatgtgcgtgtgtgtgtacatgatggaagagacagtccctgctcttagaatcccacccccatccctaatctgagagaagctcatgaagacaggaccagcagccacaatgccctaactctctcttcctcctgaggccttccccaaactctgtatcatttctccccagtacctgttcccaacagtggtcagggttcagggcccttgaatcctttaggctctcccagtcaagctttagatggtggtcctgttttccttaaagtagctgagactggggagtagttttcagattgaatattccaggaagcagaggcaatgctctgactaactcaactcagagtaacagcaaggcagaaaaatcaagtaaggagacttggaggttcctgcgtctctcccataagcagaccttcccatgctctgtggccatgtagctcacagcgtttttgcattctttacaggaaattttgtcttctgaaagccatcacttattgtacttaactgcatgccagatactgcagatgttttatacacgttatatttagaattcatatggcttggcatgttggctcacgcctgtaatcccagcactttggcaggtgaatcacttaaggtcaggagttcaagaccagcctggccaacatggtgaaaccccatctctactaaaaatacaaaaattagaggccaggcgtctgtaatcccagctactcgggagactgaggcaggagaattgcttgaacctgggaggtggagtttgcaatgagttgagaccgcaccattgcactccagcctaggcaacaagagtgaaactccatctcaaaaaaaaaaagaaaaattagctgcgtgtggtggcacctctagtcccagctactcagcaggctgaagcacgagaatcacttgaacctgggaggcggaggttgcaatgagccaagattatgccactgtactccagcctgggtgacagagcgagaccctgtctcaaataaataaataaataaagagaattcataaacaccctgcaaggtaggtggtgttatacccattttaccaatgaggaaattggagctcagagaggtgaagtgacttgctcaaggtcacccagctaataaaggcagagctgggatgcagactcagctttgtgcagttcctgagcctctatgctgccccttcacattactcagagtgcatgtctgagcctggtctcaagctatgatatctcaagctatggtatctcaagctatggctttgagaccagcatcttctctcccagagctctacatttagcttcctctgacagtgcagaagggaatccatctccttttttgtggaggctgtgaagccccatggctagtcttgccccaggcctacctgtgggctgccctatgagccgcctgcagcattgctcaccttctcagcagtctggcatctcattgaaagaaaggaatgatggtccttaagaactccacttccgaagactgtccctccatagttagagcaaattcattcccttgctgggttgctgggctctggcactgcgctggccctcgttggaggtctgcagaagtgcacagaaagtgtgggcaatggactggccatttccacagttttggaaacttttaaaaatccatattcttgctgggggtggtggctcacgcctgtaatcccagcactttgggaggccgaggcaggcagatcaccagaggtcaggagttctgagacgagcctgcccaacatggtgaaaccccatctctactaaaaatacaaaattagctgggcgtggcagcaggcgcctgtaatcccagttacttgggaggctgaggcaggagaattgcttgaccgcaggaagcggaggttgcagtgagccaaaattgcgccactgcactccaacctgagcaacacagcgagactccatctcaaaaaaaaaaaaatgcatattctggcttggcgtggtggcttatgcctgtaatcccagcagtttgagaggccgaggggggtggattgtttgagtccaggagttttagaccagcctgggcaacatggcaaaaccctgttgctactaaaaaaaaaaaaaaatccaaaaaattagccaggcatggtggtggctacttgggaggctaaggtgggagaatcacctgagcccagaaagtagaggctgcagtgagccgagatcgggctatggcactccagcctgggcaaccgaagtgagaccctgtctccaaaaacaaaagcaaaaacaaaacggccgggcgcagtggctcacgtctgtaattccagcactttgggaggccgaggtgggcggatcacgaggtcaggagattgagaccatcctggctaacacggtgaaaccccgtctctactaaaaatacaaaaaattagccgggcgtggtgacgggcgcctgtagtcccagctactcgggaggctgaggcaggagaatggcgtgaacccgggaggcggagcttgcagtgagccaagatcgcgccactgcactccagcctaggcgacagtgtgagactccgtctcaaaaagagaaaaaaaagcagattctggccaagcgaggtggctcatgcctgtagtgccagcactttgggaggccaaggcagatggatagcttaaacccaggagtttgagaccagcatgggacacatgacgaaaccctgtctctacaaaaattagcctgctactcaggaggctgaagtgagaggatcacctgagcccaggaggtcaaggctgcagtgagtcatgatcatgctattgcactccagcctaggcgacagagtgagaccctgtctcaaaaagggggaaaacaaaattaaaaaattaaaaaatgcagatcctcaggttccaagccttctgcattttcaaacaattcccccagtgagttgtatgggtaattaaagtttgtgaagcactgctctaggccctggagtctaagagagcctcttcccatctttggctttcctgtccccatctaaacccttgttcagtcatcccccatcctttcacctctcaaacaagcaagacaccagtccctgcagctgtgtattatcttctcctttttccttaaggactgaagcttcaataggagttccaggcattaagatggatggtggagatgcacaagaacatggtcatttccttagactaccccaggttaggagcacccactttcttttttcttttcttttttttttttttttttttttttttttttgagacagagtctcactctgttgcccaagctggagtgcagtggcacaatctcggctcactgcaagctccgcttcccaggttcacacagttcttctgatcagcctcctgagtagctgggactacgggcgctggccaccacgcctggctaattttttttttttaagtagggacagagttttgccatgttggccaggctggtctttaactcctgacctcgggtgatccacccacctcggcctcccaaagtgctgggattacagatgtgagccatcgtgcccagcccacccactttgttaatcatgatcagagcaggggtgccattctaccaccttggcacacctgcctagaggagtgagtggcgctgggagcagactgaggaacatcttagctgagcagtgaatccagcactgttctaaggaagctcagatggtctgtgactcatccctgtcctctggactgaatctgaggccttggaactcacccagggtcttagtggaggcacagctctgagctatgggtgtagagcatctgaacccatctacacattgaccaaacacaggcaggttccagtctgcgggggagatggagaaggtgccaccatgctgctgcacaaatcccaggatagctggggaatgagaatccagcactttgggcctaggacctggaaggagaggtcttttgggagaggtatggggacatctgaaggaggacttcttggaaggggaggggctggagcagaggcaagagtgattttgtcagatggagagaaggttctccacatgggcggggctggcagaggcagatgcccagacaggtcacaactctctaggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcagtgggtgcctggatgagggaggagtggggaagtgttccctgaggggacgggcctgcccctaccacattcggaccttcctacttcgtggtgtgggcactccctgcaatgtggctcccaatcctctttccctccagccatccacgaaaatgctttcattgtgttcattgcctcatccctcgggcacatgctcctcacctgcattctctggcggttgaccaagaagcacacagtaagtcaggaggtacggtctatccctagcgggggctccaaggcagcccagaagaaaatcaaggacatctgtcctcaggattcgggtaatggtgaggtgggaactgagttctaatgggaaccctggcagaggggtgctggggttggggctggggcttgggaacaaactgagggtggttggtcagaatctaggactatagcactgtgtttgggtagtgtgggagactggagaatagaagagatggaggctgcaaatggggatagaatgaggagtcgcatctaggcggcagtgagttaggaacagtgtcagaggactggtctgtcataattccagcgccccacccatgtacatgggtttcttttcccccacagtatttggaggtggggttggtgggtgactccatgtaactttcatactccatccccctgaagtggaagcggcaggaataccactgctcctcggcccatcactcccccagaggcagggacgtgaacacatagtcgtcattcttgctgcccctgcctgtgctcccttccatgaccgctagtgggagccaagggagataaggcccagcccttaggagttagggctgagaggggagcccacgctctcatacccagcaagctgcagagtgatcagacagcccattccctaggatcgcaagtcctacagctggaaacagcggctcttcatcatcaacttcatctccttcttctcggcgctggctgtctactttcggcacaacatgtattgtgaggctggaggtgaggccaggataggatccacaggcggtcatgagtggctgcggggcagcaatgatgtttttgataatgggcaatggtcttggggactggctgccattgtgttctctgtggcagaccaatggtggtgtgatttatcaagaggcctctgagcgggtagctggaagttcaccatgtcctgttccttgtgtcctcacaacagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggccaacagttgcctaggcttgct

SEQ ID NO: 38078 - DNA, 39085 bp, Homo sapiens; identical to SEQ ID NO: 36800

SEQ ID NO: 38079 - DNA, 110584 bp, Homo sapiens
ggactttgggactggacagacctggtcacagtctaggttctacatcttactggtcgagcaactttaggcaagtagcttaactcctccgaacttattttccttttctaccaaataatgataatattacttcatgagtttgtgagtattaaatgagatcatgcatatacagcctacagcccttagcacaccatgaacacatagttatttgataaatgtttgttagtgtggttaattgaacagaaagccttaaatgtcttcctaaccctaaaatccagtgattctttgaactggggagggcagtagagagatttaatttgtggaaaaatgaaaagaccatttaaaattattcaatcagaaatgtattaagctttgtgtatttgtgtcaggcatttgtagacagtgtggaaaatgtcttatccaatgattctttgaactgggagggaagtagagagacttaatttgtggaaaagtgaaaagaccatttaaaattattcaatcagaaatgtattaagctttttgtatttgtgtcacaggcatttgtagacagtgtggaaaatgtcttaataaatgagacatgctctttccttgaaaaagcttcagtctgactcacaaagagtatatgaattttttcctatgatggcttgaaagattttatcttcaaattcctttttgtgagattgtttttccataccagtgcttcttatttatagggcttgttgcaagtaatttgcaatattgttacaggttgagtatcctttacaccaaatgctcagaccagaagtgttttagatttttttggattttggagtatttgcatccccaaatctaaaatgctcaagtgagcttttcctttgagtgtcatgttggcattcaaaacattttgaattttggagcaattcagattttgtgtttttgaattagagataatcaatttgtaataatatttaaggtattgctgtttgtgaaagatgtatttttaaacgatttagagtcaattcatgataatctccgtaatactcttacaagaattccaggctgggcatggtggctcatgcctgtaatcccagcgcattgggaggccaaggcagacagatcacttgaggtcaggagtttgaggccagcctggccaacatggcgaaaccccatctctactaaaaatacaaaaattagcagggcatggtgatgcacatctgtaatctcagctactcgggagcctgaggcaggagaatcacttgaacccgggaggtagaagtgtagtgagctgagattgcaccactgcactccagcctgggtgacagagtgagactcagtctcaaattaaaaaaaaaaagaattccaatatgatttcttaagtgggagaaaggggtggattgtacaaactgtgtgcaagtgcaacctttgttcgtgttttgtgtgaaccctcctattgctgatcaccacttaaaatggtagggacaattagttagttcagggcttccctaaatatggggagtgctaaattctgggtacatccaagagcacgtgctaggcttttgaatgccatttgtcacacatattgaggtctaaggttgcaaaccattgtatactagatccttgttattcctggtgtgaataggcatgtgtgcctacttttaatttcttcttgagttcagtgctttgaaaacagacagctgaagaaaatgtctaatagtctaaagaggaagcaaacactttcctagaaaccttcgaaactcagaaatggatttctagaaattctagccataatacatactccttttctttctgggcctcattcagaatcttgatgtctcaactgtctctgagttttttttttttttttttttttttttttgtctttccccagacagagtcttgcactatcccccaggctggagtgcagtggagtgatcttggctcactgcaacctccacctcctgggctcaagcgattctcctgcctcagcctcccgagtagctgtgaggagcaccaccacacccagctaatttttgtatttttggtagagacagggtttcaccatgttggccaggctgctcttgaactcctggcctccagtgatctgcccgccttggccttccaaagtgctgggattacaggcatgggccactgtgactggccttgtctctgaattttgtgtggaattgtcctctaggagtttgcagggtattccagattgaaagtagacctttgaaaagtatggggcatgcaggctgggatggaatccacagctgagggaaaagccagggaatcaaaatagaggaatctttgcttcagaggaaggcagctggggacttggtgccaggagtgtttggttcccagctctgcactaactggatttgagactttggggaaagtgcccagaagctgtggtctgctctggattgtcatgcagtttaaatgagacgttgcctgtgaagggctttctgggaggaacaggtacatatctagaccaaccctacttgtaatgcaggaacaaaacaaaactgaaattacatagatgctgccccttgaatactcttggattccagggtctcaaagtgcatagggtaaagtagcagatgactgaggaaaatgcatctaaacttctcttagccttcttatctctcggagacccaataggcttctaacagaccaaggctctggacagggtgtggccccctttcctatgagaggattaggagggaaggaaagggaaagaaggtgctgcatgaaattgatcttagttgttgactttgtgccaactggctggtgggggttttgagaccagaatagaaagatgaagtcatatagaaggatcagctgaaagaggtaagagaaacggaagcaagtgtaaaaaggattgataggctgggcacggtggctcacgcctgtaatcccagcactttgggaggccaaggcaggtgaaccacaaggtcaggagttcgagaccagcctggccaacatggtgaaaccctgtctctactaaaaatacaaaaattagcctggcatggtggtgggcgcctgtaatcccagctactcgggaggctgaggcaggagaattgcttgaacctgggaggcagaggttgcagtgagccaagatcatgccactacactccagcctgggtgacagaggaagactccatctctggaaaaaacaaaaaggattaataaaggaagatagcaagagattgaagaggggaggaagaggagggcagtgggaagcaggcctcccctcgacaatggggaatcagagctgctgactccagaacagtattaaacttccaggacaaaggtttgggttcctattgggcaccatatgaagttctatttggttgaataaactcacatcacatttgctgagtgcctcctatggaagagtcctggacgggggtgaaaggtggacagtgagggggtaggagtgcactttgcatagatctgggtttcaaggtaggagatgtttgtgtaaggtttgcttttaaaaaattcagggctgcttacaaagtaatgggcttgatttcttttctcctgcttatggaaatcagtttatttgtctcataataagcaaaaactgaagaaaccaacaccactgttgcaaattttgaagctacaaggaaaactgatgaggtgaaatttttggcatacatcagaatcgtattcagtctgaaacggaattatttcctctttttcttttctttttaataaacccaactaaagtaaatattttcctgagctctcacccctataggagggttattttggccttctgaagagggtgagatggagatatagtgctgctgatttcctacctgtgagcctcctcgtgggtcccatcgaaaccctgctctccctgctctgagggaaggtgcttcacagcaacttcagcctaagggcagtgacagtgaaatggcctccagggagccagcagcctgggctgccctccgctgtgtgtttttgtgccctcaggaatgtgtggatgcagcaaatgacaacagtgagtgctctgtccctagcggagccccaggccctgtcactttttgtcttggctggtttccaaggttgaatgattgcattggttgaagcttcattatccacaaggggaggcaagacagtgggctggagggagaaaaataggcctttcccacgggcatgattccagcagggtttgcatttttacatcagtagatctcagggactttcattttctgtcagtttgggccgtttgccctatcccagctacttgggaggctgaggcaggaggatcacttcagcccaggaatttgagaccagccttggaaacagcaggatcccacttctgaaagataaataaataaatatcccagcactaaagcccatgtatttagtggtaatacaatttctgcttttgacagcattttccactggatgtcagccgccatagcatcactttggagttggaaaggaccacagagctcattctagtgtaatccctgaatgtctggagaggctgtgcacacagctagtgagtgacagagtggtgcccagaatttgggttacccaagccccacatcagtgttgtggtccctacacttcactgcctctggtgtcattagaataatttcagtaatttgttgtatcaggttgggctgaagtgacctgtattcaaatcctggtttttccacacctaggtatatactcaagaaaaaggatcacacgaaacttatacacaaatattcagagcagcatttttcaaagtaactaaaaagtggaaacaaaccaaatgtctatcaactgataaatggataaacaaagtgtgatatttccatgcagtggactactcttcagccttgaaaaggaaggaagcagtgatatgtgctaccacatggatgaccttggaaacattatgctaggtgaaagaagccagacacaaaagccatatgttgtatgattcagtttacataaaatgtcctgaataggcatattcacaggcacagaaagtagtttagtggtttccagggcctgtggggaggggagtatgtggagtgactactaataagcatacagggtttattattgggatgaaaagaatgttgtggaatttggccaggtgcagtggctcacacctgtaatcccagcactatgggaggccgaggcaggtggatcacttgagatcaggagtttgagaccagcttggccaacatggtgaaaccctgtttctactaaaagtacaaaaattagccgggtgtggtggcgtgcacctgtaatcccagctacttgggaggctgaggcaggagaatcgattgaaccctggaggcaaaggttgcagtgagtcgagatcgtgccactgcactccaacctgagcgacagagtgcaactccatctcgaaaaaaaaaaaaagaaaagaaagaatgttgtggaatttgatagttgtgatggtttcacaattgtgttaacatactaaacatactaaaagccactgaactgacacttttttaaaagggtgaattcatggtataagaattatatctcagtaaagctgttatttaaaaaattctggctctacctcttactggctgggcgactttaggcaatgaacctaaagccaagtcatctcagctatgaaactggaataataatacacttcacagggtctttttgataaacgagattgtgaatttgaaaatgcttctaaagtgtaaacctcacatatttttggactgtcaatgggttataagttcattataaattggatttttaatcttctcctcctgtgtttttcacaatactaacaaggtctgggtacatagtgatcactcaaataaagatttattgagttgattcaaatgtatttcagttttattcaattgtggtaaatgaaactacacaacaggaaatctactcttttaaaagttttcaactgttaaaaacggtgttatgaacgatatgcacattgttgtacagcaaatctctagaaccttttcatcttacataactgaaactatatccactgaacagcaacttcccatttttacctactcccagttcctggcaaatgccattttactttctgcggtatgagttagactactttacatacttcgtataagaggagtcatgtaggatttgtccttctgtgatgggcttactgcacttagcataatgtgctgaaggttaatctatgttgcaacttgcgtcagaattttcttccttttaatactgaataatattctattgtatgaatatactgcattttctttatgcatccatccatcaattaacatttaggttgtttccatctgttgactattgtaaataatgatgcagtgaatatgagagtgcaaatattttttcaagaccctgttttaaattcttttggataggctgggttctgtggctcacacctgtaatcccagcactttgggaggccgaggagggtggatcacctgaggtcgggagttcgaaaccagcctgaccaacatggagaaaccccatctctactaaaaatacaaaattagccgggcatggtggtgcatgcctgtaatcccagctactcagagggctgaggcaggagaatcacttgaacccgggaggcagaggttgcggtgagccgagattgcgtcactgcactccagcctgggcaacaagagcaaaactccgtctcaaaaataaataaataaataaataaataaataaatgaattcttttggataaatacccgtaagtggattgctggatcatatggtagttctatttttagtttttgtttgttttttttttttttttgagatgcagttttgctcttgttgcccaggctggagtgcaatggcgtgatacccattcactgcaacatctgcctcctgggttcaagcaattctcctgcctcagcctcccaagcagctgagattacaggtgtgcgccaccacgcctggctaattttgcatttttagtagagacagggtttcaccatgttggctaggctggtcttgaactcctggtcttaggtgatccacctgtcttggcctcccaaagtgcctggattagaggtgtgagccaccgcacctggccctatttttaattttttgagggccttccatattgttccccataatggctgcaccactttacattgccagcaacaatgcacaagggttccgatttcttacatccttgccaagatttgttgttttcctttctttttttttttttttttttttttttgagacagagtctcactgtgttgcccaggctggagtgcagtgggatctctgctcactgcaacctctgcctcttgggttcaagtgattctcatgcctcagcctcctgagtggctgggatttcaggcacccaccaccacacccagctaatttttgtatttttagtagagatgagttttcaccatgttggccagactggtcttgaactcctgacctcaagtgatcctcccgcctcggctttccaaagtgctgggattataggtgtgagccactgtgcctggccatattatcctttttttttttttttttaaaagaaaataatggccattctaaaaggtatgaggtgatagatacctcgttgtagttttgatttgcattgtcctgatgattagtgatgttgagcatcttttcatatattttctggctatttgtatgtcttttttggagacatgtttattcaagtactttgccaattactaaattgcatgatttattttcttgccgttgagtttattgagttccttatatgttttggatattaattccttataagaaataccgtttgcaggccgggcgcggtggctcacgcctgtaatcccagcattttggaggcagagacgggtggagcacaagttcaggagattgagaccatcctggctaacacggtgaaaccctgtctctactaaaaatacaaaaaattagccgggcgcggtggcgggcgcctgtagtcccagctacttgggaggctgaggtaggagaatggcgtgaacctgggagatggagcttgccgtgagccaagatcgcgccactgcactccagcctgggcgactgagcgagattccatctcaaaaaaaaaaagaaaaaaagaaagacagaaataccgtttgcaaatattttctcctattctttatgttacctttttactctgttgattgtttcctttgctgtgcagaaacttttaagtttaatggtgtctcacttttctgtttttgcttttgttgcctgtgctttgctgtcatatccaagaaatcattgccaagaccaatgttatgaagattttcctctgcatttttttctcagagttttatagttttcaccgggcgcggtggctcatccctataatcccagcactttgggaggccgaggtgggcagatcacgaggtcgggagtttgagaccagcctgaccaacgtagggaaaccccatctctactaaaaataccaaaattagcctggcgtggtggtgcgtgcctgcaatcccagctactcaggaggctgaggcaggagaattgattgaaccagggaggcggatgttgcagtgagttgagatcgggccactgcattccagcctgagcgacagagcgagactccgtctcataaaaaaaaaaagaaaaaaaaacaggtttttttgtttgtttgttttttgtaggggaggagattcactcttgttgcccaggctggagtgcagtggcacaatcttgactcactgctacctccacctcctgggttcaagcgattctcctgcctcagcctcctgagtagctgggattacaggcgtccaccaccactcccggctattttttatatttttagtagagacgcgatttcaccatgttgcccaggctgatctccaactcctgacctcaggtgatccgtccacctcggcctcccaaagtgctgggattacaggcatgagccaccgagcccggccaaaaaaaaccaaaaaaacaaaaaaccccccagagttttatagtttcaagtcttatgtttaaatcttttatctattttttttttgagacggagttttgctctgtcgcccaggctgaagtgcagtgacacaaccttggcttactgcaacctctgcctcccaggcaattcccctgccttagcctccagagtagcttggaatacaggtgtgtgccaccaggcctggctaatttttttgtatttatagtagagatggggtttcaccatgttggccatgctggccttggacttctgacctcaggtgatccacccaccttggcctcccaaagttgttgggattacaggtgtgagccactgcacccagcctcttccatccatgttgagttgatggttgtgtatgatataagacaagcttgtccaacgtgcagcccacaggctacatgtagtccaggacggctttgaatgctgcctaacacaaatttgtaaactttcttaaaacatgagatccttttttttctttttttaactcatcagctatctgtagtgttagtgtattttgtgtgtggcccaacacaattctaattctcctttttctcctcctccttctccgcttcctctttctcctccttctcctccttctcctccttctcctcctcctcctcctccttcctttttttttttttttttttttttttgatatagagtttctctctgtcgtccaggctggagtgcaatggtgcaatctcagctcactgcaacctcctcctctcaggttcaagcaattctcctgcccaccaccatgcctggctaatttttgggcaggtacccaccaccatgcttggttaacttttgtatttttagtagagactgggttttgccatgttggccaggctggtctctaactcctgacctcaagtgatctacccaccttggcctcccaaagtgctgggattataggcgtgagccactgtgcctggccttaattcttcctccagtgtggctgagggaagccaaaagattagacatctctggtataagattacagtttagtttcactcttttgcatgtggatatcaagttttttcaacaccacttttttttttttgtttgagacaaagtttcgttctccttgcccaggctggagagtaatgacacagtctctgttcactgcaacctctgcctcccgggctcaagcgattttcctgcctcagcctcctgagtagctgggattacaagtgtgtgccaccatgcccagctaattttttgtatttttagtagagatggggtttctccatgttggccaggctggtctcgaactcctgacctcaggtgatctgctctcctcagcctcccaaagtgctgggattatagatgtgagccactgcacccagccctctttcttcctttttttttttgagacggagtctcactgtgttgcccaggctggagtgcagtggcgcatttgtggctataaagttccctgtgagtactgttttggtgtgctgtgttttcattttcatttgtctcaagatattttctaatttccttttttatttctcctttgatccattggttgttcaagagtatgttaattttcaaatatttgtgaattttttagttttccttctattattaatttctagttttattccattgtggttagaaaaaatgtttgtgtgatttcaatcttctcacatttgttaagatttgttttgtaacctaacgtgatctgctttggcaaatgttctgtgtgtgcttgagaagaatatgtgttctgctgctgttaggtggaatgttctgtatatgtatggcagtttagttgagtttatagtgttcaagtctattgtttctttagtggtcttctgtctggatgttctgtgtattgttgaaagtatggtgttgaaatctccaattattagtgggtggctatctatttctctcttcagttctgttaatgtttgcttcatatatttgggtgctctgatgttggatatataaatatatatatattttcagatggagtttcactctgtcacccaggctggagtgcaatggcactatctcagctcactgcaacctctgcctcccaggttcaagagattctcctgactcagctacctgagtagctgggattacaggtgcccaccaccatgcttggctaatttttgtatttttttgtagagacagggttttgctatgttggccagactgctctcgaactgctgacctcaggtgacctgcttgcctcggcctcccaaagtgctgggattacagttgtgacccaccattcccagctgggttaatatatatttataattgttgcgtcttcctagtgaattgactcttttatcattatattatgtccttctttgtctcctatgatagtttttgacttaaagtttattttgcttaagcatggctactcctgctctctcttggataacatttgcatggaatatgttttttcatcctttcactttcagcatatgtctgtctttaaatctaaagtgagtaccttatagacagcatacagttggatcatgttttttttttaatccacttagccaccaacagaattataatttttaagcatttatcagaagtaaagacatttagtaatgattccccccttcattttatatacctattttctctttattttatttttttaacagagtcaacctatttgatttcttgacaagaccacaatctgatcccaaagatgtgctccacaaatccaggcaaatgggtcacctttgatgatgatcctgctgttcaatcttctcaaaagtcaaagaattttcctctggagaatcaaggtgtctgtagaccaaatggactgaagctgaaccttcctggcctcagggaatttcccagtggatcttcctccaccagcagcactcctctctcctcccccattgtagatttttatttcagtccaggacctccaagtaactctcctctttctacacctaccaaagacttcccaggttttcctggcatccccaaagcagggactcatgtgctttatcctattccagaatcatcttcagacagcccactcgcaatatcaggaggagaatcttccttactgcctaccagaccaacatgtttatcccatgccttgttacccagtgaccactcatgtacacatccaactcccaaagtaggtcttccagatgaagttaatcctcaacaggctgaaagcctaggattccaaagtgatgatctcccccagtttcagtattttcgagaggactgtgctttttcaagtccattttggaaagatgaaggcagtgattcccatttcacccttgacccaccaggaagcaaaaagatgttctcatcaagaaacaaggagatgcctattgaccaaaaaagcctaaataagtgttcactcaactatatctgtgagaagcttgaacatctccagtcagctgagaaccaagactcacttagaagtttgtctatgcactgtctatgtgctgaagaaaatgcctcttcctttgtcccccacacactcttcaggagtcagccaaaatccggatggtctttcatgctgagaattcctgagaagaagaatatgatgtcttcccggcaatggggaccaatttttctgaaagttttgcctggaggaattttgcagatgtattatgaacagggattagaaaaaccatttaaagagatacagcttgatccatattgtaggctttctgaacccaaggttgagaacttcagtgtagcaggaaaaatccacactgtgaagattgaacatgtgtcttacacagaaaaaaggaaataccattctaagacagaagtagttcatgaacctgacatagagcagatgctgaagttggggtccacatcgtaccatgacttccttgactttctgactactgtggaggaggagctgatgaagttgccagctgtttcaaaaccaaaaaagaactacgaggagcaagaaatttccttggaaattgtggacaacttttggggtaaagtcacaaaagaaggaaaatttgttgaaagtgctgtgataactcaaatttattgcctctgctttgtgaatgggaacctggaatgctttttaaccttgaatgaccttgagttgccgaagcgagatgaatcctattatgagaaggactcagaaaaaaaggggattgatattcttgactaccattttcataagtgtgtgaatgtacaagaatttgagcaatcaagaatcattaagtttgtacctctggatgcctgccggtttgagctgatgcgtttcaagactttgtataatggggataatcttcccttttccttgaagtctgtagtggttgtccagggagcatacgtggaacttcaggcttttgtcaacatggcctcattggcgcagaggtcatcctatgctggttccttaaggtcctgtgacaatataaggatacactttcctgtcccatcgcagtggatcaaggccctttggaccatgaacctccagaggcagaagtctctgaaagctaaaatgaaccgccgagcatgtctggggagtttacaggaacttgaatctgaacctgtcattcaagtcactgtggggtcagcaaaatatgagagtgcctaccaggcagtggtatggaagatagatcggcttccagacaaaaattcaagtaaatattcaacaccccaagtttattttcatgggaaatagcttaaatattcttaccttcctccttgggttgaaaccaggtagagacagatggcaatttgtcagctgaggctgtgctttggggtaggagatggaacatttagctaaacagctggtttatttgtttccttttgcacctatttctaccagataagtttaactgttgaacattttttaaatatcatacgaaataccatgctaggctaggaatttgttgtggatggcggcactaagagaaaattcgttgatatccatggttgagattaacgcatcaacttcaaatgttaaaaatatttctaatatagctgagattccctaattaatctctaaagatctgtcatccatgaatatacctgaacttctttgcattctcagctgataccacttcttccttaggtttgctccctgctctttgaaataagactgctttcatttttacccaaattgatttttgttgactgaattcacccatttggtcatctcaacttgtattgtttttgtttttgacatggcatctcactctgtcatccaggctggagtgcagtggcacgatcacggctcactgcagcctccacttcccaggctcaagtgatcttcctgcttcagcctcctcagtacctgggattacagatgcataccatcgtgcctggctaattttttgttttttagtagagacggggtctccctatgttgcccaggctgctcttgaattcctgggctcaagggatcctcccacattggcctcccaaaatgctagcattacaggtgtgagccacctcatctggcctaaactggttgttttagaattaggtggacacacgtgagtgttaaaaattcagttaatttttaaaaattttgcaaataaaaattatctaaaagtcagaacttgaaaagacagttatagtaccacatttattttggagtagtaagtaaatagtagtggacataatataataaagtcaaaaaccaaattttaaaattagagctctttcctattttagttgagggttgttggttttttttttttttcccccctagcagagcactggtcactggtctctggagttaaattggaggtggggttgggggacctgagttgatgcattcatgcatccatcgatccatccatccattgatccaaatcttttttttcttttttttttttttttgagatggagtctcgctttctcacccaggtggagtgcggtggcacaatctcggcttactgcaacctccgcctctcgggttcaagtgattctcctgcctcagcctccggagtagctggaactacaggcgcccaccaccatgcctggctaatttttgtatttcagtagagacagggtttcaccatattggccagggtggtctcaaactcctgactttgtgatcctcccacctcggcctcccatagtgctgggattacaggcttgagccactgtgcccggcccatccatccaaatctttactgagtacttactgtataccaagtgccacatcaagtgctggggataaagataaataaaaatctgatccctgtttccagatggctcacagctgctgtagtccttcagagaaatttaagctcatctaggcccctccaggctgtggacttcagaggaagcatttttctttggggtggccttatggcagtgtttctcaaacctggctatattattattattattattttgagatggagtcttactctgttgctcaggctggagtgcagtgcgatagctcactgcaacctctgcctcccaggttcaagtgattttcctgcctcagcctcccgagtagctgggacgacaggcgtgagccaccacgcctggctagtttttttatttttagtagagacggggttttcccatgttggccagactggtcttgaactcctgacctcaagtgatccacccgccttggcctcccaaagtgttgggattacaggtgtgagccaccatgcctggccaaacctgactatattagaataacttgaaagcttttaaatcatctcaatgtttaggtttcacttcatgctaattaaatcggaatctctggcgggggtgggcggtggggagggagccagattccaagtattttaagatctctccagatacaaggtgtagccagagggaagaacactgctctccaggtgttgtaaagttgtagaaccagaagaacaagccccagactacaattgacttgaggggcagcactgcccgtaccctggaggccatgggaccaccttgtccatgactctctgtttgttggtttaacacctgttgactgatgagagcttgagctatgggcaggatccttcaggtgagagacacaggcctagtgagctgaggagctccaggaccctgtgcagaagggaagttcctacattgtctttcttcctgacaccccatacccttcttcattaatgccaaatttcaccccacagcgttctcaagactcagattaattatgttcagttcccccatactagcaaggatagctcaggcttagggcagagtgaggtggtgatggtgcagcctggtcacagtaaatggtctcaaacagcacattctgatcaactctgctgtgatgggagggaaggtcagtatcttctatgatataatccactgagatgatgtttcctgctttctttttttttctttttttgggatggagtgttgctctgtcacccaggctggagtgcagtggtgcaatcttggctcactgcaaccgctgcctcctgggttcaagcaattctagtggctcaacctcccaagtagctaggattacaggcccgcaccaccacacccggctaacttcttatattttgtgtagagatggggtttcaccatgttggccaggctggtctcgaactcccaacctcaggtgatccacccgcctcggcctcccaaagtgctgggattagaggtttgagccaccgtgcctggcccctgctttcttttataacttggctagagaggcaaattgaaccatttgcatcatcatgccagagaaaccagttttaaggtcttcatacaaggttccaaatggtctattctaaaagttacttgtgctagttttaggttagagggtttaaacaaaatcagagtattagcttttgttttgctcaacaaaaagggaaagagaggcaggcagaaagtcaggcaggctggaatgcctattggaaactcctggatctgcaggtttcccctgaaatctgggtgataaactaactcctgttgttttccgttgatcctagagatggtctcgaggactagaacaaaaggtccaaagcagtttttgcatagacttgaagtggtaattatgcttttgagagagaagcacaataggctcaggctgtgggcttgcccacgtggtgtgagagggacaagagcacaggctccctttgtagtccattcctattgctctacttagagcaggtgctccgggaggccctgaaggaaataagcacttggctaaagcctggccagggtaaccacacttatttttcaaactgagaacccataccaatcatcttttctaattttgggagtgcagacacgtatgaagctttttgtgaaaatgatcctgtttataatactgcatttttttcagagtcattggtgtagttaactgattcaatcaacaagaatttattgagaaggagtctcactcatttactccacaaacatctactaaagttcttctaggtataggttctgtgctgagtgtttaagagatacagacacaaacatgattcctactctaccagaaacttaacagtctagaaggtgagacagactctgaagcagctacccaaatgcactgtggaaaagtgcatagttccaggcttggacaaacatatgcacttagggatcccagaggaaagggtaataaactgcctggggactagggagggcttcgctgaagagctgatggctgggagagtcaatagagtttccatcaaagaaagaaacagcagaaccacaggtgtgtgggtgggggatcttacctaagttttggggctgagggagtggtcggggaagagaccagtgtattaagaccttgtgggccatgctgtggggtgtgaagtttatctgtcaacagggcctcggggttgttttcggcatgactgctacagaatcatatcttgtttcagaaaggctggcatgcagtgcagaggaaagatttaggagtagattatagacacagggaagttgggaggaggtaagggttgctgagcaaaggcagtggcagagagagagaggcaagagatgggtgagcgaattcaggggaggtgcccctaagtgatgacagattctctatgggcatgagggaaagggagggaatgggacaaggtcaggtgctctggctgtggtggataggtgggcaatggtgccattagccgagatagcctgggatcttctcatcactcatccttttaaagtctgtttcccagtcctggccacatgttagcatcattaaagcttcaaacacatacccatatttgggccccatcccctactaatcgggctctatgaagatgaggctcaggtgttgatgtttataaaggctcatgcagccggggttgagaactactgacgtgatcccctaggcagagatcattcctccctgctctgcatatgcctttgtcttccagacctctgttattgctctcccatgagtatttatttatttatttatttatttatgagacggagtctcgctctgccacccaggctggagtgcaatggcaccatcttggctcactgcaacctccacctcctgtgttcaagagatttttctgcctcagcctcccaagtagctgggactacaggtgcgcaccaccacgcctggctaattttcgtgtttttagtagagatggggtttcgccatattggccaggctggtctcaaactcctgacctcgtgacctgcccagtttggcctcccaaagtgctgggattataggcatgagccactgcgtccggcctcccatgagtatttattagcagtggagctcaccaagaacaatgacaagaatggacatttccagggaaactggctggacctgatcttggccttcaggaattcttttgtaaaaccgtcatatcaccaggcccacagaggacaacattttacaggcatttcagtcaattacacagtgataattcactgaacaaatcctttgggatcacagctgctttattgagatcaggtctgtgcacaaagaggaggcccagggaaaacacagtggggctgtgtcaggtggcgtccagagggcatggtgcagctgtgggcctggcttggggcaggacatttctgggattacagggccctgccccaagcttctccgttgagggggtagggagggcaatgcagagagtgagagggtgccagggcaggctataagctaatttgcctcttgagaagtagggtaataataaggttggagcagagaggaaatctttgtcctaaggcagtgcttctcaaacttttgtgggcccaggaatcaccttgttaaaatgtggattttgactgagcaagtgggatctggaatactgtgtttctaacaagtgctgatgtgacgccaatgcatctggcccaaggaatacgcttagaatagcaggatcccagaatgcatctctatttttctatatgacttttagatcagttgtgtatttagagaacataaagtttttaaaaagctctttaaaattttatccttttcaagattgtctcggaaaactttgcattatttgaaaagatacttcgaaaatggaaactgaatgaatagcactggagtgcagtggcgaggtctcagctcactgcaacctctacctcccaggctcaagccatcctcccacctcagcctcccaagtagctgggaccacagcacgtgccatcacacctggttaattttttgtatttttggtagagatgaggttttgccgtgttgctcaggctggtctcgaacttctcagctcaggcaacccacccgccttggccttccgagtgctgggattataggtataagctacctaccgcacctggcaagaacatataaactagtctactatgttctaattataaaacttttttttaaattttttttccttcctgggaatttgagggatcaggattgaccttttttactggggaaatcacctgtgatttctggaaaggtggggagggctgctggtcccttaatgtcccttctaaccagcttgtcaatgcttagtattcctttgacagtgggcaggtctttcattttgcaacaaaggtttgcctgaggcactagctcacagacttcattcatactaaggtgtgaatgacagcagaggagcttaggctttgttggggtgatagagagagaaagagaaaggaagaaagagaaagacagctgaagacaaatgaggatgctggttagccagaggaggtgtatatggtggcacagaattattaaggggaatgagagtggtggaggagcaattaaatatatctacctctaacttcccaatttttcgacttttctctttttttcttctgccctgtcatcagcacgttggttgctctctcctcctccactctgtcatcctcttgctattctttcccttcggccctctaacagttcagtttcaggtgtaaaatattttggttcaggagggactggatatcaactagacctaagattttgtgatttacattccccgtcctaagaaaaggaattatgttgagtgaacaatgaccaaagctggacagttccccctggtggtcagcactgcgacaacacgattttcctctatcttttattcattaattggtgaatttgaaaataatctgttaagccccaaacatgacagacattgtgctaaggacagacatgacacctgtccctgtggggcagaaagtctgaagagggagtgtgttactaaacattgtagagcatttagcattttcaaaagccttaaaaaataagccagaaaacttgaaaggaaaaaggcttttaccatttttaaagaaaagcaggtagaaaggttttgtttctgacattttttgtaccactaagtcttcaatttgggtttagttcttcaattttcatcgtaaaatttccccaaataattttttcttataaagtgtgagtatcaaatcagatcatgtgtagtataatttttaactccgaatgtgtaacattcacagtccctttattagcaaaattatagtaattaaataatactggctttataattgaatagcactttgcaaaataatatgtctggctcatctatattgctatagaatactactgccccagtgctgtatgcatatgaactggttaatcctcacaacagcccttataaggttcaggttatcctcattatccacatttttagatgaagaaactgaggctcagagagataagcaatttgtaaccctagccttaaccactttgccataacaagacagaagaatgcctgcagtaagtgtaaatgaacttactgtatcctcactgcagacagaggactaaaaagagtaatggggtttgcaatctttctgggtgtgtgtgtatgagaatgaagttatcacttgcctccagtgatcaggttgttaagagcacctcagaggccactgttgtcctacccttcctgtaagtggtagagatggctaatgagcatctgttggttaactgattgatgatttctcaaggctttttacagccttagaattctattagtcactctacaagaaacaggttgtatggaacgaaaggtaatttatcttttaagaattaagtgaaatcctttaaactcttgtttttgtgcctaaagctatattctgatggaaatgctctttctctagctatgtcagtggtacagtaatttaatctggttcttgaaattactctttatctcatacatttatttaagtaaagatagccacattagatatggagatgctatgaacaatgcaacagaatcatggaatgtttgtaaagctgctgcagtgattacaatgaaaatattgatcatttccttataacacacacacacacacacacacactatatgacccccatctaaaatctttgaaatatatccagtatctctgggtctggcactgaacctggcctggcatagcacagatgctcaataagtgacaaattgagtgaaaaccaatattagattaaaatattaaaggccaatatgcccatttctactctgtatagctgttccagtcaaagtattttggaaggatgagtgagaattacagtagggaaaaataatttgttccactgaaaaaagaattcttggcctggaacattttctgaaagttaagtttaacttttaaaaatcagaattttaaaataatgcgacttaatttgggctgaagtttatttttgagttatctgtaaatagatggtaaggaaatgaataaattaataattataagatgttactcagtctaagagaaagaggcttgtacaggtcttgagcacattgtagccaaataattatgtttaatataaatattactcatatcttttaattaaggaaaacaattaagtttaagcatattactatattgtttaatataaattaaacattaatattaaaaatattgcttaaaataaatatttagcaaattatattagtataatatagtaattatattgttatatactaatataatttgctaaatatagtaatatttctaattaatattagtaatatttctaattgaaaacatttttaggagttcatctgtgcctgcatatagtaatatattttttatttttatatttttgccattcttattcaaaatagtaatgaagttgtacttgtttttaaagctagtacttaaaaatggcagacagctttccccctagttggtgcaaaattgtagattttcatggtatgttgtttaaatggaatttgcactgctgcagtgctaatgaaattccttattaaggagagagatgagtgccttttatgttcaagagaaatgttcaatggccattaaaatactttgactatttgattttttttccctcgaggtctagatcatccccattgtctgtcatacaaattagagcttggatcagaccaagaaattccctctgattggtatccatttgctactgttcagttttccgtgcctgacacctgtgcctcaaggacagaggtcaggtctctgggagtggagagtgatgtccagccacagaaacatgttcagcagcgagcttgctacaacatccaggtacatcccaaaacttctagaactgtgacctgatttggctttaaatatttgttttgctgtcttttgtgatcgtgtatgtgttgtgtgtgtgtgtatatgtgtggtgagatttgccctagagaggatctcagctatggaaacttgatggccaccattgagcttagttcttcctatccattctggagaatgttgggaacacttaataatttagctctcaatgaaaaacaggacattaaaaatgaatctacattttagaagcatatttataataaaaattatgatgttaggacaccatttctcaaaatatgtgctgcagaacatgtgtcccatataattatccaacaaaagaataagttggggaatgccgtatactaaattaatgttaaataaaggctcccaagaagtcctgcaataaggaaacttgttaaacttagttaacccagtttttcccaactcattggctattgtgtcttgtctttgtgggtatgtgtatgtaaaacacttatccctatcttgtggaatagtgttctgtggagcatgctttaggaaatgctgagttactctattatggtagttttcagtttttttttttttaagacggcatctcactctgtcacccaggctggagtgcagtggcattatcttggctcactgcaacctccgcctcctgggtccaagcgattctcctgcctcagcctctcaagtaactgggattacagccacccaccaccacacccagctattattattattattattattattattattattattctatttttagtagagatggggttttgccatgttggccaggctggtctcaaactcccgaccttaggtaatctgaccctctcggcctccccaagtgctgggattacaggcgtaagccaccatgcctagcctattggtagcttaaagttttattttaaatttttaaatagagatgggatctcactatgttggtcaggctggtctcaaattcctggtctcaagtgatcctcctgcctcggcctcccaaagtgctgggattacaagcgtgagccaccgtatccagcctggtattatggtagttttaaatgtttgccatcagctcttctgcattcttaggcagatgaactaaaggaggacatacacttacatctgtttctaaacttgttttcccttcttatcctcaagtttagtagatatatggatgtctcctgccacatatttcccacagtatcttgaaatggtgatgcatcttgctgattttgtttaaaaggttttctttattttgagacagagtcttgctctgttgcccaggttggagtgcagtggcatggtctcggctcactgcaacctccgcttcctaggttcaagtaattctcctgcctcagcctcccgagtagctgggattacaggtgcctgccaccacgcctggctaattttttgtgtttatagtagagatggggtttcaccatgttggccaggctggtctcgaactcctgaccttgtgatctgtctgcctcggcctcccaaagtgctgggattagaggtgtgagccaccacacctggcctaaaagtatttttaactagaaaatatttcaaaaatcacaaaaattaaatagtgcattacagacaggtggttcagtttagaatgtatgtttcccttctgtctttcacatgagcaacattttataatttctaatagcatttattttatttttaaaaatttaaattttgcctgttacacagccctcaggaggtcctgagaacatgtgcctctcaaatagcattttaaaatctatgtgttgcttgacttgcagcaaagattaatgccattctgattttctactaatttatttctattaaaaatagtgatattatacatgacatcgctaatatcaactgggtttcctatactatagtaatgtgagtcaggatttttctttattttggactatctgtttagaagtctatgtttgggtccagttatctttttctactgataaaagtaatgataggtagtgctgtcctgtgcagccccttcagacctgaaggatgtatttccccagcaggtgggaattgccgccgctgaagatagctgcctttcctgaggtcatgcctccttcctggaatctatgcaggggtgtataggcccctttgcatcaacttgggctaacgctgtaggtcagcccagcttcagctctccagggcatggacagaagccttcattctgactacattgcatcccagcttctctctctgcccatttagcttcatttcctgcctcactcccccatgaatgttgaactcaacggcactctccagtaaactttctgcacacagatctccatctcagagtttatttcttggggaacctgacctataacactaggtatatatatattatgtgtgactgaaatgtgggtcaagtggcatggagactgtgtttatacttattttcctattcacagggcatgccaggttcatgcaattttagtggacaattaaaaattactttacaaagtatctcttgctttagtagcatttactagttgatgtgcacctggtggcagtttcaaaatgttttcttccatttagtaattatctgttgccagatactgctccacatgcagggacacagcagtgtgaacagagagacaaagtccctgtcctcatggagcatagtttctagtgggggtaaacgaaaaatagttagtagataaataaataaataaatatgatttcaactaataacaaattccaagaaggtaataaaatagggtaacgggatagagagtgactggagggctttatcaggggtagtcctggaggacctccaggaggatgtgacatttgagctgagacaaaaatgatgaagagcagatggtttactattaggttgctgcaaaagtaatcacggtttttgccattagttttgcagcaacctaatagtttgtaagatggcttgtttcaattagataattttgggtgcattataaatcttaagggggccaatggctagatacatgatacagccatatattcaggtagagggataattgatcatatgtctagtcagatctgtaaattttttttcagtatacatattctgtatacattttataaaaactacgtttgacttagaagacagttttggtgctcttgaagacttgaccctggcggggaggatttgaggggctctgttgttcaaaaggagagcagagcgcctcacttggaagctactgtaggagggtagagggctgtgtctgtgtccaaagggtgaggtttgtgcagtctgtgccacatgtataaaataggactgaagaggtgtgagtgctgtgttgcatttgttaatgctgcctgtgttttgcttttgcataacaggttgaaatagaaaagaagtggattaaaatcgatggagaagacccagataaaattggtgactgcataactcagtaggagtagcaagagtttatgatgacagcccacttgtcaaatatgtaattcaccgaaaccacaccaagtcctgctactgtagagtggaaatgacttctgaatagcggttttaggacaggtctgatggctgtgtttagagaagtttagacctaaaaccgaacaatctgtattttttgcttttcatgtgtttttgtcctaggggttcgatctaaaatgtttctataattcgtgtgatgttttgcttcctattgaaactcaaaggcactgttactcgttgtgtgaccccgcagccagtatgatttttgattactcagtggctgactgttttgctctctggattactgaggtgccgtcttcatttcttcccatctcttcttgctgcttagtgtctgtactagagggtaagggaatcaaaggagacataaaccaaaatagttaattttccctctttcttgcctctgaaatgtggctaggtgtagaatgatgttgaaaccacaggctaaaatgtagatctggaagtatctgtgcttttgaattacttatttacctgtcctcttaccgttggtaaataataattggctatatttggtacctgtctctctcctactgtattgtcattttcaaaatgtgtttgttttctggcgcgtgctgcaaagaagctatttctgttgtcctacatattttagtataaatcactaagacatatttcctttcacttggcaggattcctttcaaaatggaatctgagtattagacactagttaacatatttgtgtatattaaatatgaatttttaaaatttataaatactattttccaaaagtacagactctaaggacatattttgataaagtattatttgtaatgaacacaagcctctcttgagtagaagtctaaatcacattatgattattttatactagttctgctatcatgctgttttatgctaattctgcttattttagagtatttttcattaaaaggtgagcaaagtgaaagatacttggtattttacccagatttctaagtggcaacatttttattcttcagagtcaggtaaatgactataatagtttggtttctaatgaaaagtcaatagcattagcagttataattctgtttataatttcctttcagcatttacagtgaaaagtgagaattttaaaatttatgaaatctatattccaggtattgtttttagtctgaaaaacaaactcccccatgtggtattaatataccttcaatttatgttgagtcttaaacataattaggagatatttttctctatttgctagatttgttttgagtcaaaactgatttagtgttcttccaaacaacatttatgtgttggcctacagagtttatttcatgtgttttttttaatatttaatattatattacattcattgaaatctgttcaaaaacagattaagacaaacatttatgatggtctgtatcaatcagcagattttattgcttttcattattttactgtaaaggcaaagaatgcaataggtgatggttggttgaaaggaattgttattgctgtttttattttttactttttttgagacagagtctcactctgttgcccagcctggagtgcagtgtgtcatcttggctcactgcaacctccgcctcctgggttcaagggattctcctgcctcagcctccaactagctgggattacaggcacaagccaccatgcctggctaaaattcttttgtatttttactacagacggagtttccccatgttggccgggctagtctcgaactcctgacctcaggtgatccaccagcctcggcctcccaaagttctgggattaaatgcgtgagccaccatgcccggccgctattgctctttttaacttcatttgatgccttgcttataatatcatatgcttgaggctcactgttgatgtagagtagggcaaatctgtgtgtgtatgtcattaaaaaaattctaccatctttctttatcatctggtgtgggcgcactctacagtgacttcagtctgctcagaacgaatgtggaggccggccgaaactgatgctgcccacagtcccagtgaagttaggtgggttaattactgccattcctttctaagtgtgttttatggcatcctgcccacaaagaactcacagtctgattaggatgaacttaatgactatttacacctcaaaatatattcagcaaagggttcacttagttgcccctcatgcttcacaggttgactagtatctgtgggtacctccctgcccaggttattcactcacaagccaccgggccttcaggacatctcaagattcagtcttgacaatataatagcaaaagctggactaaagcccaaatggattgtctgtggcaatgcagaagctgatagcattaacagcagggtgttacagcataattgttaattcgcacatctattaggatccttaaatattcattacttaatgttaaattaacattctgtgtagggaggggaggcttattcaattcttctgacctcagaactggcagaaggtcagatgtgactacagaactctaggtgaaaaatcaggtagggttcaaattaagtagaactgcccttgccggaatagtgatcttcaaaaaacccttgcttttaggggagggaagcggggaaggaaaggaatgagggaggaaatattcctttctagcattcattttgcttagatcactccattgtgagtttgaccattttggagtcaaatgagcagacttccaaggagttgaccagtttgtgactagtctggtcacctttccagttacaggatcatattaactgtgtaaatgaattcatgggtagatgatttgtgcagatctgaatttaagaacatttcctttttctgtgggaatcacaagagtttatccactaaaaaaagatatgtaaaaaagatactttccagcacataaataaaggctggaattttacaacctgatgtatatattagacagttctaggatgttagttcccttcattccagagctatgcttgtgatacagccccttttcttataaagtcagttagaaggacttccttaacaatgactattataatgtcttacttaaaatacagttttgtattctgtcaatgcaaatataagacaggttgagccttaatcatgtaacaaaatattttgtagattacatattgatttttcaaaaattaaaaatgtatttcaaactattcttactgtgctgtgaatttatatcttcttctgcaagacctggggctatttttttttcttaaggtatgaaatcaatttcaataaccttaaacaattgaccctctgtcaggcatatgtcaggctccactcttaaggagtcagtgaccatgacctctttgcatatcctggaaaaatgacatcatcaaagtatagttgataatgttataaaggatgattttaaaaatagggtataatcatgactcacaaagatatgaggctgggtgtggtggctcacgcctgtaatcccagctctttgggaggctgaagcgggtggatcatgaggtcagaagatcaagaccatactggctaacacggtgaaaccccgtctctactaaaaatacaaaaaaaaaaaaaaaaaaaaaaaaaaaattagttgggcgtggtggcgggcgcctatagtcccagctactggggaggctgaggcaggagaatggtgtgaacccgggaggcggagcttgcagtgagcagagattgcgccactgcactccagtctgggcaacagagtgagactccatctcaaaaaaaaaaaaaaaaaaaaaaaaagaaatatatgaaatgaatacatgcataagattaccactattcaaagcctttcacaatttttccttgaaaacaggaaaaactttgtccacagaattccatggaattttcaacctttggcaacttgtagagtagtcctgtagaattaatgtgcacctaaaagccacatttttaaagtttagaaaaccagttttacaaaattgcacagaatatatatcaggtaagatatacgtgtgggtggtagggagttgggggagagtggaggagagttgtgcgggagtggagggaggctgtaggagatatgaagggaatcagtgcttataaaggacgaacctaacaacctctccaccctcctttttataagaaatctgccttgtgttgaaattaaatttttattgagctactaaagttaatatttcaaaaaggcatcagtacttcatagaagacagagcatgaagcaccattttagccactgctagcactcacaaggcttggccctagttcttcaggaacagcaaaaggattgactggcaaaaactgaccatatttgtaacaacagtcctcaaaatcccatcaatcaattcttccctgttttgtctcaactctggctagactgtcccaccgcttttgtgtagacacagggtagattttgatgttgtctctcctagaccctccccatcctctgcaactactgtattccaaggaacttatacccttagccagggccctaaaacacagggttatgtgtattctgttgaatcatatgtaatcgccaatatttacctttcttgatgggaatttcacgggctcaatctaattatccacatatttccctaggtcatatgatacaagcactttttgttatcctgcttagaaatggcaatgaaatatgaatttgactaatttttaaagcaagacagagttgctagtcaagaagcaaatagttgaattacaaaaatccatagatacaagctacagataatattgtgcctttaaaatcatctgtaaggaatgtaatcattttcctctgtaaggaaaaggaaaactgattagattaattgccccaagttttaaaatatttcagttcatttccgtgagacttcctggggaagaaaggcacagcatcattagactctgggttttgctgcttacccttcatgtatctgcactcgcacagccttccaaacttcagagggaagagtggcttctttaaataatatgactgtgcgtgttgacattttcctgagaagtcccttttgtagaatccagaattgtgaactccatgaaatgtaatttgcagtacattctttaaacagaagagggtgctctcgggcaagctgatgctacccagctctagaaatataagcatttaaatttggtggtgcttgtattatgattagtgcaagatcttgggggcatttaataaagcatttcaaagcattgtgagtccagtggagtataattaaaattaatgcaatagacaaacacattaaagtattcttaatgcctagtctaaaaatgctgtcaaatacagttttacacatccgaaagatttaaatactatgcttgtctctgaacatttctaactgttacagagaaagaaaaacagtgtcttccttctccacaggtttcaaacaaaatttttctaatgagagttaataaaatcttctttctttaaaagatttataagatattataattaattcatcctgctttggcatgtgtcaaggtcaatgtggtctctaaaaatctccagtccaggattgtactttcagcttcttaggtaagaacaagcaaagatatatgctttcaggagaatatttcatgctgccttgactcagggacaagccttggttctgtttcagtcctcagaaaggagtaatgaatattgttcttttcaagatgggctctgtatttctctcagaaatctccctgggtggatgttgttgttttttgtaaagccagttaggacactctctttccaaaagtcttatatcatgagtagtctatgagtgtagctgtacgcacgcagcattcccaaagccttctgaagtacagaaggcttcctaaagacattggctgccagtttggcactctgagtcacctcaaaatgctatgtgaccttcgttccaaataatcatcttgctgatcattctaattttcttaagtgcttactatatgtctgcatttttctaggtactagggacaagtaattacaaaaacagttaattcctgctgttatagagagcatataatagtgggggaagtcaggcaataaatatcaagttgtgattattgctatgcagaaaaataaagcagggtaaaacaataaagagtggtagaagcgtgccattttagataggttggtaagggacgttctctttgatgagatgacattctagcagcgagacctgaaagaaatgaggtagagtgccactcagatccccagggaagagtgtgtccagcagagggctctgctagtgcataggtgcgggactcggggtgctaacccgtcagaggaacatcacagaggacagatggctgctggatggccatatcggagtgagcaagggggtgggatggaggtggaaagagatcagagagattgtggggaggtgggggaggcagaccacctagggttttgtgggccatggattttactctgagtgagatgggagcccctggaaggctttgtgtagaggaggggtagaactttgttacatgttaagatgatcgtgtggacataaaaaggaggtagaggcagaagcaaagaaagtagttaagagtctattgcagtatctcaggtgtcttagtcctttcttgctgctatacctgagactgagggatagcagaaatttctcacaacacaaatttctcacaatcttggaggctgggaggtccaagatcaaggtgccaatagattcagtgtctggtgagtgcctgtctgtttcttatagtaggcacgttcttgccgtgtcctcacatggcaggaggggcaaaagggctccctgaaccctcttttataagggcactaatcctgttcataaggacagagccttcatacctaattacctcccaaaggccccacctttcactaccatcatcttgggggttaggtttcaatatatgaattttgcgtgggacacaaacattcagatgatagcatcaggtgagaggtgacggtgattgagagtggtgacaggagatgaaaaatggttgaattcagaacatatttgaaatatggagccaatagtatatgccgatggattagatgtggcgcgtgagggaaagaagggaaccaaaacaactgccagatttttggcctgagcaacgaaagagtggagttgattttatggacgaggggaagggtgttgtaggagcaggttttggggagaaagatcaggaattcatgtttggatgtgttaactttgagatgcctattagacgtctaatggagacagcaagtagcaattgaatgtacaaggcaggaaagagggctgggataaagatgcgcctcttagagatatcagcgctttcagccatgggactaactgggatcacctgggagtaaatatacactaggagtgggctgagaattgagcccttgggctccctggagtttagaggtcaggaaaatgagggcaatgtcataaaggacactgaggaagagtagctggagtagaagaaaaaagagaatggcattcattccaggggtcaagtgaaaaaggatgtaatgagtttcctcaaatgctgctgctagagtaagatgaggactgagagttgactactgaatctagcaacatggaaatggtgaccttgacagaaacagtgtcactgaagtgagagcaatggaagcaaactcaagcaggtttggactcagggagtaaatggctttgtaggggaagcaaaatttccttctaccctcttcagttctgttgttggtccaagaattaaactgacataagacagattaacaggagaaaagcataccaattttattaatatttttacacggacgtggcagtcttcaaaagggaaatgaagaccctaggaagacagtaggccgtgaagcttatatacattttcacgcaaagaacaataaattatggggatgtgacaagacaaaggggcttgggcttggggcattaaattgtaggacagtgcctaggaaatacatgggggaaattaacgaaagacagggtcgttttggtagtttgttgtggaagtccatttcggcatcaactcctagtctctggtgataagaatgttctcttcctagtacagggaaggcacctttttcatggaaaattttatgatctgtttttaggtagaaatgaggaggtcagagagcctatgttagtttgttttgcatcgctgtaaaggaatacctgagactcagtaatttataaagaaaagaggtttaattggctcacagtttggcaagctgctcaagcatggaaccagcatttgcttggcttctggcgaggcctcaggaagtttttactcatggcagaaggtgaagcgggagcaggcatgtcacatggtgagaaagaagcaggagcgagaggaggagcttccaggctcagctctgcatgaatgaacagagtgagaactcactcattatcgcagggacagcatgaagacattcatgagggatctgcccccatgacccaaacacctcccactaggctcatctctaacactggaggtcacaatgcaacataaaatttggaggggaaacacatccataccatatcagagcccttctgcatgagctgtttctcaagtgccttcagattaaaataatcaatatgccaaaacagcatattttgggatggcacgaatcccttcagccccctttttttttgggaatagagtcttgctcttgttgcccaggctggagtgcagtggtgccatctcagttcactgcaacctccacctcccaggttcaagtgattcttgtgcctcagcttctcaagtagctgggattacaggtgtgtgccaccactcccggctaatttttgtatttttagtagagacaggggttcaccatattggccaggctggtctcaaaactcttgacctcaggcgatccacccacctctgcctcccaaagtgctgggattacaggcatgagccagtacacctgttccccttcagctcttttgaggagttttgctgtcaatatgaacactggaacagtggctggggaggatgagatctcaatacttccctgacatcccttaagactcaagtcttgatactttgtctgctctctggctctttctttgtcattactattatttttatcttcttgatgttgactcttgctaaaattttttgtcttccttattgttaatgcttatagaaaatgattccttgttatcttttagcccatgtcatccgaatcatttgctgtttctagcctaggtgctttgactatgccagcttgtatttcttcagaattttcattaactatatgtgtggtattgtaggcattacatattttaaaataaatttagccattgcttcaatcacatcctgctttgttttaaaatttttcttggttgaatttcactgggtcaatgtcatttcatattaggatggtaatcccacttcaaattttcttatcaaattcagaataattataaaccagttgctggtttcataatcttaagaatgccaacaaagttcctgcaggataaaaaaagcacacctatttattcatagtttttatatctacctaatagtttgaacttcgattctttattatagatgatacactaatattctatgtaaataattgtccagtaattaataagtgaattttaataaaattaaagtatctgtgaaaggtacaatttaggcaactgtgaaatcatactattagtgggatattttattgttttgattcattatttattttaaagctgttttgtatggttcaaataaggaggtgatcaaaatattatttcacgactcacatggcttattgtcacacacagggaattttttccatgatgtttaaagagggaaagaatcacaagaacaaatctcatagggaatacacttgatagatgaagtacattaaccatgtaatgaatgagttccaaaattactaaagcctagttgctcaattaggatgaatgcaggctctatggaaagtgaaagctagttgaagtgtcaggtatgagtgtaagagaggattttgggagagatagcttgatcagcacaacagagatccatgcagacacaggaggtccctccatgcaagagtgtgggtgttgctgctgagtcttcggagatgaccccaaaggctaacaggatgtagtcctgccatacctggagctcacgatctttggagaagcaactcaacagagtgcagtcatgccatggcctaatctctcaaagtgtctgccaaactattagatttgtaggtaagtcatgcattacttaccaatgggaaaatgtacaaaatgagaaatgtgttgttaggagacttcgttgttgtgcaagcatcatagaatttactgacacaaacctagatagtatagcccactacacacctaagctatatagtatggtctattgctcctaggctacaaacatgtttttggtaacagcatgctactatactgaatactgtaggcagtagtaatacaatggttttgtgtatcgaaacatatctaaacaaagaaaagatacagtaaaactatggtattataatctcatgggactaccattttataagccgtccctcattgacagaaacattgttatgaagcacaccactgtattttggagtccagtagttgaagtcagtagttcacatatggggtttgataaggtgtgatgtaacattctcggaggaagtgggagtacatcgcaagttcttatcatagtaaaacatatgtcactcatagcaaactatacatgtgttaggaataatttcaaagctgtgcaacaaaaacagttcacaattaaaatagaagaataaacttcaatttaaaaatattattactcaaaaatagtaaatatttaatgtataaagtaatgaaacaaaacttactaaacaaaaatattacatcttgcaattcacactccattttagtcttttaaatttaaagatacaaataaaaactccaaatggtcacatagaatgacagaattgaagtaacctaagtttggctgggcacagtggctcacgcctgtaatcccaacactttgggaggctgaggcagatggatcacctgaggttgggagttcaataccagcttggccaacatggtgaaaccctgtctctactaaaaatacaaaaattaactgtccatggtggtgggcatccataatcccagatacttgggagggtgaggcatgagaatcacttgaacccaggaggcggaggttgcagtgagcagagattgtgccactgcactccagcctgggaaatagagtgagactctgtctcaaacaaacaaacaaacaaacaaaaaaattggccaggcacggtggctcacgcctgtaatcccagcactttgggaggccaaggcgggcggatcagttgaggccaggagtttgagaccagcctggccaacatggtgaagccctgtctctactaaaaagaaccaagaacaacaacaaaaaaaactagccagacgtggtggcagggtcctgtaatcccagctactcaggaggctgaggtaggagaactgcttgaaccggggaggtggaggttgcagtgagccaagatcgcaccactgcattccagcctgggcgacagagcaagactccatccaaaaaaaaacaaaaacaagaagtaacctaaattctatttcttcatctttacaatcacagtttattttaaatctattgtttaaatccaagaatacatggtaccaaaggaatagagacacaaattgcacctggaccattatgaatcccgagacgaatatgggtatcagtccacatgtgtcagaggtccaagtgtataactgggagttctccaaattaacttctatgtaggatacaatgtttattatacgctaagaaactaaaaaaaaatgctgatttgaatctttcatttgcattattaaaactcaacaattattatacttattgtttagaatgcgtgccaatattaaataaaaaattggtggggaggggagatagagtatttaattgtggacattcttttgccagaattgccagaacatggtgataatcaaaagctgactgactttctgttgtttcatcattgtgtttaaattatcagtaaacaatgcttctcattattgcctgtgcccaggactgcccacttccccatacttggtacaccactggattggcagtgatccactgttgaaaggaattggcaatgatccactggtgaaaggaaaattaatgatgcagcagggtgcagtggctcatgcctatagtcccagcactttgggaggctgaggcaggtggatcatctgaggtcaggagttcaagaccagcctggccaacatgtcaaacccgatctattctaaaagtacaaaaattagccaggtgtggcagtgcatgcctgtagtcccagatactctggtggctgaggcaggagaatcgcttgaacccgggaggcggaggttgcagtgagtcaggatcgtgtcactgcattccagcctgagtgacagcgtgggtggggaggggggaggaaaagaaaagaaaattaacgatgcaaaggagagagagagagacaattgctaaggccatatctctgagcagatgagaggggaaaggacccaaggcgccagcagaggggctgacagataaaagcacaaacagttcatccacggcaatgaggcaagacagagtctatgggtacggatgaatgcaggcctgtcatctaaggtgttctttcttagtttctttcccagaagtggaacaggggattcagagacttttcaccatcccagagatggaggatcctgtttctttaaggactctttattaccgattttaattttctttttttccccctgggtttttttgtttgtttgtttctgtttttgttttttttttgagagagaatctcactctgccacccaggctggagggcagtggtgtgatttcagctcactgcagcctctgcctcctcggttcaagtgattctcctgcctcagcctcccgattagctgggactacaggtgtccgccaccatttctggcctatttttatattttcagtagagacagggtttcactatattggccaggctggtctcaaactcttgacatcaagtgatctgcccacctcggcctcccaaagtgctgggattacaggcgtgagccactgtactcagcccaattttattttcttgaaaagtttgatcacttcctttaatatgtgttctttaaccgtattttttttttcatggtagaggttgccgtggatgtcactggtattaatgcttcaatatcagctatactgactcaaaagaggacattattgtgattttagaactgagatgatcaattccctctaacagggaataaatggttaaggcagctctgatttgggaaatacatttgtgagcactctagagttcagtttctttttctgcttttcatctctgagagagacgctacagagctgtgagtggccgggtgggggtgggagaggccgcccgggagcagtgcttgtccttttctgtagagttttattttgatattttcacactgctcagagagaattccatccaaaggtcctcaagtgccatgaaaaggacaaggaaagagcatctttgaacagtggcattgttaaatgccaagagcctgcctctccagtggataattttgagatattctgaaacacttttcaaaggctttgccaagtactcattgtggaaaaggacacattctatattaaactctcactgggatcagagatggccttgggtaagactgtgacctagacgatgtttgtagccctctttttcttgcctcttcctccatcagtgatgctccagtcccttcccccacacctcctcaaggcttttagggtctccctgcctccttctttttgtcttatatgattgagtgccacggaagggtagatgtcagtaacttagatcttggtgttcttctgctgcaggcttttccagtggagctacttattcctccaaaccccacagacctttaactgcttctctaccttcagtgtggctgtcctccatcctccagtccaccctttgtgctgcagtcaggaagggacacattatcttgcatttgcttaccagtgagccttagctttcaccacagcttgccttattctctaccctctagccaaaccaaacaaactgctctgttttcctcaaacccatcatgttctcaaaccctgcatgttctcaagccccaagttttggctgatacagtaccctctccctggaatattcttccttgcccccttcctctgtctcctactcattccacagacctcagtttaggggaccaattctaagaagccttccctggccctccccattcaggttaggtgaacctcacaggtattttttttggtactaatcctgttatattgtaattacttgcatctttttctttttgcccaccctctttgggattttgactggggtggctctgcccagttatttctctttttctgggaagagaaccatctgcaggggtggtggtaggtgatggtaggagcaatgccagtgatatggggctaatcccctggccagagattacgacctatgtgttcaataagaaacactacatgaatgaatgatcggataaatttagatcaatgcactacttttctccctatgatagttgcattttaatccgtaattttctcccacatataggctagaaattccattttataagagcttaagaataaattcatatcaataacttttaatgagtgtttttcatatttgaggtactatgctaggaactcaaggggcatataagaatgaataatacacagcctaagccctcaagaaatttaaaaatctattacacttatggttgcaaatgtcctttaaaaaataaacacatacacatatccaaggggttgaaaaatattaaaatatttgttttaaaatttgatttaatcttgtttttgaaagctggtaaaagtggagaggaagcacccttagctttttagcacctgttgtttgtctgggactgtgttttctcatttaatagccagcaacttatgaaggaagtgttacttttctctctctctttttaaatttttttttgagacttaaaaaatttttttttgagtcttcctctctctcccaggctggagtgcagtggcctgatctcggctcactgcaaccttcccctcccaggttcaagtgattctcatgtctcagcctcccaagtagctgggattacaggtatgcaccaccatgtctggctaattttttgaatttttagtagagaaagagtttcactatgttggtcaggttcgaactcctggactcaagcaattcacccacctcggcctcccaaagtgctgggataacaggcgtgagccaccgtgcacggccaaggggtgttgtttctcatcatgaaatgaaaacatctctcttgttaaaggtatcttggaacgcttgtgtggctgtagatggctttttttcttgtacttgaaacaatatcccgtgcttaatttccttgacctgtccatgtaacaataagatgtaacttcaaatgaaaaacattcacataaagaatcattcactagctcatcccatgtaaacacatataagcaaacactgacgttgccactttcaaagccaaaagaaaatgcaatcacaagtagggatgatagtggtaggaaaggggccacagtggttttctgtggtgtttggatagaatacagtggttattgtctaaaagttttctgtcttgatgaccctttcttggtcctttggctagaaaaagcaagcttttttatgtttcctctctgaccattggtatttctgggttgccagcttctccagcacccaatctaggatatgggaggcaaaaagaaaatcagagaactcactgctatgtggctgttgggattgcgaggtccataattggcctgccatattctcctcacttttcagagtcttcttatgtttgtttagatatataacattttagctgttcatagcagaatgaataggaagaagtgtgtttattttatgttgtccctgcctctccgaatatttgaagcatctaagacaacagaatagaacagtcaagatgctgccacttacctcttataaaatgagacaaattaggaaaaaagaaaagcacagttatcgagggaacaaagctggttggttttctgcaggtcatagccttaagttcaaattatttgtctttatctccaccttgtctaggttggagaattaactggagacaataaacattattgttgctaatattttatgtacatgtatgattatatgcattacgattaaagaaatgaaagtataaccatttgttaggtaggaaattactgaatccttatcaagaccttgatgagaatgttgaaaaagtagtgatgaggaaaattgtgtttgaagtcatcccacatactttttatgagttaattataattagtaatacgtgcacgatatatacatctcttgaatattaaaatattttgaagtaggcagtcatatactcattaacagtgttccattgcattgtgtcacatggtcactttaactgaaatcttgttggagtgggaggaggaattcatcatggtggaatagaatcagatgttcaaataaagcaagttgattttggagctgtattagaaaattgaaaatgttacaaaagtgcagagtataaaataaatcagaactgccaacactgtaaccatttcaaagttacagggtgaggcagagattatctggattttcatttcctgtaagatgtaaaggatgaaacagggtcagagaaacaccctgggtttagtgcattggttgcaaaatgttcagaagttaattatgaatatttgctgcctttagtcatatgctcaaataccaacttgtattttaatcaccaataaataattagagtctatacaattattgaaatactttgtatttgactggaaagtttaatacgtaaaaaataatgggctgcctctaaaatatttttctttcctttttttcttttttgggacagagtctcactttgtcgcccaggctggagtgcagtggcatgatcttggctcattgcacctctgcctcccaggttcaagcaattctcctgcctcagcctcctgagtagctgggattacaggcatgcaccaccacacctggctaatttttttatttttagtagagacggtttcactatgttggtaggctggtcttgaattcctgacctcaggtgatctgcccgcctcggcctcccaaagtgctgggattacaggggtgagccactgctcccggcctttctttacatttttatccaacaaaaggacttcacaaatatggcctttgctcacaataagcaaagtgaaattatttctttactttcagaagagtatcactaacacctccaggcaaaagtagtgaggacacatggggaagaaaattaatctgattattaagatttgcttaaatgttgcaaaaactggtattgattatcagtaataaacatatatattatatattatggtctctaaacaaagtaggagaaaaatgaaaatctgatgctccaaattgtgttggccagttaagggggagctttatgctttggcagaggtgtaattcaaaggaataggtacttaaagaaggactaagttttggcatttcttttttattcattatttactaacaaaaaatagccactgtaaaattgcctcactgaggctgtaggatcttgaaatttcaattttaccatcaaaagtaccttgtaggctggatgtagtgactcatgctcataatgccagcacattgggaggctgaggtatgaggattgcttgaggccagcagttcgaggctgcagtgagctatgatcataccactgcactccagcctgggtgatagacctagaccctgtctctctctctaaaaaaagtggattgtttatgcaacatacttcctctctgagtttaaaaaattgacaaaagaaatgtaaccatcatgactatactattctgcatatttcatgataatttgataagctatcaaacgtaagtgttaaaagattcttttacatacttttcaaatgctcttgtgactggtgaggtcactcaagacacttgagattacaatgagggacagtccaatcagagaatgggtgctggtttagttatttcacactgtgtaacaaattatccaaaatgtaactgcaaataaaattacagatattcatgatctcatatagcttctgaggatcaggaatctaggagatgcttagagcgtagatttggttcaagataactcaaagatatgtagtaaagcttgtcagggctgcaatcatctgatagttcaactggggaaggatctatttccgaacttacttatgtgactgtttgagggtttctcatacttgctgactgtgggctggagtctcagttccttgccaaatagacccctccataagctacctgagtatcctcatgacatgacagctggcttcctccaaaatgagagagtgagcccaagaaagaatccacagctatgaataaccttatctcaaaggtgatatgctactacttcttcttttttttttttattttaatttaatttttttttttattgatcattcttgggtgtttctcacagagggggatttggcagggtcataggacactagtggagggaaggtcagcagacaaacaagtgaacaaaggtctctgttttcctaggcagagtgtttgtgtccctgggtacttgagattagggagtggtgatgactcttaatgagcatgctgccttcaagcatctgtttaacaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacttctttctacacagacacggcaaccattcgatttctcaatcttttccccaccttgcccccttttctattccagaaaactgccatcgtcatcatggcccattctcaatgagctgttgggtacacctcccagacggggtggtggccgggcagaggggctcctcacttcccagtaggggtggccgggcagaggcgcccctcagctcccggactgggtggctggccaggcggggggctgacccccccacctccctcccggacggggcggctggctgggcagaggggctcctggctgggcagaggggctcctcacttcccagtaggggcggccgggcagaggcgcccctcacctcccggacggggcggctggccgggcggggggctgagccccccacctccctcccggacggggcggctgctgggcggagacgctcctcacttcccagacggggcggttgccaggcggaggggctcctcacttctcagacggggcggttgccaggcggagggtctcctcacttctcagacggggcggcctggcagagacgctcctcacctcccagacggggtcgcggccgggccgaggccctcctcacatcccagacggggcggcggggcagaggcgctccccacatctcagacgatgggctgctgggcagagacgctcctcacttcctagatgggatgggggcccggacgaggtgctcctcacttcccaggtgggatggcggccgggcagagacgctcctcactttccagactgggcagccaggcagagacgctcctcacttcccagaggatgggcagcccggcagagacgctcctcacttcccagacggggtggcggccgggcagaggctgcaatctccgcactttgggaggccaaggcaggcggctgggaggtggaggccgtagcgagccgagatcacgccactgcactccagcctgggcaccattgagcactgaatgaatgagactccgtctgcaatcccggcacctcgggaggccgaggctggcggatcactggcggctaggaggtggagaccagtccggccaacacagcgaaaccccgtccccaccaaaaaaacacgaaaaccagtcaggcgtggcggcgcgcgcctgcaatcgcaggcactcggcaggctgaggcaggagaatcaggcagggaggctgcagcgagccgagatggcagcagtacagtccagctttggcccggcatgagagggagaccgtggaaaggagagggagagggagacgggagagggagagggagacgggagagggagagggagacgggagagggagagggagacgggagagggagagggagacctacttcttctttattttagtggtaaaataaacctaccatggtacaaggtaggaggggacaacaccaagtggtcaataccaggaggcagggatcactgggggccatcttgaaaactggctaccacaggtccacgtggcagatttgcaacttggatttacctagaacttgtgttaaagcatacctcctctagtagtcattgcctgttattgggaagaaatgactagtgaccattcagacaaactgcaaggggcaaatgaaatttgctgacatttctctgctaacattacatagcctctccataacttgagtatactgactgtactaagaaataacaattcaacttttagttacactttttatgggtaccaagatccaagaataatttaaaaaatatacatgatctacgtatagttctgagaagggcagaatgtgtaataaagtaaaacagtatgctgtcacagaaagttaggtgattaccaatcctaagcatttagaaataaagctttaaaaccttcctatgaaaaagatggaaaacaagagacacttttagctttcttatttcccagcttgaataatttaattggattttataatatcagtaggaatcaatgactgcttttagctttcctactttgggtgaaagataagtcactttgaacactcctggtagtaaattgccaggtggagagatatgaccattaaaatgaccatatatagttcttggctttttgtaaaagaaatttctaatagttttcaatgtaggaaagttttctaaagggtatcatataaatcagctacttgaaactcacaaaccataaggtacctgacccaggcaaatcacatacacagtggtaggggataaacagctctactgcacttacttgcacaaataaataaataaacagccaattttaaatataatagagtttttaatcatcaaataacgtatccatctggttaggtcaagacctatttgcaggatagaaaggctgtttagaagagttgtggccaagtgcggcgagtcatgcctatagttccagcactttgggaggctgcggctggtggatcacttgagaccaagagtttgagaccagcctgggcaacatggcgaaaacctgtctctacaaaacacacacacacactcacacacacaaaatagctgggcgtggtggcacacacacctgtagtctcagctccttgggaggctgaagtcagtgggttgcttgagcccaggaggtagacgctgcagcgagctgtgatcatgccactgcactgcagcctgggcaacagtgtgagaccctgccaaaaaggcagagttgtggcaacagatggtgacttcttcccttttctaatcctccaggttatctgtgcttacatcttccctcagtcttagctaggtaacgtatgccccaagatgctctgcccttcaggagagagaattattgtaggtagacagctggtgatttctgcctaactaagaaaaggagataggaacgtattagctgctgactttcttttagcagtggttttccaccttggctgcatattagaatcagattttgccgagtgggatccaggcactaaacttttttttaaagctccccgcgtgattttaatgtgcacccaaaattgagactctttgtcttaggtcagggggtctcatgtcagcgcccattggaatcacctggagagcatgttaaagttacagaatgctaggctccatcctccagtctgattcaggagggctggggtgggacccatcatttgcatatttaacaagttcccagatgctgctgatgctgctgtaccacgctgacaagtcttagaaaaatttggctcttgttatatttttatacaacaaaaaatggagttcagctgtgagtggggtgtagggggaggaatgaaaattggtaaatgcagaggacagatatcactagtctcccctcttttctttccccatcttcttcaaagctgaagttagactgagatctacccctgcatttcccctcctcgattttcatctttcacggattgaggaaacaacctgtgaacggcccaaagccggctagacccaacctaaccatccgttttagcgggtctcttttctcacacaggccgaccgcctctccgccttgacccccacctccactcaaacccgctccatctattaacgttctcttctgcccagccacgcccccggcgttctccgtggttgcgcacctgacgtacatcgttcaaaacgtgcccagtgtttccctccgagggcactgcgtgccgcgcaggcgcaaagggccaggtgctggaggtgctgtcatggcctgcctcaacccggtggtaaggaagacctcaggctctgtgtagagggagcgccctgggactccgggttcacggcagccgaaccctgcaccttttgtttccccctgacactttacagattgtcataaaccctctctcttccttaggggctggggctcttcttcacgtctgtgttggaggaagctgctgagggccagtagttcagcaggaagttgggccagccccgccaaaagaacaagtgccctttttctctttttacccaaactgaggctatctagttggggtgtttagaggtggaactgatcctcaaccctgctggtttcctagatactagaaaacctccaagttcggttgtgttaattttaccgtggacattgttaattccaagctgtattatttactgcttgaaataacaatgtgatatctcatgttacctccccacatgtttttagtgtctttcactacccgcccatttcgttgtcctttaacaacttaatgcttaagtgtacaacctacattaccctcctacctctaacggacacttaatttgcacagtgagaatttctagtctcagtggcacttaggagaccatcaatcttaaaaacctgaatcaaagaacaaaaatcaaggattcatctttattaccaattcatctcaacagacttcacatttcgtgaaaggcaatgtgcctgtccagatctgtgtaattttatgggttccgggtattatatatgcagtataacagctccatttttagagacatgctactttaattatatgtgttttatgatagtgcgttttaagatacataaaatacctatactctgcctgaatataaggttactatgtatgccaatttatctgattgtgaattctatgaaggagtgtctgtattttaaatagaggagttaagatggactagacatagttttaataacagggatgcaatacaaagtctgtggtcatagaagagaaaatatgttcaatacctattttgatttctgaaaaactgtgttctaatgggtactttttgactactgctgtgttaagattttttagacctaagagttttttccttcggtgttaagcgtgatcacactagctgggactaccactgaagcatcaatttagtatgcctttatcaggataaactgttttagaagaagcacctaatttaggggcatttagtcttaatgcatgtgcttgtgaataacattatttaaatgttactgattggcctattcgtataggtttaccctgggtctttagaaggattaaagcatagctttaaatactaaatactcttaggggctgggcacggtggcttacacctgtaatcccagcaccttggaaggtcgaggtgggcagatcacttgagcttaggagtttgagaccagcctggccaacatggtgaaaccccatctctactaaaaatacaaaaaattagccaggtgaggtcgtgcacgcctgtagtgccagctactctggatgctgagacaggagaatcacttgaacttaggaggcagatgttgcagtgggcccagattgtgctaccgtactccagcctgggtgacagagcaagactccatctcaaaaaaaaaaaaataataataataataaaaaaaaagcacagctactcttggcatgaacaggagtatttaggagtatttatttagtactcttaatgagtactgaatagggtaggatgaaaaggcaatcctagagtgccacaattttcattttggcgtgattaagcaatttgaaataagagcaactcaactaaattcctgctttgctgtttcttgccggtggaacttccactaagtcagtattgtcagcacatagcattgccattttggcctgggggcatagtttatatagatatgaagggctgagttttttcacataccctcttttttgttgctataactagtgtttaatctgggtagaaatctgcttaatttcattgtcatggcatgtttgactaggaggtattttagaatgttatttggtctcttcagtatgcacactgtggatgggtaaggttgttcgtgcccttcttaggttctggtaggaaatccgttttggaacaggtgtatttgataatggtccagaatatatattttttggactttgtgtattttggaagtgagatgagctttaattgctctattttaagtgtttaccccagttttctggcttggagtttatttatatttgtggaaataatatagtgaaccctaaaaaattctcctttggccactttgataaagaggtaaattgaaaacagaaggtctatttctggttgacttacattaatttcccttttaaaaggagttgaggaggttaaatactgacacaaaaggcaagtaacatgacaataaccatgcatctttgagattattagctcatatgttattgtagttctgtaattcagtcttgtagataggctgagactatgggtctgaagctaacacagtttatggaaagctaagactatattgggaataggaatgtacatagtaaaagttttaatggtgacttcacaagactagaaggtatgcactgcatatcttttaaggccaaatatgttctaacttgagaagtcagaactttaacaggccgggtgtggtggctcatgcctgtaatcccagcactttgggaggctgaggcgggtggatcacgaggccaggagttcgagaccagcctgaccatcatggtgaaaccctgtctctctaaaaatacaaaaattagcggggcatggtggcatgcacctgtaatcgcacctactcaggaggctgaggcaggagaattgcttgaacctgggacgtggaaattgcagtgaactgagttcgtgccaccgcactccagcctgggcaacagagcatgactccatctcaagaataaataaataaataaataaataaataaataaataaataaaatgaaactttaacaattgcttttatgtagcctaaactctacagatctgtaattgaagatgtaattgaaggagttcggaatctatttgctgaagaaggtatagaggaacaagttttaaaagacttgaagcaggtttgtagccgatacaactttttcttcctgtcttttgttgtttttttcagcatacaaaactgatatagttctgatctctcaaattatagtttagtacttacccattcattgtgccatcaggatgacgttagtttttaagaaactgaaaaaaagagaagtatcattatatgtgtatatatttttttaaagtaaactttttttttcccctctgcagctctgggaaaccaaggttttgcagtctaaagcaacagaagacttcttcagaaatagcatccaatcacctctgtttactcttcagttgccgcacagcttgcaccaaacattgcaatcgtcaacaggttggataccattagtaaatgagtactgttagtatcttcagaacaaattctcatttgggaatgtttttcagttagacagggtaatgttcttagggtgagaaggcttggacacctaaatcatttctattaaatgaacacagtataaatcattgccccatgtaattattgattaaaaactcaggttattcgaactagtttttattttaaatattaaattttacaaagatgataaagcctttctttagaggaaagtcacatagtttgtcagctgttgggagcacccattggtaatttcagataatttgactgggtctagtcaaggattagaagtggcagagggaaaggtgagtgcttgcaagtttgtgtgttctctttctcttattttttgtgtatattataaatctgatatattgggagcaaaatggagagttcagaatatggagattattcaggctacctcactgttttggatatataaaataatggctagaaattgatcatgtgcatttatctttattcttggacttagcaaatctagacttctgcttttaagggaaatgtttgtccacattatgcgtatcaatttaaactggaagggactagctaataaaagataaaacttaagagttttctatccttgtatgcttgattcctttctttttcttctgattcttataatctttatgttactcatatgtgtatatataaatgtatactcgcatacaaacaagttttattgggtttagctgaaattcagcagagtagtctgcaagaagtgagggtagattttggattggattatcagtaataagcagatagttctttgcatgcttgggaaaattcacatgaaaattacatgggccaaggtgaagagaacattgtaaggatgcttgtacttcttctattacaaagtgggagaatttacatgtggcagcaattctaacatataaaaatgaataaattaacaatgaatgttgaattagcaaatacaagttttatcgaatactgtgttaataaagtataattttgctctgtaagaattagtcttggcagttttaattgttgacacattgaaacatttttcatcagttgggtttttggctatgctttaattttaaactactatttcattgggacatctccttctctgtttaaataacattcctttggagttttgttaatcactgttttatttattacagaatgctaaagatgtttttttaacttatggttggcatgagggtgtggtgggtatggaagaggaaaatacttgactgtcttttatcagaagaggccgaggtgggtggatcacctgaggtcaggagttctagaccagcctggccaacatggcgaaaccctgtctctacttaaaaacaaaaacaaaagcacaaaaattagccaggcgtggtggctcatgcctgtaatcctagctacttgggaggctgaggcaggataatcacttgaacttgggaggcagaggttgtagtgagctgagatcgcgccactgcattccagcctgggcgacacagtgagactccatcttaaaaaaaaaaaaaaaaagcatggtgaacacttctaagattctgtcattcaaaattgcaatactagattttgccgcaagatggtaatattaccagtgatttaaataacaaaagtcttgcaactagtgtatcaagtttgtttttactcagctccttattctgtatcttagcagttagaataatagaaataattacattttaaatagtttttctccttattctcttctacatcatttataatgaagaggtttcagaggaattacatgtatcccttaaaagtgctttataggcttgttcctgtctctcttcatctttaggtaccaaacagtaagattcttgaaataaatagtctcataaaattgaagtacttcttaattatatcttctcatggtatgcttttaaaagcctgattaaaataacttaaacttctagaatttttttatctcttttgatagcaagttcaaattaaatctacaattcaataagtcatttgcctttgtctgtaccatcttaaaacttgtttgctcagtcaaaatcacaatgagataccgtctcacactagtcagaatggctattattaaaaaactgaaaaacagatgttggtgaagctgcagaaaaaagggaccacttatgcactgttggtgggaatgtaaatttgttcagccactggaaagcagtttgcagatttctcaacttagagctacaattcaactcatcagttctattactaggcatttacccgaaagaaaataagttgttctaacaaaaagacacccacacttgtatgtttattgcagtactactcacattagcaaagacatggaatcaactcaacccatacatggtggattggataaagaaaatgtggtacatatataccatggaatactatgcaaccttaaaaaagagagaaagaaatgtcctttgcagcaacatgggtgttgctggggccattatcctaagtgaattaacacaggaacagaaaaccatatattgcatgttctcacttataaatgggagttaaacattgggtacatacagacagaaaggtgcgaacactgggtactccaaaaggagagaaggagagaagggggcaagggttgaaaaactacccgtcaggtactatgttcactatttgggtgacaggatcaatagaagcttaaacctcagcatcatgtgatatacccacgtagcaaacctgtacacataccccctgaatctaaacccagaaacttgtttgctctatcatatgttcttcgttttttatttgtgtagtaatttcctgtatcttcagttctctactttgtttggtctcaggacccctttaagctcataaaaattaaggaccccaaatagcttttaaaatgtgggttgtaagtatctatttactatgttggaaattaaaacaaaaatttaaaaaatattggtttatttaaaaatttaattacatgttaacataatagcatatatttatgagtaataattcttcgagaacaaaaatatttagtaagaagagtgtcatcaattaatgtcggcttaatgaggtttgcagaaatgagctggattcttatctatttctatttatttacattttattgtatgtaaggtgttcaccatagtgctttgatatagatagatagatagatagatagatagtgaagaggttggtatagtctagcaaattaacatatctgtcatctcacataggtgctcattttaggtacttttagtatgccttaagtcttctcttttagcaaaaatcccaagtgcagcacaacattattaagtatagccctcatgttatctattagatatttagacttattgatcctatgtatctgtgactttggatcctttcacctacatcttcttattttctcccttcctgcctctggtaactgctattttattctctatgtctgtatttgtggttttttttttttaacatataaatgagatcatgcaatacttttctttttgtgtctggcttatttcacttagtataatgtccttcagtttcatctatgttgtgacaaatggcagactctccctcttttaaaaagctgaatcatattcctctgtgtgtgtgtgtatacagacataccacaatttctttatccatttgtccatttgcagacacttcggttgtttacaaatcttggctatcgtgagtaatattgcaatgaacttggaagtgtagatatttttatgaggtagtagtttaatttcctttgggtatatatccataagaaggattgctgaatcacgtggtaattctatttttaatttatttaggaatctctgcacagttttatacaatggctgaccattctgcattcccaccaacagagtacaggggtttcctttcctctgtactctcaccaacacttgtcgtctcttttctttttggtaatagccatcctaacaggtgtgagttgatatcttaatgcagttttgacttatattcctctgatgaatagtgatgttgagcacctttttgtatacctgttagctgtttttatgttgtctttggaaaaagatctattcaagtcctttgccaatttttgaaaaggttatttgtttttctgttattgagttgtgtaaatcttttaatatattttggatattaagccctttatcagatatatggtttgcaaatattttctccgtatctgttggctgctgttttattttgttatttgttttctttgctgtgcaggagctttttaatttgatgtctgtatttattttattttattttatttttttgagggagggtcttgctctgtcatccatgctggagtacagtggagcaatcataggtcactgtagccttgactttccagggtcaattgatcctctcacctcgacttcatgagtaactgggactacaggcatactctatcatgcctggctaattttcacattttttgtagagaccaggttttgctgtgtcgtccaggctggtcttgaactcttggaatgaagcaatcctcctgcctcggcctcccaaagtgctgggattacagatgtgagcgactgtgcctggcttatttattttcgcttttgtagcccgagcttttggtgtgatatccaaaaaatcattgccaaggccattgtcaaacaggttttcctctgtgtttttgtcttggagttttatggtttaaggtcttatggttaggtcttttgtctattttgaattgatttttatgtatggtatgaaaataagagtccatttcattcttttgtgtgtggaaattcacttcttccaccaacaaccatttattgaagaaactatcctttccccattgtgtcctcttagcacccttgttgaaaatcagttgaccatatgtgtttgggtttatttctgggctctctatactgttctgctggtctttgtgtctgtttttgtcagtgccatactgttttgattactacaggtttgcaatatagttttaaacaagaaaatgtgatacctccaactctgctttttttttcttcccctctgaattgctttggtatttaatgtgttctgttgttccatatgaattttagacttttttttgtatttctataaagaaagtcattggaattttgataagagattttgttgaatccatattttgctttgggtagtatggacattttaatgatatcagttattccagtccatgaacatgggtattttcccatttatttgtgtccttcagtttcttatatcaatgttttatagttttcagtgtacatatctttttttttgaggcagggtctggctctgtcatccaggctggagtgcagtggcacaaccttggctcactgcagcctccaccccctgggcgcaagccattctcccacctcggactcccaaagtagctgggactacaggcatgtgccacaacatctgactaatttttgtattttttgtagaggcagggtttctccatactgcccaggctggtctcaaactcctgagttcaagcaatccacctaccttggcctcctagagtgtgcatatctttcaccttcttggttaaatatattcttaagaattttattttttaagatgctattgtaaatgagattgtttttatgattttttggataggtagttatttgtgtacacaaatcccactgattttttttgttgattttgtatcctgcaactttactgagttcatcctctttaaatatttggtagaattcagccatgaagccatctggttctgggcttttctgtgttgggaggtttttaattactacctcgatctctttattttttatatctgttcctaaattcaatctgttgtgatatgttgtttttgtgaaagtataggaagaaaatctagccttccacagatacatagttggaaaaaagggaagcattttaatagtattttcagataattgataactacactaaaactcaacaaatggtagtttctgagaggttagctgcatgatggaatctggaaccacaaggaactttttggaatatttcattagggtttattggtataccttgcactttgaatggctttttaacacgtgtaatgttacagcatacattggttatttggaaaaattggtttcctgtcatacagttgaaacgttgttcattatacaagtttaaaaaaatcatattcattgatataactaggcctctcatccattgtggttgatatgaattttccaaaattaaatttttgcttgaaaagttgagttttatcattggcaaatacatgctgttagtttttcttaaagtgatgggcatgcttagtttatgtttaaaaaaatgtctgccagatacccagtttgaataactatagttgctgtcagatattctttcaagtaaaaatggtgtttcttgaaaaaagaggccatgtttttttttcttttcaacttttattctagattcaggggtacacaggcaggtttgttacatgggtatattgcatgattctgaggtttggggtacaaatgcatagtacccccaggtactgagcatagtatccagtagttagtttttcaacccttgccttcctctcaccctcatccctctagtagtacccattttctcttgttggcatctttatgtccatgggtactcaatgtttagcttctatttgaaagtaagaatatgtggtatttgtttttctgttcctgcattaattcacttaggataccagcctccagcagcattcgtgttgctgcaaaggacatgatttctttgttttttatgagtgcatagtgttccatggtgtatatataccacattttctttatccaatccactatggatgggcacctggattggttgcatgtcattgctgttgtgaatagtactgtgatgaacatgggagtgcatgtgtcattttggtagaaagatttctttcttttggatatatagccaataatgggattgctgggtcaaatggtagttctattttaagttcttagggaaatctccaaactgttgtccacagtggctgaactaatttacattcccaccaacagtgtacaagtgttcttttttctctgcagccttgccagcattggttgctttttgactttttaataatagccattgtgactggtgtgaggtggtatattcttgtgttttgatttgtatttctctggtgattagtgatgtggagcattttttcatatattggccacttctatatcttttgagaagcatctgtacatgtcttttgcccactttttaatggggttatttgattttttgtgaattgttttaagttccttatagattctggatattacaactttgtcagatgagtagttcgtgaatattttctaccatcctgtaggttgtctgttcactctgttggtagcttcttttgctgtgcagaagctctatagtttaattaggtctcacttgtcaattttgtttttgttgcaattgcttttgagaatttagttataaattattttccaaggccgatttctagaatggtgtttcctaggttttcttctaggattcttatagtttgaggtcttacatttagaactttaacccatctttgtaactgaatgcaagttcagtcactcactgcttgcagagtccagttaacaagagggaggtgtggtaggaagaaagtgactttgcagccaggtgcggtggctcatgcctgtaatcccagcactttgggaggccgaggtgggcggatcatgaggacaggagtttgagaccagcctgaccaacatggtgaaacctgtctttactaaaaatacaaaaattagccaggcttggtggtgcgtgcctgtaatcccagctgctcaggaggctgaggcaggagaattgcttgaacctaggaggcagaggttgcagtgagccaagatcatgtcaccgcactctagcctgggcaacagagcgagactccgtctcaaaaaaaaaaaaagtgactttatttccaaagctggcaaggaggaagtggcttgattcctgtccaaagcaatgattttgaattttgatgagggaaggcaagggtttaaaaaggtaaaacttgatatggaaggcatgtaagaattgtactgagtacaacgtctgtgtgtcttgttctgttggctttcttgggttccagtccacctggagcatgggctggagtcatctcaacaatggcaaggttgtggactagctgccttgcatttatcactgcagttttgcagctgggtccccaggcttggtctgtttgtctcaagattagcccctagaacttctaactaggcacataattagatactagcatacagttagatagatgtgaagggagtatatgcggtgagaaagggaaggacatgaagtctattttcaggctaagggaaaaggcttctgaagtttgcttcaaggttaggtcttgaatccaaagggaaaggaaaaaaaaagttttaaaatgtattttgaatttaagctgcccagttacatcttgagttaatttttgtatgtggtaaaaggtaggagtctagttcattcttctgcatatggctaccagttgccccatcaccatttattgactagggagtcctttccccgttgcttatttttgtcgactttgtcaaagatcagatggctgtaggtgtgtggctttatttctgagttctctattctgtttcattgttctatgtttatgtttttgtactgttgctatgctgtttggttactatagacttatagtatgggtgaagttctgtaatatgatgcctccagttgtgttcttttttgcttatgattgttttggctgttcaggctccttgttggttccatatgaattttagaacagtttttttctagttctgtgaaaaatgacattggtggtttgataggaatagcattgaatctgtagatttctttaggatgtatggccattttaatgttattgattcttgtattccatgagcttggagtgtttctccatttgtttgtgtcatctatgatttctttcagcagtgttttgtagttctccttgtagagatctttcccttccttgagtagatgcgttcctaggtattttatttttgtgtgtggctattgcaaatgggattgtgttcttgatttggcgttcagcttgaacgttgttggtgtaaagaaatgctactaattttatacattggttttgtatcctgaaacttaactgaagacatgtattagttctaagagtcttttggtgaagtccttaggattttctaggtataagaccatattgtcagtgaagagagatagtttgacttgttttcctgtttggatgccttttactttttctcttgagtgattgttctatacctccagtattatattgaataggagtggtgagattgggcatccttgtcttttctggttctcagggagagttcttccaatttttgcccatttagcatggtgttggctgtgagtttgtcatagatggctcttattattttgaggtatgttccctcaatgcctagtttcttgagggtttttcttttatcatgaagtcatgttggattttaccaaaagctttttccatgtatattgagatgatcacaggtttttgcttttaattctgtttattgtatttgtcaataaatcatatttattgatttgcatatgttgaaccaactttacatcccaggaatgaagcttatttagttgtggtgagttaacttttgatgagctgctgggttcagtttgctagtattttgttaaggatttttgctctgtgttcatcagggatgttggcctatacttttctttttttatcatgtctttttcaggttttggtataaaggcgacgctggcttcatagaatgagttagagaggagtcccttctcctcaacattttggaatagttttcagcatatttggaatagtatcagcactactttgaacatctggtagaattcagctgtgagtctatctggtctggggctttttttgggtggtaggttttttattactaattcaattttggaactcgatattggtctgttcagagttttaatttcttcctgattcaatcttgggagattttatgtttctaggaatttatccatttcctctagattttctagtttgtgtatgtagaggtattctaatagtatctgaggatcttttgtatttctgtgattggttgtaatgtcatctttgtcatttctgactgtgcttattggaatcttccctttttttctttgttaatctagttagtgttctatcgatattgtttatcctttcagagaaccggtgtttggtttcattgattctttttttcccccttaatgatcactgtcagaaaatcattgattctttgtatggatttttgggtctcaattttgttgtgtttcactccgattgtagttatttcttttcatctggctctagggttagttcttgtttttctagttcctctaggtttgatgttagattgttaatttgagatctttccaactttttgtggtaggcatttagtactatacagtttcctcttaatactgcttttgcttcatctcagagatttttggtatgttgtgtctgtgttttcatttatttcaaataattttttgatttctgccttaactttgttgtttacccaaaagtcattcaggagcaagttttaaaatttccatgtaattgtgtgatttggaaaaatcttggtatacatttgtttttgtttttgttgttgttgttttttgcttccaactgttattagtctttttattctcttggcaatgtcttccagagttaactacttctgttgtaggtgataaaaatgtataaggctctacttcagatgttggtactgctgtgagcgtggtctcttcctttactcaactgagaattaaaacttgattcttttttatattccagtcccagaagtaattccctctatagaagttatctaatgatagtcttattcatcctagtagtggcttacaaccaggctctaacctctccaggaatactataggatggatttagcataaacatatattaaactaaaaaggattctttcaaatgagtttaagtgcattttatttttagacaacctacttgacaagttttttgttttttttttttgacagagtcttactctgtcactaggctggagtgcagtggcgtgatctcggttcactgcaacctccgactccctggttcaagcgattctcctgcctcagcctcctgagtagctgggattacaggcatgcaccaccatgcccagctaatttttttatttttagtagagatggtgtttcaccatattggccaggttagtctccaactcccaaccttgtgatccaccagccttggcctcccaaagtgctgggattacaggcgtgagccaccacgccagccgacctgtttttcttaaaaacaatgcttccactccaaagatataatggtcgaaataaatgaagagctcaagttgacatcagtccaatttatcttaagtcattgtgtcatgtgggtgataggcagcaagcagttgtgatgacaggtgatagagccaaagtaattgccaattggttaacatttttccatttctaaaccatctttaaagaaaatcatatacagggtcacaccatcctcatggtagagcaactatgccatctggattcatgtttttactggtaaaaaactggtagttgttgaaattagtaagatgtgcttggtttgttctacagcttctgtcataaaaggttttactgtttaggtctctgttcttcatgttggcctttgattgattttatgtaatctttgatgtacttcttgtaggcttctttttgaagtttgtttcctgcaagtgatggttcatgacagtatcaacataagtgattaatgtgctttcggtaccctcaccctcagggccttctgcggaggcatttctgtcaatgttaccctctgtcctactgactatcttcttccccacccccccgtcccacttccaggcacagccagtctgcaatctcccagatattgtaaatgttggagaacagctcatcatggctgataaggtccgggtagataatcttgatggcagctgaagggagatgcggtggtgctggcttagcaggattccagagattagagtgaacatgatgcagctggagcagtgcttggtgggtgggaggagtgggtggaaaaggagatttctgtttttattcctctgtggtctatgagtatggttggtatgataatttttttgaacttattgagatttgctttatggctgagcatacggtcaattgtggagtatgttccatgtgcagatgagaaaagtattgttctatggccaatgggtggagtattctgtagatgtccatgaggtccaattggtcaagtttaaattcataatttctttgttagttttctgcctcgatgatctaatgttttcagtaggatttcaatagggggaagtcccccaccattatcgtatggctgtataagagttttgtaggtctagaagtacttgtttgtaattctgggtgctccaattttgggtgagtgtatatttaggatagttaagacttcttgtggaattgaatgcttatcattatataatggccttctttgttttttattgttggtttaaagtctgttttgtcttatataataatagtgacctctgctctttttttgttttctatttgcttggtggatcactcttcagccctttattttgagcctatgggtgttttatgtgcatcttgttttttatctaacttgccactttgtgcctttttagtggagtgtttagaccatttacattcaaggttaatattgatatgtgaggttttgtttttattgagaaggagtcttgctctgtcactcaggctggagtgcagtggcacaatctcagctcactgtaaccttcgtctccgggttcaagaggttctcctgcctcagcttcctgagtagctgggatggcaggcgagcataaccacgcctggctaatttttgtatttttagtagagacgggatttcaccatgttaccaggctgatctcaaactccttacctcaagtgatctgcctgcctcggcctcccaaagtgttgggattacaggcatgagccactgtgtctctggctgatatgtgaggttttgatcctatcatgaaattgttagctggttgctttgtagtttctgttgtgtggttactttatagggtctgtttataggcctaagtgtgttttcatggtagctggcatcagtcttttgtttccgtgattagaactcccttaaggagctcttgtaatggtggtctagtggtaactaactcctttaatgcttgcatgtctgaaaaaacctttatttctcctgtgcttatgaaacttaacttggcagggtatgaaattcttggttggaatttcttttcattaagaatactgaaaataggcccctagtctctcctggcttgtaaggtttctgctgagaagtctgcttttagcctaaagggtttccttttgtacaggatctgacctttttctctagctgcctctaagattttttctttagcattgacctttgacagtctgggagggcaggggccatgaagagtggggccagattgggcacatccatctacaggtcccccagtggcaggtacaagcactgaagctgagggagaatccagtgggcagccaccaggtgcccagaggtatatctaggcatggaactgggaaacctccttggccccaagttctctgcacagtgatgaggggcagcctaaaattctaatccagggtagtgagtgctccagatatctggagatctgcctgggcatggagtggagagggccttcctgcatcaagatctctgcataggaggggtgggatgactcaggctagtggaccaggcaagcaggtgctatgaatacctggagatctgcctaggtgtgtagcagagagggcccccttgcaccaggatctctgcacaggaagggtggagtggatcaggctgttaatcaaggtgagtgggtgctccaaaggtctagacatctgcctgggcatggagtggagatgacccttctgcagcatgatctctgtccatgaaagatgagtggctcaggctgctggtcacgcaagcaggtgccctgaatgcctggatttctgcttggggggtggagcagaggggaccccacttcacctcgatcccaggggaacagcaggggcaccaagtgatggcacatgcagttcagtttcagattgccaagctggccctggctgcaagtctcattgcccaggagagactgcaactgtagcagctctcctcccactccaggcttgcaatagggaagagtataattccaatacctacttctgaggtgctttccacctcagaagtggtggaggctgtggaggctactaccctgctccagagcaggtgcttcagtctgtggcgcaagagtaaaatgcttgtatggccatgcagctgggttacctagaatggctgactttgtatgcaaccagattaaaaatggcatcctgtgcttggtcctatgtctgggaaagtgtctgcagcttctcctagtgtttttccctcacagcgtctccaaccctttccccaagttagcttcagggattgggaggaaaaaaaaagttctccctcagcctgagttgctctgatctcctgtggaaaggtgagtcactgagggaggctgtctttctctctcatgtactggggcttcacttacttttatcagccaaatgccatcacagtggctgtttggcaggattctcgtctttgggatttggagtatcctgcatgattccattagattctcattttccttcttgaattaaagctcaaaccattgatctttatttactattttgttatttccaaatggtggaggcctgctaacaggctttaatctgccacctgaggaaaaaaaggctatattaactcccagcttaaacaatgacacaaatgcttttccttgtacttttgcatgctgcagaaatgctttatccttctatttcatctcgtaaaatattaaaaggaagtatacttgctagttgaaatttagtataataattcttagattatgcaaaggactttcttaccttaagtgaaatatctttgtggttgttcctgctgtttttgtctgttgtgtttttttaactgtgagtagcaattgagaataaagtgaccacttgcaaggtttggtgctactaacttaattcatgctaagatgtctacagttttacttgttattgcttttgcatcatcagttcaaatgtcaacaaaaccaaataaaaatactaaatgagaaaaaggcatactttgtcttggtatcatgaaaatagttttgaccttataaacaccctgaaaatggtcttaggtagcctcagtggtttgtatattacactccgagaactgttgttctgcatgtagggtgactatatgtaatttataatctagttttgagagagagacaaatggggttctattaataattacctcagaataacaggtgtaaactgggactgtcctgggcaaattgggacgtgtagtcaccctatgattaccttatttctaggggacttcaagtcagcttctgtatttggtcttcatgtcacatgatctttttaaaatgatactatcagtcatgatggaaggaagggaagggaggaacagggacactgagaggtttgtggttgctttcatatttgagcattaaaactcctaaagtataggtgtaaactgtatgtccgattgttcttgaacttagatgtgttgaaaatttcagcaatgtggttggttctttaggtgatttgagagttagaatattgtttggtcatcaggagacatcttttatgctaatgcgtattcacaaagaagaaattcacctgtttctatatttcctgaatcatgtaattttattattaaaatttggattggttcaaagaagatccaagaatcataaaactataactgccgcaatgtatcaaagaatttttgatggtgaataagaaacaatacacttatgaatgtggatattgttatgccatgttagtgtattataacattcttaaaattatgtttgtggagttgaattcttgctatgttaaaatttattgttaaatttactatttctaatgagaacaaagatacaatataccagaatctctgggacacagctaaggcagtgttaagagggaaattcatagcactaaatgcccacatcaaaaagttagagagatctcaaattaagaacgtaacatcacaattgaaagaatcagagaagcaagaacacttcagccccaaagctagcagaagacaagaaatgaacaaaattagagctgaactgaaggaaatcagggcacaaaaaaccattcaaaagattaatgaatccaggagttggtttttgaaaaaattaataagatagataggctgctggctagactactaaagagagaagatccaaataaacacaattagaaatgaagggaatgttaccactgaccccacagaaataaaaataaccatcagaaaccatcagtctagctgctggctagactaataaagagagaagatccaaataaacacaactagaaatgaagggagtgttaccactgaccccacagaaataaaaataaccatcagaaactattgtgaacaacacctctatgcacacaaactagaaagcctagatgagatgaataaattcctgaacacatacaccctcccaagacttaacgaggaagaaattgattccctgaacagaccaataaggaactccaaaattgaatcagtaataaatagcctaccaaccaaaaaaagccaaggacctgatggataaacagctgagttctacctgatgtacgaagaagagctgctactattcttactgaaacgatttcaaaaaattgaggaggaaggactcctccccagctaattctgtgaggccagcatcatcccgataccaaagcctgggagagacacaacaaagaaaccttcaggccaatattcctgttgaacatcactgcaaaaatccttaacaaaatacttgtaaaccgaatttagcagcacatcaaaaagctaatccaccatgatcaagtgggctttatcactgcaatgcaaagttggctcagcatactcaaatcaataaatgtgattcatcacataaacaaaactagacagaaaccaaatgcttatctcaatagatgcagaaaaggctttagataaaattcaacagcctttcatgttaaaaactctcaagaaactaggtattgaaggaatatacctcaaaataatacaagccatctatgacaaacctacagccaacattatactgaatggggaaaagctgaatgcattccccttgaaaacagcacaagacaagcatgccctctctcaccactcctattcaacatagttttggaagtcctagctatagcagtcaggcaagacaaagaaataaaggacatccaaatagaaaagaagaagtcaaactgtccctatttgcagatgatatgattctatatgcagaaaactctatagtctcggccgaaaagctccttcaggtgataaacaacttcagcaaagttttggatacaaaaatcaatgtacaaaaatcactaacattcctatacaccaacaatagccaagcagagaggtaaaccaggataacaaaaagaataagacacctagcaatacagctaaccagggaggtgaaagatctttacaatgagaattacaaaacactgctcaaagaaatcagaagacacaaacaaatgggaaaacatcccacgctcatgggtaggaagaatcaatattattaaaatggccatactacccaaagcaatgtacagatgcaatgctattcctatcaaattaccaatgaaattcttcacagagctggaaaacactattttaaaactcatatggagctaacaaagaacctgaatagccaaggcaatcctaaacaaaaaggacaaagctggaggcatcacattacctgacttaaaactatactacagggccacagtaaccaaaacagcatggtactggtacaaacagacccataggccaatggaacagaatagacagccaggaaataaggctgcacacctgtagccatctgacctttgacaaagtcaacaaaagtaagcaatggtgaaagcactcccaataaaataaatggtgctgggataactggctagccatatgcagaagactgaagctggacccctttcttacaccacatacaaaaatcaactcaagatggattaaagacttaaatataaaaccccaaactgtaaaaaaccctagaaaacaacctaggcaataccatcttggacataggaacaggcaaagatttcatgacaaagacaccaaaagcaatcacaagaaaagcaaaaatttacaagtgagatctaattaaacttaagagtttctgcacagtgaaagaaactatcaacagaggaagcagcctacagaatggaagaaaatatttgcaaactatgtatctgacaaaggtctaatatccagcatctataaggaacttaaacaaatttacaagagaagaacaaacagtcccgttaaaatgtggataaaggacatgaacagacacttttcaaaagaagacatacatgcagccaacaagcatatgaaaaaaagctcaatattactgatcattagagaaatgcaaatcaaaaacacaaggagataccatctcacaccagtctgaatggctgttgttaaaaagtaaaaaatgaacagatactggtgaggttgcagagaaaaggaaatactgatatactgttggtgggagtgcaaattagttcagccattgtgtaaaacagtatggcaattcctcaaagagctaaaagcagaactgctatttgacccagcaatctcattactggatattctcagaggaatataaagcattctaccataaagacgcatgcgaatgttcattacagcacttttcacaatagcaaagacagggaatcaacctaaatgctcatcagtgactgactggataaaggaaatgtggtacgtatacaccatggatactatgcagccataaaaaagaatgagatcatgtcttttgtgggaacatggatggagctggaggctattatcttcaacaaactaatgcaggaaagacagccaaatactgcatgttctaagtgggagctagatgatgagaactcatgaacacaaggaaacaacagacactgggtctacttaagggtggagggtgggcgggggcagaggagtagaaaagataactactaggtactgggcttaattcctggataatgaaataatctgtaaaacaaaataatctgtaaaatctgtgacacgagtttacctgtggaacaaaccttcacatgtacccctgaacttaaaataaaagttaaaaaatttagtatttctagaacatacacatgaagaccaaagttatgacacttttagtttgagtaaaaatatatactcatttaaaacttactttgttattaaaaccatcttgaatattaaaatttgtttgatgcacatttaaaggtataacttgtgagcatataaaaataagttattatttttatatgttcaagtatataacttgttagtttagtatcaaaattaagtaggagctgcatgaaacttcattataaaactgttcaatgcttttattccaatgtctataaagaaactttaaaaactctcttattgtactgtttgatttatttaaatatagagaattatcttacaggatttattgcaaggtacctaaaagaggatgattgttgctattttttctcaaggaattcatttaattgctttagacaatgtgttaacagatttttatttcctctccggctattacttaagctgcagcagcttaagctttgctcacttcagctaatgaagactaataccactgtgttcctgccagttcaattctttctaatttagcttttctaaaataatgcctgttaataagcaaggtcgtagatgaacagaggataaaaataattctgtgcttcattaaccatcaatctgtagcctttcttctgttgtcttaacgtggaaggaatggttagtttaaaaaaatgtttgcttttatgagttgtttgttttatgtgacggagccattctaatgtcaggaacagatctttggggcaattttccttaatgcagtttgtgaaaaacaggccataataaatattacattaacatataaacatgctaaagtttgtgtttttattaaagatgagggaaaatgacattctaacagctatatttagtcatgttcaggtaaaatgaaccttgagtatctaaggtatatggttacattgatcaactaagatccttctactgtagttattattttttctttatgcttatttttaaatgatagattacatttacaactagctggtcaatctttgagatgtattataaatgaaaggctggttagcatagaaaactggtagataataaaggaaagatatatgggactgtaggtctaatgtaggtcgagttgtcattctggggatttgttttcttacatatttttagcaattgtacctgttttattgcagagacttgaggagacatgttcttattcatttgttcctaaaactgttcaggtgtgcttgcttacttgaccaaagtactgtaaataacttttcataaaataatgaattggaatttatgttgaacctatacaatttagaatgggtttatgttgggttaacatatttatgctcaatattatagtctcacggaaatgtgccactttaataaatatttaataaatattacttgacttaataaggacaatctaggtgttttgttatggatttccaaagtacagtatagttgattacaatgagatattttctttcagcacttaaaggagtttatttgtaaagtctttatgtgaagttgttgcaaaaaatataattactttttaccgcacttggaatcaggaagtttagaattcaccatggtttaacctgttagtgatagaaaatattttttaaaaataagctatatttagtgattttattaaattggtaaattctaatgaatgtatatttattttgtttcctatgcagcatcattagttattcctgctggtagaactcttccaagttttaccacagcagaactggtatgtagcttacttaaaatatattttaaaagacatgtcccactgttagcgagtggtggcaaaatgctgaacatagatgtaatttcttaccctccagttgaaagtgaaaagatgtggccgggcgcggtggctcacgcctgtaattccagcactttgggaggctgaggcaggtggattgcctgagatcaggagtttgagaccagcctggccaacatggcaaaaccctgtctctactaaaagtacaaaaattagctgggtgtagtggtgggcgcctagtaatcccagctactcaggaggctgaggcaggagaatctcttgaacctgggaggcggaggttgcagtgagctgagatcatgccattgcactccagcgtgggtgacaagaacaaaattctgtctcaaagaaaaaaaaaaaaagatgtggtaaagagtggggtgacagaatagcatctgtagcatagatgtaataaaacgcagaagttccagaattgacattttcttgccaagttttcctgtctttcagagcagttgttagcatcttccaagactgtacctacaaggttaggaaatgtctgaagttatgttgtatggggttttaatacactatataatgttatatgcttgttacatcctaaataaataattttgaggttttttttcagattttttttcccctctagaatggagcaacatcatagttttgactttaattaaactggaatatttttgtcattttgtaccttcgtgaagtatagcttgtttatattttcccccttagtacttgaaggcagaagatacatttacaagttaacatagaaaaccaagtagtttttcgggtagagaagaatagcagcttttcacttttatctttcttccatggtactgagagtagtacataatctactaactgttttttaattttctttcagcccataggttgcctttgtagggcaaatgcttagtgggctagttatttccatttcttcactaagaacagccaaaaccacacaccttaataggatttttggaaagaatggtgctgcttttgataggagaccaatgaagaaatacctctgcctttggaattcaaacaaatattttttttcctgttaaaataagtaataagcttgtattaataaaaagtaaaaatgggctgagcacagtggctcacacctgtaatctcagtgctttgggagactgaggtactgggcaccatagcaagaccatattaatacaatttttttttttttttttttttttgagacagagtcttactctgtcacccaagtctggagtgcggtggcatgatctcggctcactgcaacctccgcctcccaggttcaagtgattcttctgcttcagcctcccgagtaacgagattacagacgcccgccaccatgcccaactaattttttgtattttagttgagatggggtttcaccatgttggccagggtggtctcaaactcctgacctcaagtgatccacccaccatggcctcccaaagtgctgggattacaggcgtgagccaccgtgcccggcctgtacaaaatttttttaaaaaaattagccaagcatggtggtgtgtgcctgtagtcctggctacttgagaggctgaggcaaaaggatcacttgagcctcgtaattggagattacagtgagttatgattgcaccactgctcttcagcctgggcaacagaatgaaaccctgtctcttaaaaataaaaatgcaaaacatttataaataaaataaagagttctgtagtcttatactccaagaataaatgttttaactctttgatgtttattcatccagacttctttcatgaaagctatattagtttttaggataaaaagtagggatactctttttactgtttctgtaatttctgttttctaatttagtaatatagatggactgctttcaatttcagttagtacaaattgaccttcgtggatgcagcacagtttaattaacaaacttttgttggtgaacatttaaattatttccagcatttttctaatatagtattctattgattatgcttgtgtatatgtctgtgtgtttctgtgataatcaggataaatttctaaaagtagagttcatgggtcaaaggtcatttgtattttcatttttggtatatatattgcaaaaattatcctccaaaagggttgtaccaatatacattcatacaaacagtagtttgagagaaccaatttttatcacattctcaacaacactggatgttatcagtctttcaaatttttgcaggtctgagaaccaatggccctgcaaagctatgtcttgggcaagttttttgagttaatgtttatactgttcattaggacttactagcttcattgctaataactgtagaataggattcctcttgatccttaatgggatgatcgatattgaaaactattttattcaaagaactcagccctaatattaaatgttaagtattgtcaaactattgtccagaatcagattttttgactccctgtgagatcagggaaaaaaagatacaagtaaagtccttttctaactttctaatataaatttcttatatctagggcacttcaaactccagtgcaaactttacttttcctggttatcccattcatgtaccagcaggtgtgacactacagactgtatctggtgagagtatattctaagaatctttttgttttcagcattggtactattttttggacattaagcttcatgatttttaaataaactatataccagaagttataagaacttttaataaaattgattttaaaagtaatgataaatggtggttttgattgttatagagacaatctaccacaaaaggcactgtactaggcctgtcctatatttgattcccagttctctttcccaacattgtataggggttctttgtatatattttttctaattcaagtcagttatctaaattttaacaaatacaaaataaaataacttacctgcattcctgctagctctaattacggattaaagattaggatgatcaacctttgccccctttcttattagggattgcatggtctgataggacatccaatagtttggaggttaaccggtttctgcttttccgagcaccatctcttgattttgaagaggatcatacctcttctttgggttgttgtaaagtttaagtaaagcacctaactcaacactcaaaaataagtccttttttttgagatggagtctcgctctgtcgcccacgctgtagtgcagtggcgcaatctctgctcactgcaagctccgcctcctgggttcacgccattctcctgcctcagcctcccaagtagctgggactacaggcgccggccaccacgcccggctaattttttgtatttttagtagagacagggtttcaccgttttagccaggagggtcttgatctcctgacctcgtgatccacctgccttggcctcccaaagtgctgggattacaggcatgagccaccgcgcctggcctttttttttttttcttttatagtgttattttagaggaagaaaggagaagaaatttgattacttttgaaatcattaaactctcttttggatagcattgtcttgctatatggcattttaaatatatgaagtatattttacatgattatgtttgttaaaatccagttttttggctgataacattaatttatcaaacaatggaagaggttcatggattaaatattggtgtcctttatgtatctcaaagtgtgccataaaagcaattgtgggaaaagtctggaattaaagcaaaacatatgtaattaaaaaaataagaatttatatattgattgtagaaatccaaaaatgtctgaagaataaaagaaaaacccctagagataaccaccattaacatattggtgtatttttttccagcctttgtggatgagatttttttttttttttgtggtggttgtcaaaggaaattttaattctattatacttacaattttgctttctcctttttaaggtcacctttataaagtcaatgtaccaattatggtgacagagacttctggaagagcaggtattcttcagcatccaattcagcaagtatttcaacagcttggccagccttcagtaatacaaactagtgttccacaattgaatccatggtctcttcaagcaactactgaaaaatcacagagaattgaaaccgtgctacagcaacccgcaattctaccttctgggccagtagataggaaacacttagaaaatgccaccagtgatatacttgtatctcctggaaatgagcataaaatcgtgcctgaagctttgttgtgtcatcaggaaagttctcactatatcagtcttccaggtgttgtattttctccacaggtctctcaaacaaattctaatgtggagtcagtgctcagtggttcagctagcatggctcaaaatctgcatgatgagtccctctccacaagccctcatggggctctccaccagcacgtgactgatattcagcttcatattcttaaaaataggatgtatggatgtgattctgtaaagcaaccaagaaatatagaggaacccagcaacatacctgtatcagagaaggtatagttctgtgtccaacttcttggtatcaggggacagatagtggccagtaactggatatcctgaatattttcaagctgtaatgttaatcagaattatatatattttgtttttttctttagaagattatttcttttttctagtgatttaaaaaaatttttaattgtgataaaatacacgtaacataaagtttaccaacttaaccatttttaagtgtacagatcagtagtgttatatacattcacatgtggtacaaccaagaagattctttctttattgttgtttttagtataactgtcagtccttgaaatattcatgcttagcatttctaaatttttcatttcaataaatgaattataatacttcttcagagaaaatgcgtttgttttaaaaggtaatctgtttaccagtctcttatactgggaaacttattttatgtctgcagataaaaattaaaagacccagaaatccagaccagtagtttgtggaatgttttgagataattaattatcaaatgtaatatacaaaagaagcccacaaagttttttttttcctgctctacctaatttttctgaattcctatatggaaacttttccctacatgagggattatgttgctagtaattttgtttctccctgcctactaaaatactagttttacttaatttcttttggtattgaaaccactaaaaattagcttctagttaacttttgatattgaaaataggtctgaatttttaattttcaaggaattcatagtaatggcagaaagactcatggagaattttggattataaaaattaaaaaaattgcattctttttacaaatataaaatacatcttgtggctaattctatttacacaatttaggacatgtgaaaaatacttaaaggtttttgctccagctagtggtttagccatcatctagacccactgtacaaatctgtagcaatggatagttaagcacaaccttaatattttatcttcatgatatttaaattttgctagttagggaaagacatagggcatagtgaaaggccaggaacaaagaaaatgacaatcagaaactatttggcctgttttagaatgtttcagatatttattgaaacctgttcaagatctctgagcaaatctgtttttagtttttctataagtgttcatattaaaatgttttattgaggttttttttacgttttttaacataacatataacacttagtaaataaatgtaggttaaactaataagtatgaaacatttgattttgaggtaaaactaactacaaatgtaaaatgtttgttttcatcactactacttttggaggcactttttacctggattctgtgtgaattttgcagatgtttggtgtgatgagtcaaggacttattctactgttatgtattgtatgtcatcatgtactttttctgatatggggaaatagattagttaagggatattaatcaaggattgattgggggtagtggttgagaacataagctttggaaccacagtaggttcaaattctaggttcactacttgcaagcaaactatataacattactccctgaaattcaattttagtctttaaattggcccctaataccaatcttgtaattttgagaattatcagagataatatatatgaagtatttaaagcttctggcaccatagtaagctttagattagtgctattatgctctatgagcttgtaatatattgggtaacttttcatgtaacttgtttgttagttttaaaaaaggtctatgtctaacacacaaaatccaaacgtacaagagtatatgtaaaatgcttatttatttattgtaagttacctttaagatagtaagcagtttggtaggtttatgctgaactaattttcaaagactttacaagtagtttttctttttataagtaacttaaagcaagttataatcaactatacttgtttacttttcctgtgttgtaaactactggagagcttatggatctataggtttaagaggtaaggatctatgttgtttgaacattctgtttcacaaaatatattcttgatagcttttaattctgccccttgtaatttctgttctattttctttgtctgaatttgactcttctaggtactttaaaaatggaatcatacaatatttgcccttttgtgactgtcttatttcacttagtataatgttttcaaggttagtcgatatcgtagcatgtgtcagaatttcattcctttttaaggctgaatcatgtgagtttgacaatttttaaattttgtaaatattcctggaatctgttccttcatctccactcctagtgccattgccctaattgtttctcatgtgggataattttatctaactaatttatcagtgtgtagtctcttctacctcttactctgctcctgccaatccatccatcctagaggtcaaaggcctaagcttcagggatcagaattgttttgaatcccttctctattccttaataattgtatgacttagagaagttactcatttgtaaaataaagataatagtatctaccatgtaattgtggtaggattagttaagaaaattaatgtaaagtgctcagcagcacactggcaccgtggtaaatgctcagtgcatgttagcactctcttcctggtggcttccagagatctgtcccaaatgcagcctggttgtgtcttttctccacttaacacatcaccgactgcccttcacctataataaataaacttcaggcaccttaatatacatatacaaagcatattacgcgttctttctctgccaaagtttcctatttactcttccttcctcacatgaatatactttactgggaacaccaaaccgtgagtgattcttggttttcaaccttgttatttcctacttctctttttgctttttgttatcccctctatttgatgcctggagtttcttcccaccatcctttcctctggttaattcctgcttattcattacttcctccagaaatcttcagtacttctccacctaatttttccttcattattaaattggatgtagctcttctgttttgtcacctgaagtatgtctgtcataatgtagttcaaagatacattgatatgttctctttgcattgacagttacatttatctttgtatatgcagtaatctaagaatatatacacactcgtgtgtagtggagtataagcttttaaggataggatctagaattacgtttatttggctcagtggttctgaatcctggctgaatgatcaaatcattgggccattaaaaaaaagtgcaggtctaccctaagagattaaatctaattgatctggaatgaggcttagtcatcaatatttaagagcttctggagtgattgtaatatatagtcaaggctaagaaccactgatgtagctcaaaatcaatgtatgagtgaaaaatggagtgagaggataagagaatatataacttctaagtaagagttttcatttttcttctaagtccacacatattcctctaaaatataaaatgtcctatcaataattgactttagaattcatttaaattgagtaaatactttttgagtctctatatgccattgtgaaattaatatatcaaaatcagagatgtttaaaccagatatgtgactttttcttcattataagaagaaagccaatttaacaaaataattttttatatctgtcaaaatatattaagatatatttcattccaaataagagtggagtggcatgggatgctactgtacatggtcaggcaatatataattatcattgttactctattgtaataaattaaattcctgttaagaattaaagaaaatatgccctgccattacaattatagaccactgaatttgatatagtttacgttgaaaatgtgaaaagaatgtgtattgtaggttaggcttatcttgttttatatttatccccacatatgggtatgaagttctgcaaatttttactagccattgggaaaatagggttctttcattggagggaagcttaaattgcaaagactggaagctggatttggcgaacaaagctttatcatgaagcatcctatttacttgcttattgtactacccagtcacagaagccacatacaatcaaagacaccttggttaagctgagaatattggacattattgagctggtttgttttagtgcagagaaaataaaaaaaaaggaagcatttcctctgtcagatgacatcatctgcattagaattgttgacatttctttcacgtttggctggaattcatagatgtatcagcagcgactttcctttaacattcaacaggctaaaaataccagtgtttcttagggctgccaacatctgattttaatcattatttgtacattgataccatcaaagaatttttatgttgtgagttcttttttttttttttttttaaattggaaactgacatctttgtaataatgaaaagtttggttagtaaaatttggtactctataccattggagctcctgagatgcttggcaaacatggttttgctgctttagtaaagaaagcgttgctgtctatttcagcacatggcatgcattagtgctaagacacagccaataattctaaaagaagtctcatctgctgacataaaactcaaatatattagagccacggttttgaattattgtgtttcccaagacatttatcaaaaaatgtaggcagaatattaaattcttcatgcagaatttttctggcttttcaaaggacaatgcttgaagcccttgtttgatccttggggagacatttactatttttgagagggagcaaaagccccctcataacaatttgatctagaggagttcattgatgatctatgtggtggacgtttggctatatgaaagacttaaatctttgttttcatggtcctgtggtatcagttatggatgttgctgtacaactcctggctattttggtcaaattaccacttcagaagagattggagtcagataatcatgtgaatttttcaatgcctggtggaagtgcttctgaagaaaaaagttgagaatgataactcttttgctgttttgaaattaagtttagatttgtaattttaatcctctcccagagtaaagagggcctcactgattgaaggaaaatggtatgaggctacgtaaattcaagtagaagagtcctggaatcttcagtattcctttataagcttatccttgtctggcaaggtaacatagaagctctgattcatttttcaacagaagatcttgtggcttaaagttttcagtacttgttgctattaaaatgaaaagccaggccgggcatggtggctgctgcctgtaatcccagcactttgggaggccaaagcggatggatcacttgaggttaggagttcgagaccagcctggtcaacgtggtgaaaactcgtctctactaaaaatacaaaaattagcggagtgtggtggcaggcacctgtaatcccagctactcgggatctgaggcaagagaatcacttgaacctgggaggcggaggttgcagtgagccaagatcgtcccactgcactccagcctgggcaacagagcgagaccccatctcaaaaacaacaaacaaacagccaatttcaacatgtggtttaggcctaggacaaatcttatactaattgactttattattattatcatttatttatttttgagatggagtctcgctctgtcgcccagactggagtgcagtggtgtgatctcggcgcactgcaacccttgcctcccaggttcaagagattcttctgcctcagcgtctcaagtagctgggattacaggcctatgccaccacgcccagctagtttttgtatttttggtagacacgggggtttcaccgtgttggccaggctggactcgaactaattgactttaaaataactcaaatttaggccgggcacggtggctcacgcctgtaatcccagcactttgggaggctgaggcgggtggatcacaaggtcaggagatcaagatcattctggctaacatggtgaaaccccatctctactaaaaatacaaaaaattagcctggcgtgcggctgtagtcccagctactcgggaggctgaggcaggaggatggcatgaacccaggaggctgagcttgcagtgacccgagattgcgccactgcactccagcctgggtgacagagccagactctgtctcaaaaaaaaaaaaaaaaaaaagtaaaataactcaaatttaaagaggcatgatatatatacaataaaattcatcttttaaaaggtagcttttagatttaccatatgaattttggcaaacatgaagttatacaaccctacctgagatagagaacattttcattacctcccagtttcctcatgtgcctttgtagtcaataccctctttcaacccccagttcctggcggtcactcactgacctgttttcttttggggtaggtttaccttttccagaatattagacactatcatgcagcatgcatttttagcacaatacatttgagattcatccatgttgttgcatgtatcagtatattccattgtatggttataccacatttatttaccagtttgacatttgggttgtttccagtttttggtatttgtgaataaagcccctgaaagggccgggcactgggtgatcccagcactttgggagactgaggcggttggatcacttgaggtcaggagttcaagaccagcctggccaacatggcaaaaccccatctctactaaaaatacaaaaattagctgggcatggtggcacacacctgtaatcccagctacttgggaggctgaggcatgagagagaatagcttgaacccagtgagctgagatcatgccactgcactgtggcctgggagacagagtgagactgtgtctcaaaaaaaaaaaaaaaaaaaaaaagaaacagccccgaaaacatttatatgtagattttatatgtgtaaatacctaggagtgggattgttagataagatgataaacgtatgcttatgagaaacagtcaaactcatttccaaggtggctgtatttccaccagcaatgtatggtggaattttgcatttctaccagcaatgtataagatttgttgttggtacaccacatccttggtagttaacactatcttttggtaaggagaagtttttaattttgatgaagtccagtttattatttttatcttccagtttatttattttgactttcagtcccgtatattattttgacttctgcttcatgtgtcttatcaaaggctgcaaagattttataatacttctaaaaactgtatagttatagttttgtcatttaggcctgtgatctattctgggctagttttgtatatggtgcaaggttaggatggaggttcatttttttttttggagacagagtctcgctctgtcgcccaggctggagtacagtggtatgatctcagctcactgggttcaagcgattctcctgtctcagtctcccgcgaagctgggattacaggtgcccaccaccatgcctggctaattttttgtatttttagtacagacagggtttcaccatactggtcaggctggccttgacctcctgacctcaggtgatccccctgcctcagcctctcaaagtgctggggaaacaggggtgagccaccgtgcctggatagctcatttttttttacatatggatattcaattgttttagcattgtttgttaaaaagactgccttgtctcactgagttagctgtctgtgcacattatgtatctaaagcacttcacctttagtgaaaattactacatctgtgttggtttattactgaaggttcactctgtttcattaattcatgtgactatctttttgctaggaccacactgtcttgattatggtaaatttatagtaaatcagagagtgtgaatctctcaaatttgttcttttttccaaattgtttgggctattctaattcctttatatttccatataaatattaggatgcgcttgtcaatttctaaaaagaaaaattgctaagactgatttgggtttgtgttgaatctatagatcagtaaggggaattgacgtcttcacaatattgagtcttccaattcatggacataagttttttttttaatttaggtttttgacttctgttactaatattttctagtttttagcatatacatattatacatattctgttatatttttatctaaatatttcatggtttttggtgctattataaatggtacctaaaactgccatcaagaacatttttattcttatttttaagcttcatttgcattgcatttttaaaaatatatttttatttttaattagttaattcattagtttgtagagacagacagagtctcactgtgttatccaggtttgtctcaaatgcctggcctcaagcacttgtctcactttggcttcccaaagtgctgggattatagacgtatgagccaccatgcccagcctaaaatacattttttaaaaggtagaaaaaactgaaaatttctaaggcatttgaagtacattgccacaatattttaaaaagaggttgtgccagtttttcctgccaccagtactttgatcagttttgccacatagtatagtatatcactactgatttttaaaaattcaatttttctcctgtgctaaagtacacataaaattaactatttattttatttttaaattatttttacaatttttaactgtatagcttagtgacagtaagtatattcacattgttgtgtagctatcaccaccacccatctctagaaatttttcatcttcccaaactccatgcccattaagcagtaactccccatttctcactctcccagtccctgacaaacaacaattctactttccatctctatgaatttgaccactttagttacctcatataagtggaatcagacagtacttgcccttcttcatttagcgtaatatctcagggttcatccatgttgtagcatgtatcagaacttatctccttgttttaaggtgaataatatctcattgtatgtatatactgcattttgtttattcattcaagtgtctgtggatacttgggttgcttccagcttttggctattgtgaataatgctgctgtaaacatggcgtacaaatatctcttcaaattcctgtctttaattttttcggatatatatggagaaatggaactgcaaaatcatatgacaattctacttttaatcttattaggaactgccatacagtttccatagaggctgcaccagtttacattctcaacagtagtgcacaagcatctgatttctccatatccccaccaacgcttattttctgtttttttttttttttttttttttttttttaataattgctaccctaaggggtttgaagtggtatcttgtagttttgatatgtatttccctaataattagtgatgttgaacattgttttatgttcttctggccacttgtatgcattctttgtagagaagtctattcaagtcctttgcccatttttttaaaattggactgtttgctctgttgttgttgacttgtagttctttatatatcctggatattcacctcttatcagatgtatgatttgcaaatattttctcccattttatgggttgcctttactctctgttaataatgtcttttgagcacaaaaggttttgattttggtgaagtccattttatctatttttttcttttgttgcctatgcttttggtgtcatatccaataaattattttcaaatccaatgtcatgaaattttcaccacctgttttcctctaagagatttatagttttagttcttatctttagctctttgatccattttgagttaattttcgtagatggtataaatttagggttcaactccattattttcaatgtggtgctagttttcccaaaatgatttgttgaaaagactgtccattccacattgaatggtcttgttacccttatggaaaattgacgttttatgtaacggtttgttgctgggatctttattttattggtgtatacacctgtctatacattaataacacactggttttattttttaatttttattatttatcgtttcagcttttatttaagattcagggagtacatgtgcaaggtttgtgacataggtatattgcatcatgctgaggtttggggtgtgattgatcctgtcatccaggaactatgcatagtacccaaaacagttcttcagcccttgccctcacttccccttctccctttttggagtccccaatgtctattatttccaccactgggtgtccgtatgtgcccaatatttagctcctatttgtaagtgagaacatctctttatggttttctgttcctgtgttaattcacttaggatgatggccttcggcagtatgcatgttgctgcaaagaacatgatttcttttttttggggctgcatagtattccacggtttatatgtaacacattttctttattcagtccaccatgtatgggcacctgggctgattccatgtctttgctattgtgaatagtacttcaataaacataagagtgcaggtacgtttttggtagaaatatttcttttcctttgggtatatatccagtaatgggattgctggattgaacggtagctctattttctttgagaaatctccaaactgctttccacagtggctgaactaatttacattcccaccaacattgtacaaacattccttttcctctgcagccttgctggaatctcttgttttttttttttgactttttaataatatccattctgacttgtgtgagatgatatcttattgcatttttgatttgtatttctctgatgattagtgatgtggaacattttttcatatgtttgttggctgcttctatatcttcttttgagaagtatctgttcatatcatttgcctactttttaacgtggtcatttgatttttgcttgttgaattgtttaagtttcttataaattctggatactacaactttgtcagatgcacagtttgtgaatattttctctaattctgtagattgttcactctgttgatagtttcttttgctgtgcagaacctctttagtttaattaggtctcacttgtcaattattgtttttgttgcaatagcttttgaataattagttataaattatttcccaaggctgatgtccagaatggtgtttctcaagttttttctaggattgtttatagtttgagatcttacatttaaatcttcaatccatcttgagttaagttttgtatatggtgaaaggtaggagtccagtttcattcttctgcatatggctagccagctatcccatcaccatttattgaatagggagtcctttccccattgcttatttttgttgactttgtcaaagatcagatggctttagatgcatggctttatttctaagttctctattctgttccattggtctatgtgtctgtttttgtaccagtgctatgctgctttggttactgtagccttataatatgggttgaagttaggtaatgtgatgcctccagctttgttctttttgtctgtgattgttttggctgttcaggctccttgttggttccacattaattttagaatggtctagggattttttttggctggtaagttttttattattgattcaatttcataattaggtattggtctgtttagagtttcaatttctttctgtttcattcttgggagattgctttcaggaatttattcatttcctctagattttctagtttgtgtgcatagatgtgtttataatagtctctgaggatcttttgtatttttgtgggattggttgtaatgtcacctttgtcttttttattgtgcttatttggatcttctctctgtttttctttgttaatctagctagtgcttgcttgtatgaaaaagctcttatatctccttaacttatgaagcttagtttggtgggatatgaaattgttggttggaatttctttcctttaagatgctagaaataggcctacaatctctcctggctggtaaggtttctgctgagaagtctgctgttaatctgatgggtttccctttgtacatgacttgacttttttctctagttgcctttatatatatattagcagtgtccttccatagtctggtaactatacaccttgataatgttgattttgtatagtgtcttgaaggtgttctctcaatttcttgtatttggatgtctacctttctagcaagattagggaaatgttcttgaattattccatcaaatatgttttctaggttgtttagtttttctctttcaagaatgccagtaattcatatatttgattgctttacataatcccaatatcacactatttttattattgtaattttgtagtatgttttgaaatcaagaaatttaagactttcaatttgattcttctttttcaagattgttttggctatttggcattccttgagatttgaatttttggatagatttttttctttttctgcaaacactcttgttgggtttttgatagagattgtgttggctctttagatggctttggataatattcacatcttaaccttattaatttttgaatccatgaacttggggtgtctttccattgatttttgtctttattttctttcagcaatttttgttgttttcagcatatacaagtcttttgcctctgtggttctgtttgttcctaaataacctattctttttggtgctattgaaaatgaaattattttcctaattttctttttgagtttttaattatttgttgaaatgcagctgattttggtgtgttgattttgtattctttaacattgtggaatttatttatttttcctaacagtttgtttttgtgtgtctgtgtgtatggaaactttagaattttctacatataaaggcataacatctgtaaacagagataattttagtttttcctaattttgatgtcttttatttcttttacttgcctaatcatcctagctagcacttttagtactgtgttgattagaagtggtgaaagtagttgtcctttccttctttctaatcttagagatttcaggggtttaccattcagtatgattttttttttatcttgaactatccttgcatcccaggattaaatctcatttggccatggtgtaggattcctgtaatgtgctattatatctatttgccagtattttgttgaggatttttgcatgaatattcatcagaagtattggtctgtaatttttatgttttgtctttgtctttggtatcagggtaatgctggcctcataaaataagtttggagatattttgttcttccattttttggaagagtttgaggatgattggtattcatctttaaatgtttggtataattttctagtgaagacatttggttctggatttttctttgtaggtagggttttgattacttattcagtctactttccagttaatatacttattaagattttctattgctttctggttcagtctagattgcgtatttctaggactttgttaatttttaaaatagattatctgatttgttgtggtgtaagtgttcatagttttctcttaaagttctttatatttctgtaaaattattaatgatgtcccctcttttatttataattttattttattattattattattgaaacagagtctctgtcgcccaggctgaagtgcggtggtgtgtgatcttggctcactgcaacctctgcctcctgagttcaaatgattcttgtgcctcagccgcctgagaagctgggattgcaggtgtgctctactatgcccggctaatttttgtatttttagtagagttggggttttgccatgctggccaggctggtctctaactcctggcctcaagtgatccacctgcctcggcctctcagagtgttgtgattacaggtgtgagacaccatggccgaccctcattgataattttagttgagtcttctcttcttcttatcagtctagttataaaggtttatcaattttattgatctttttgaagaagcaactcttggttttgttgatttttctccattgtttctcattctgtgttttctttttctctaacattattatttatttcattctgctagctttagttttgatttgttctctcctttatagttttttaagatgtaaagttaaactgttaatttgagattgctcttttaaaatgtaagcacttatacatgtccctccccattgttttcactgcatccccaaacttttttttttttttttttttttttttttgagacagtttcactctgttgcccaggatggagtagagtggcacaatctccgctcactgcaacctttgcctttgggtcaggtgattctcctgcctcagcctcctgagtagccgggattataggtgcccaccaccactcctggctaatttttgtacttttagtagagacggggtttcaccatattggccaggctgatctcgaactcctgacctcaagtaatctgcctgcctcagcttaccaaagtgctgggattacaagcatgagccactgcacctggcctgttgcatatatctgggggctctgatgtttggtgcacatgtatttataattgttatatcgtcttggtatattgattattttatcattatgtgattaaaaattattttttcctttttaaataacagtttttgacctaaaatccattttttttctggtggtaacatagccactgcagctctattggttatcatttgcatggaatttatttttccatcttttcccttccaacctattcatatcctggatctttagtctcttatagagagcatatagttggatcttgttttttatccattcttctaaactatgtcttttgattggggagtttaattcatttgcgtttagagtaattactgatcggaaagaactaactcttgccgttttgctgttttctatatgtatttaggttttctgtgatttcctcctttattaccttcctttgtgtttaattgatttttggtttcccttctcatttcctttgtgtacattctatagatattttctttgtggttaccacgggtattacatataatattttaggcttataataacctgttttaatcagatagtcacttaaattcaatcacatacaaaaagtttactcgtttacaactttgccctcccctactttgtcttattgttgttacagattacttcttcatattttatttacacattaacatagttttttaatgcttttgtcttttaaatgatgtagaagaataaaatcaattataaactaaaattatgttaacactgatttatgtatttgtccatgtatttaactttaccagataattttacattttgtgtagcttcaagttactatctagcatctattcattttaacttaaaggactccttttaatatttcttgtagggaaaatctaactataatgaattcccttggtttttatctaggaatgtcttaatttatctttcattttttaaaggatggtaaggcagagtttattcaaggggatccatggcaataggaactactctagctgggttttgcagcggcagagagagactggaaggaattccctcccttattgttgaaagataattttgccagatacagaaatcttggttgatcttttttttttttttttttttaacactttaaatatatcatcccactgccttgtggtcttcaaacttcggctgaggaatctgccaaaacacttactggggattccttgtacatagatgcgttgcttttctcttgatgctttaaaggtatatattttttaaatttatttccaactaccacatgttctcacttataagtgggagctaaacaacaagaacacgtggatactaggaggggaacaatgaacacgggaataattgagggtggagtgtaggaggagggagacgatcagaaaaaaatacctgctgagtactatgcttattacctgggtgatgaaattatctgtaaactaaacccccgtgacacatagtttacctacataacaaacctgtacatatacccctgaacttaaagtaaaagtgaaaaaaagagagaggtttatttaggaaagaggtctcccttgtagatagattaaaatattacgcattctaaactgaaacttggctggaaacagtggctcatacctgtaatcccagtactttgggaggctgaggaaggaggattgcttgagttcaggagttcaagaccagcctaggcaacattgcaaaaccccatcaatataaaaaatacaaaaaaattagctggccatggtggtgccctcttgtagttccagcttctcgggaggatgaggtgggaggatcgcttgagcccaggaggtcaaggctgcagtaaactgagattggaccactgcatttaagccggggcaacagagtgagaccctatctcaatcaatctgaatcaatctcaatcaatcaaaactgaaacttaatccttcaaatatgtttattttacttgtcctaaaacaatgtccctagaagtattaaagtgtaaagcactgttattttcccattttgagatctctaatgtaaaaatgtattttttgaaaataatttaaaacataaaatgctatataataaacatttaaaaattttttttatttttatattttgagacagggtcttgctgtattgctcaggctggagtgcagtggcaggtcatagctcactgcagccctgatctcccaggctcaagtgattctcctgcctcagcctcctgagtagctgggactgtaggcacacacaaccatacctggctaatttttagtagagataaggttggtcttgaactcctgaactcaagcgatccttttgtcttgtcctcccaaagtgctgagattacaggcataagccaccacacctggtctaaaggtattgtttttaaatttcaatttctaattgtttattgctactatatagatatgcagttgaattttgtaaattgacctaatatcctgtgacctcgttaaacccacttaataattttagtagttgttttgtagaccatttggggttgctttatgtagactataatctattttgatgaataaaaaaaaatatttcttcccagagtgtttttttttcttggcttattgcactgactaggacttccagtacaaaattaaataagagtgccaagagcagaaatcttgttcctgattttaaggggaaagcattctatctttcaccaagtgctatgttagctgtatggttttaatttttttttgtagatatcctttatcagatggaaacagttttctttaatgtagtttttttttttttaaatcatgagttgatgtttaaacaattttcccctctattgaaataaatgggtttccttctttcatgttttgatatggtgagatacactgattgatttttgaatgttcagctttcattttatatattgctggattcaatttgctaagatttcgttgtggatttttgcttctatgttcatgaggagtactggtctgtagttttgttattttgtgctgggtattagggtaatattagtttcatagaatgaattgctatgtatctgtatctcttctgttttctgatagagtttttagctttctgaatttagaatttttccttgtgggaaggtttttaatggaattaaatttctttaactgatacgtctctttaggttatctgtttcttcttgagtaaattttggtaatttcttgcaatggatttatccattttacttaagttgtaaaatttattgaaagttgataatatattattttaatgcctctaggatctatgtaacatcccttctttaattcttaatactgtttgcttgtgtcttctgtctgtctctctctctttctctctctgtctgtcgtgctagaggtttttctatttatttatttgtttatttattgagacagaggctcactctgttgctcgggctggagttcaggtggtatgatctcggctcactgcaaccagcacctcctgggttcacgtgattctcgtgcctcagcctcccgactagctgggattacaggtgtgtgccaccacacctgactaatttttgtatttttagtagagaatgggtttcaccatgttagtcaggctggtctccaactcttggcctcaagtgatccgcctgccttggcctcctaaagtgctgggattacgggtgcgagccaccctgcctggccaggtttttcaattttattgataatttcaaagaatggacttttgaccttactgatttctctctctctttttttttttttttggtttttaatttcactttttttcccttttaaaattttcattatttccttcctcctgtttactttggacttattttggccttctttttctagtttcttaaggtgggatattatgctattgatttgagacgtacttattttctgatataataatttaatgctgtaaatttccctctaggcactgctttgggtacatctcaaaagtttggacattatgttttcatttgcattcaattaaaattattttctaatttatcttatgatttagtctttgaccattgggtatttataattgtgttgtttaatttttaaatatttgggggattttccagatatctttctgttactggtttctagtgtaattcttttgtggtcagagaatatactttatatattttaaatttgttagggtttgttttatgtttcagaatatggtttatcttggcaaacatgatatgtgctcttgaagctatttggctatttttgggtggggtattctctatatattaattaggttaagttggttgattgcattgtccagggtttccatatctttactgaatttcagtccactttttctattgactactgagagaggaattttaagtcttcacctgtaattttagatttgtctattttttatttttattactttttagtttagttttgaagctatgtttgtaggtatataagtatttaggattgtcatcttcaatcgatccctttattatatttaatgttttttatttatctctgataatatttctggttctgaagttaacattttctgatattaatatagcagtttcaggtttattttgattagtgtttgcatggtatgtgttttttctgttcatttacttttaacttacctgtgtcattgtatttaaagtgagtttctttctttctttcttttttttttttgagatggtgtctcgctctgtcacccaggctggagtgcagtggcgcgatctcagctcactgcaacctctgccttccaggttcaagcatttcacctgcctcagcctcctgaagagctgggattacaggcatgtgccaccacgcccagctaatttttaaaaaacatttttagtagagatggggtttcaccatattgaccagactggtcttgaactcctgaccttgtgatctgcccacctcggcctgccagatagacaccatatggttgggtcttgctaatttaacccagtatgataatctctatcttttaaatgagatgtttaggccatttatattcaatatagttattaatcaacttgtcagggtgtgtgtgtgtgtgtgtgtgtgtgtgtttgtgtgtgtgtgtgtttgtgttcttccttttttctgttttcctgaatgcttttgattcttttttgctgtgtcacatctactgatgaccccttcacatgaaatttttactctcatattgtggtttttattgttagaattttgtgctaaaattcttgtttttcttttttctttattttcctaactccccaaacttgttatctgtgctgaaattctttatttgttcatggatttttttccacttttttccctaaattatttggtgtatcaatcatagtttgacatttctaactgtctctgagtctggttctcttgattgctttgcagtgtgatggttggtttttgttgcttttagtttgtattattatttttgagaagagtctcactctgtcacttaggctggagtgctgtggtgcaatcacagctcactgcagcctcaacctccctgggctcaggtgatcttcctgcctccacctcttcagcatgcaccaccactcccagctaatttttttttttttttgtattttttgtagagatgggatcttgctatgtttccaagactagtcctgaacttctgggctcaagcaatctgccagcttcagtgtcccaaagtgctgggattacaggcatgagtggccatgcccagcctcattaattttgattgaatgtcagacatcttatatataaagagagactgaagtaaatagtatttatagttgggaatggacattactcttcttatagagagatatgtttgtatgtcccatctgtaagggctgtccctccttggatttcaggctgcttcaagaaaagttgtgattttgtaatttatccagcttttgttcattgttagtatggtagtggcattcttttcagcttttacattatgggctgtgggccctctaagatttctctaatttattcgtaacagaatacaaatttatcttatttatgtaatttggacttattttcatttttgagcacatagccattaatttttgcatacatgtgatattccttatatttcatctgtgaagcaaatctgtttccaatgtagtaaaaattaattacatgtaaacttacataattttagtcaatttgaatttttctacacagtattatttgttgggtatacttttttgagggttcattattggtaatattcatatgggtttgaatcctagaagggcagttgtccactcaaaaaataagttgagtatatgcatattattaaagttgtatcttaagttattgagatgtgtattattgtattaaacatcacccatgacttgcaaactcagaagaaatatgaataaagggcatctgttcaaaccttagtaaaacttcttggcttctgttaggagccttcttgactctgcaaattcccaagactttccaggctgatacgatgaaggctttttgggtgctgtatcactcttcattcccctcttcatagcccctggtaaccttgattttactgtctgtttttatgaatttgcctgttctaggtacctcatataagtggaatcatataatatttgtcctgtgtttgccttatttcacttactataacctttatatttctgattgtaaaggatggaaagtcatcctttccatttgcttgggctacatttctatattccagtcttaaagctaatgtaacctgttgcttatgtaatatgtgtgtcaacattatgtatggatttccaaaacaaccagcattatagcatctggagctttcaccaagttttcaaggggcctcttacttttccaaagaggttaagaactactgctatagattctgaagcatatataatcatataaaacagcccctgatcttaaggagcttgacattttattgatctttgtcctgtctatgacaaactaatgggttggggtgggtagtattgtatgaccaatatagaagcctacactgaagagtgaagcgcagtgacttacgcctgtaatctcagcactttgggaggccgaggcgggcggatcacgaggtcagcagatctacatcatcctggctaacacggtggaaccctgtctctactaaaaatacaaaaataaaattagccgggcatggttgcgggcacctgtagtcccagctacttgggaggctgaggcgggagaatgctgtgaacccgggaggcagagcttgcagtgagccgagaacgcgccactgcactccagcctgggcgacagagcgagaccccgcctcaaaaaataaataaataaataaataaataaatacacaaataaattagaaaatgcctataaaatacttagcagaggggtttatttgttagctgtgctggatgaaggtaatgataaaataataaccatctacgtgaccagaggtgattactaaatttcctttatatattttttacttttgttgtgctgaattatctataacataaaaatttgccattttacccatttttaggtgtacatttcagtggtactaagtacattcacaatgttgtacaaccatccccactctgtatttccagtactttttcatcttctcaaacagaaactctgtactcattaaacaataacttttcattcccctcttcatatcccctagtaacctcgattttactttctgtttctatgaatttgcctattctaggtgcctcatataagtggaatcatgtaagatttgtccttctgtgtttggcttatttcacttagtgtaatcctttacatttttatttatccattaagcacaatgacatttgtcttttctatttcattgaattactgtttaaagtcaaatgaaatagttaaatcctaataggtactatataaatttaagacggtatgtataaaaactggtaaatattacctgaaagtaataaactcatttgctgtctccctgtgattgtaagtgggttactttatttataatttaaaaaattattcctatgttacatagaaatgctaggcttattctaaaattcaaagttagattttaatgtcataagagagaagtttgcttgaactgaccatttgtggaatgtttgttaattttaaatttggattcaatattttatataccttatttgacttgaactttattgtatttctttctctttttaggattctaattctcaggtggatttaagcattcgggttactgatgatgatattggtgaaataattcaagtagatggaagcggtgatacatcttccaatgaagaaataggaagtacaagagatgcagatgagaatgaatttctagggaatattgacgggggagatctgaaggtacctgaagaagaagctgacagtatttcaaatgaggattcagccacaaacagtagtgataatgaagaccctcaagtaaacattgtagaagaggtgaggatgacttttgagctgagacttcctttattaatttataacatttctactttattatgccttggaaccaaaaggaatagcaagattaatcttttctttactcttttgaaataagacttatttggggccgggcacggtggctcacacatgtaatcccagcacttcaggaggctgaggcaggtggatcatttgaggtttggagttcgaggccagcttgggccaacatggtgaaaccctgtctttactaataaaacaaaaattagcagggcatggtggcacatgcctgtaaacccagctactcaggagactgaggcaaaagcattgcaggagacaggttgtagtgaaccaagaaatgccactgtattccagcctgggtgacagagcaagactctttaaaaaaaaaaaagacttattatatgcttggatttaaacttttaatcttcaactgtaatttaaaaccaataataaatatttgggaatgggcttctgtattggtcttaactagaggtagtaggtgatctaggcaatgggagtggctgttaaagaaggcagcctaggtagaaacatatagtatctgctctaattctagtaaatgtcataaaatccaggtagagtgtgcttattaaaaagtgtgtaagtagtattagctataatttatggcagccttatatatgtgccaggcatcatattaagtcttaaatgccttatcttaatagtcccaaagtcctgtggttcttactgctatcctgattttagatatgaggaaactgagatatggagagttttagtaacttgcctaaggtcagtcttgtaattattaaatggccaaacgggatttatttatttatttatttttgagacagggtcttgctctgttgcccaggctggagtgcagtggtgtgatcttgactcactgcaacctctgcttcctgggttcaaatgattcttatgcctcagcctcctgagtagctaggattacaggcacaccaccatgcccagctaatatttatatttttagtagagatggggtttcaccatgctggccaagctggtctcgaactcctggcctcaagtgattctcctgccttggcctttcaaagtgctgggattacaagcatgaaccactgcacccggctcaaacagggatttaaacccaggctatttgacttttagtacaattatattctgctgctctaggttcctttatttctttgttttgttttggtttggtttttgagatggagtctcgctctgtcgctcaggcttgagtgcagtggtgtgatcacagctcactgcagcctcaacttactgggttcagatgattctcctgccttactctcccaagtagctgggattacaggtgtgtgccaccatgccaagttaattttttgtattttcagtagagatgggatttcaccatgttgcccaagtaagtcttgaactcctggcctcaagcaatctgcctgcctaggcctcccgtagtgctgggattataggaatgagccaccacgccgagacaagttcctttatttctatatgtctctttatctttaaacaatttaaagcatcataaaattccttaatgtgatcatctttcgtctttaggaccctttaaattctggagatgatgttagtgaacaggatgtgccagacctgtttgacacggataatgttattgtctgtcagtatgataaggtactgtatttaccttttggactttgggtttattaactgcatttatagtagaaaggtatgtaaaatgatgggaaataagatgaagagttacacttcacaattaatcaaaacagcagtttaattctggaaattctgagtgtgtattttgggtctagcgctgtgctatgtgatctcagtgataccagaaaaagtgacagtccttaaggaagtaatgatcttattgaaacaagatgtttcttttggaaaactagaaagacatacaatgagatggtaggtaaatcaacagctaaaatatgtgacaggtaaatcaaatgctaaaatatgtggaatgtaatcaaatgctaagatgagtggcaggtaaatcaaatgctaagatatgcagcacagatagtaagccctagaagtggctaggaaatgtaagaaatcatttgtagttggagttccccataaatccatgggtgatgtggggttttgaaatgggtcttgaatgacttgtaggatacaggtaaatatggagaataagcatcagatagaatagcccaataaaaagcagagaaatgaatggatgtagtatgtacaagggacactgaagagatagctctggcttgaacaaagtgtcttttattggatgtatagtactaggaagtgaagctgggtgggagacagaataggaagcagattagaatatcctgaatgctagtaggaaaaatctgaacttggtctgagggacactagccttctgagaaggttattgagaaaattgtaattgggtttaaaagccagatgtgtttgatttggaaaaagcaaatggtaaaagtgggtagggcagacgtgaagtgcccagaacccagacagaggatggcagtgtaagaacatggagaagtcagaggttatgatggaaaaatcggtgggacttggtcattagttgaaggtgtctctcaggtttccagcctagagattatgttagtagcagtctaactctagcaactaaaaataatactgctttttaaaaaacactacagctgtgattatgtagtcaaatgggagtttttgtccttaattcatgaatatttatattcttaaagtggctttgagatataatgaacatagtatacaattcgcctatttaaagtatacaattcaatggtttatttagtgtattcatagatatgtataacaattatcacagtcaattttagaaccattttatcacctcaaaaagaaaccccatactttttgtttcttagtgcagtattctccccattttccctactccaagcctgtaggcctaagaaaccactgatctactctctatttctatggattttcctattctggaatttcatatgaaagaaattatataatatgtggtcttttgttactggcttctttcacttagcacagtgttttcaagagtcatccatgttgtaacatatatcacgtcttcgttttttaaaaaaattgctgaataatagtctattgaatggatataccacattttctttttccgtttgtcttttgagggacatttgggttgtttccactgtaggggagaaaaaagtaataccttttccttacccattgctatttccctggttgaggcacctataaaaaagacagattaacaagagaaaatcattcaaatttattttaacgtacattttactgacacaggaaactttttttttttttttttttttgagatggagtctggctctgtcgcccaggctggagtgtagtggcgtgatcttggctcactgcaagctccgcctcccgggttcaaaggatcttcctgcctcagcctcccaagtagctgggactacaggcgcctgccaccacgcccggataattttttgtatttttagtagagatggggtttcaccgtgttagccaggatggtctggatctgacttcgtgatctacccacctgggaagtgctgggattataggtgtgagccactgcacccagccgacacaggaatatttagaaatgaagacccaaagaaacagggaaaactatttttctggacagtcataccgaagtatgataggaggaaaaaaggatatgatctaatgacaataaactggaggaaacgtagtaaggcctgtttgttcagatttttgtgtctctgtgtcttcagagataaggacacttattttcctttgtgtatagggtagggacctctgtaataaaggttttatgacttactttaaaggaaggtcagataatccttttatggcctggttcaggggagaagggtgagggcaaggtcagaaagactttcctgcttctgccattttttcaaatgtcaggatgccagaacacatatggggtaatgtgttctgaaccccatagatacctttttgctgctatgaataatgcctctatgaacatttgggtacaggtttttgcgtggacatatgttttcatctgtcttggcatatactcaggagttgaattcctgggtcatgtggtaacagcttaaggaactattagactattttccaaagtggctgtactattttacattcttattagcagtgttcgagggtttcaatttctccacatcctggccagcactggccataatccgactttctaattctaaccattctaatgagtgtgaaatggtatatcattgcggttttgatttgtgtttccctgataactaatgcgtatttacatatttagccttttttttttccagtcacaatttgaatatatttagggggaaacaaagaataatgttttgaattgctgtaaaaagaaatctttttctctgaaaataaggtcactttctccactataacattttatacaaatagaaaaccgcaatttagatgctgaatacaaatataaacataagaaggaataggggatagaaaaggaacagttcttagtttgaaacttgttttagtttcttataaacaatatattgccttctataaaaaaacattataaggtacttaattatatatacattccataaagtctcatgcagaattttctagaccattatggatgtggtatcctttgtttgccgcaatgtgggagataccttgtaattaattatgtagtactttgtatttttgcggtgttttatcatatattatcttttgtttcttataataaccttatggaatagatagaggtgatattaaatatacactgctaacaaatctagtatctgagaacccttctacttagtgaatattttaagaacagtggtaaaaaattaatggaaagcagggcattggggaaccattgaaacattttaaaaggggagtgatgtagtcagaagatagccaaaagaatgtatctaaaggtcaaagtggggtgaggaacactgttatagtgaatctttatgaaagaaaaactttccagtgctggtcactggttgatttgtttcaaatagtattgaatgtaacccaactcaagtgaattgaaagaactttcagtagtctcttttagagctttactaattcagtgtgttttatgggcttagcacgcttttgttatgccactctgctaacttactcagcttattttaaaggcaggtagtatcagttcctctgggaaactattacaaatgcagaatcctgagtcccacgccagagtactggataagaatgtacattttaacaagactccaaaatgatttgtatggccgttaaattttgagaagcagtgtttggtttctttagtatattttatttggatttgattaacagatggaatttatctttaaaatttagagattaacaattggggggaaaactttgaaaatataaacatgtacagtgcaaaagggctaaatgaaggccactggtttacatactgggtgagaattagttaaatggtatagatattttgtttcagaggcctagagaatgtctaaaattaatataaggatttaaataataaagatattatagcgaaaattaatggtgaaatgaaaccttttactacagatggaggtgttctgtgctacaaataggacactatttatagtggaatgtgaaaccatttgaatatcctatatcttcgtttgacagtttagcagacttgcttatagctgactttatcccttagatgctatacaatgattaatttctaggtgtgtagcatggtttctttatatatacagagagagatatgtatatatgtgtatatatagtctctttatatgtatctatatatctctctatataatagtctatatatatgtacatttcctttgaatagatagtgcatacacatggttaaaaaatcaaaatactgtaaaaaggtatacaatgaaaagtctggttcacattccttcatcatttttgctttctattagtagctccttttcctgttttgaatgcaaataagtagttatattagttttcatcgaatttctttattcaaatacaaatacaaaagatagcataaataacactatattctgtaccttgctttttttctttaaacaacgtatctgtcagatcttcccatatgaggaggctttctttgtgatgatattttaatggctgtataatatcctattgtaggattactaaaattcatttaaccaatcctctactgatggatatttgtgatttttcagtcttttgatttgaaccactatgtatataagacattttcataatgtgtgcagatatatctattaaatccccagaaatgggattctgggtcaaagggcaaatgtacgtggttaggtattcccaaaatgctctctaagagcattttgccattgtgaaagatgaaaagtgataccttgttggaatttttaactttccatatgttaaagggccttttgtatttacattttgtgaactgtttgttcataatctttgtctatttaaaaaattggattatttggtcttatatttagtgatctctaagagctcaatattattttggagaaaatgagctttttgttatacacagaagtactttttactcagttattttcattgctttttcttttcaatatgtagattttggatctgtcaatctttaattttatgtcttctgcattttgagccatgaataaaaagttctttcttacctcagagttttaaagggaagctcatgttttcttcaagtatttcatatatatctatatatctatatctatatctatatcatctatatctatatctatatctatatactcaagtcttgattcatttggtgtttgtcttggtgtataatgtaacatatggtttcaactttttatttttttttttccaggtggctactcaatcttcctaacattttttaagaaatctatttcgtccctaatgttaagacatgatttatcatctgctactgcatttctaaatgtatttgggtctacttattgattttctgttttgttccattggtttgtctgtccataggcctatgctactctgatttaattattaagatttttaatgtctggtaaggttagtaattctttactaatttttttgcagagttttcctggatattcttgttcatttttcatattaactccagaatcaacttgtctggttcaaaataaaaccctgttggtattttcattgagatcacattaaattaataaaatttgttattttaatgatgctggggaggaatagattgcaattttagatggagtgtctaggggggccttattgagaatgtaatagggtaaagatcagaaggaagtaagggaatgaactgtgaggatattagagtgtaagcattttgaacagaaagaacaagaaatacaaaagtcctgaggtaggagtatgcccgtgtgttcagggaacagtgcagaggccagagcagtaagtgaggaaaaataaaggattttgtagtccattgtaaggactttagtttttggatgggaagtcattggagagtttcgacaagagaaatgacatctgatttatgtttttagcagacactctgggtatcctgtttatagtagactgaagtgggtgttgtcagggaacaagggtaaaaacaggaactagttatgaggctattgtattgacctgggcaagagaagatgatggctgagataagagtaacagtagtggaagtggtagaagtttttggaatatgaatatgttttgtaggtagaactaacacttactgatggatctggatatgggatgtaagtagcaagcataaagaatacctctaagatttttgacttgagctcttagaagaataagtggtcatttcccagtgagatggggaagattgtgaggtttggggaagacagtataagtgtcatagttgtaaactctgagatgggtgtgtgtgtgtgtgtgtgtgtgtgtgtgtgtaatacacagtctttaatattttttctggagttttaaaaaatctaatatgcaatagttttattaaatactttttcaacacaattagaggtgattatatgatttgtcagtaactgaagtaatatgatttttatattaataagttcctaacattgaactattgttgtatatctagaaaaaatatagtcactagataaaggtaccacaattagttgttgcttctgttgttctcctaatgctgcttatattttattacctgtgctgagtttgggatgtttgttgtcaccgttgtattcccgagagatttttaagacacgtgcaagtgactgtgcaagacaatttgggaataaaactcagaaaaaatttattaggactttaaaacccccccacaaaaataggggtttatcctgtgtgttttcttatgcttcacaaaatgcatctgaataccagtcacagcctttgttcttggatttgactatttgtagtcaacaactaggtttaaattttactcttgatctcagatcatatattcctagggcttttaaatagtcacttgcagtttacttagaggtagcaatgattttatggcttgttacctcttgaagtattaaaatttcttattttttattgtgtctgtgtctaggctgatttatggaatctagaaaacagccagcagagtcttacagattataagctgtatattctgaccttgttcagtgctttattgggactttcttcctcatgatgaagtatcactttttcatttctgataatattggctacatcttccctgtttattcctttgcagacatactggactctgtgctgttcttgaacaatccaggcatgcccctctttaggactgttcacttctattccttttatctggaatgctcctgagtaaatatctgccttgctttactccttaccttcttcaagtttttgctcaagtgtcacctcaaatgacagcttaatattctacataatttacttatgtattaggtttctgtccttccctattaaaatgtaaactcttaaaaggcagggattttttttggttttacatatacaggatgtgtgtttttatatataatatatacagtatagaaatatatgtatcttaaactaatatatttccagtgcctaaaacagtgtctaacacataggaactcaaatgtttatggaataaacaaactatcttgaggagattttaattttaaggcactcacatttcgggtgagaataatcccatttactgtagcagagaaatgcaggtgatcctttaacttgtaaaattaattaatgtaaactacttttctccctccagattcatcgaagcaagaacaaatggaaattctatttgaaagatggtgttatgtgttttggagggagagactatgtatttgcaaaagccattggtgatgcagagtggtaaaccttgtgagctcagtacatctattttgtgaacatcagttggattatattgcatattgtgaattcatttttattttgaatatagtccagcacagagctgttcaaatttttagttcactgtatggaatttaataaaattataattcagatgcagatacaatt

SEQ ID NO: 38080 - DNA, 21592 bp, Homo sapiens; identical to SEQ ID NO: 36916

SEQ ID NO: 38081 - DNA, 105936 bp, Homo sapiens; identical to SEQ ID NO: 36917

SEQ ID NO: 38082 - DNA, 5926 bp, Homo sapiens
ctctgagccctgctcggtttaggcctgtctgcggaatccgcaccaaccagcaccatgcccatgatactggggtactgggacatccgcggggtgagcgagggtccgctggacggtgggacgagggcgcaggggagggaagtgcgaagcagctgcgggacggactctagggaccgttcctcttcagggctgcccgcctcagaagggcctgtgcatgccgctgtgtgtgtgttgggggtgtgggcgggtagaggaggcaacgggtacgtgcagtgtaaactgggggcttccctggtgcagacaaagtcagggaccctccatctctgacgcgacctgcgggccatctctcccagctggcccacgccatccgcctgctcctggaatacacagactcaagctatgaggaaaagaagtacacgatgggggacggtaatggcaccctcgtgttcgggctctgcccactcacgctaagttggcaccaagcaacccatggtggccacctgtggctgcctctgcaggcctcccctgctggagctgcaggctgtctcttccctgagccccggtgagggagccctctggccttgcaaggcagaatgctggggtgggatgctgggccccctgtctaattgggacgggtgtccctcagggcttgcctaaaccctggaagccttagctgtgtggggtccagagccctcagcgggattctttgtccctgaaccctgggatgtgggactgagtggtcagattctagatccacctgtctcagggatcttgccactggctccgtgggagggtccccgggaaggagggctgggctctggggaggtttgttttcacttcttcttccccaccacagctcctgattatgacagaagccagtggctgaatgaaaaattcaagctgggcctggactttcccaatgtaggtgcaggggaaggggcggttttgggggaaagtgcaacgtgtctctgactgcatctcctctccccagcttagaggtgttaagatcaggagtcttctgcccaattcctctcactcctggctgtctaaacagtccttccatgatgttctgtgtccacctgcattcgttcatgtgacagtattcttatttcagtcctgccatgagcaggcacagtgagtgcccggtctcctctctgctcttgcttatgggaaggggatgctggggagcctggtggcccaactgagcttcgccggtttcccatccatccagctgccctacttgattgatggggctcacaagatcacccagagcaacgccatcttgtgctacattgcccgcaagcacaacctgtgtgagtgtgggtggctgcaatgtgtggggggaaggtggcctcctccttggctgggctgtgatgctgagattgagtctgtgttttgtgggtggcaggtggggagacagaagaggagaagattcgtgtggacattttggagaaccagaccatggacaaccatatgcagctgggcatgatctgctacaatccagaatttgtgagtgtccccagtgagctgcatctgacagagtttggatttggggccaggactcttgcattcctgcacacactggtcttaagtccctggtaccattcatcctccaagtgctttcccatactatcagcagttattctcacgactccaatgtcatgtcaacaaaagcagaggcaattcccaccaaccttaggacacgatccaggcatcccagggtagaaattcagttcctgtatggtaaagtttgtgttcagaatctccttcatcagctctggcctctgacttctgtcctgggtcatttctgtcagccagttcacatcacctgcctgctcctagaatatgcagactcaagtagaagactcaggaatgtaatggcaccctcgaattgcatcttctcctcaacagttttctgagtgctgtcattgacatgcacagggatctgcgcattttcataacagacagctcagaggcagtcagagggcctttattcctctccctccttcctttcaacttgaacttctcatctccctggaaactagtcaatgttcattgttttcttctgccaccccattagaaggaactttctactttccctgagctcccttagttctttgcatccttgattctgctggtctggatccagaggctgccaggtgcttgggcgctcctggggctgacccagaggctattgggaggtcagtgaggacagattcagggacagcatctcattcctctctgccttctgatcagtttagatagggtctggcactcagtcagagtctaataaatgctgatgtatccaattgaagcctgggcactgccccagttccagcttggggaagatggctgcttgcccatggccagcctgggccgtccacagccccggggaggccacgtctgtgcagggagcttttgtccgagggtggtgacagctgttttctgcctcaggagaaactgaagccaaagtacttggaggaactccctgaaaagctaaagctctactcagagtttctggggaagcggccatggtttgcaggaaacaaggtaaaggaggagtgatatggggaatgagatctgttttgcttcacgtgttatggaggttccagcccacatattcttggccttctgcagatcacttttgtagattttctcgtctatgatgtccttgacctccaccgtatatttgagcccaagtgcttggacgccttcccaaatctgaaggacttcatctcccgctttgaggtgatgcccccatcctcctttctctttgatgccccttgttccgttacctcctttcagatgttttcccagtcctggagctacacacagaataactcgcatgtattgagtactggtttcatgccacgaaccgtgcccagcacattatacctattgtgtgaaatttgaattttataacattccagtaaggtaacagaattatctcgcccattttagagataaggaaactaagaatgagagggtcagtcctttgctcagggtcccagagctagtggaggctgtgctgggctccctgtgagcctctggatctatgggtggcagtcagggctctcccatttgtgacagaagaaaaagccttaggcttcacctagcctgggtttcacagcccaggacactttggaagaggcagagaacttcatgaccatagatggagctggcaatagtaggactgacacaacggtgacattgatgtctagtactgaacccacaggcaatattcatagctacctccagaagctttgcatgattggaccccagtgtggggaatcctgagagccagggctgtggctgtagctggattaaggtacatatgtgggtgtccctgttgaaggagtatatgttgaaatgcccggtgctggggcacttccttactccacctctattctttttttttttttttttttttttttgtgctggagtcttgctctgttgcccaggctggagttcaatggagtgatcttggctcactgcaacctccgcctcctgggttcaagcgattctactgcctcagctgcacgattagttgggattacaggtgtgcaccaccacgtctggctaatttttgtatttttagtagagatggggttttgccatgttggtcaggctggtctcgaactcctgacctcaggtgatctgcccacatcagcctccctcagtgctgggattacagatatgagccactcctcttcctcttttttccctccagtgttccacgtgttccccctgtgagatgagtagcatgctgattttactcctattcaccgaccttctctgcatgaggcagggagtgaggcacagtgggagatgtatagatgactgccccatcctggaaatgagtgcagtgagagggctgcaggcagagcagcctgtgaggtgtgtgtggcaccacctgggtaccaggcccggggcctgcccctcactcacggggaaccatccctcacccttgctgatcttgtttcagagcacaaatcctactttagtacagatctgggaatttgaggcattagtccaacgggcttctgagcctagaatctgtttccctttcccatcaagaaatctgcttgctcagctagttcccatcagctctggttctggtccaggcttagtggccttggagttatgtaagaggtggtgggaagggaggggtggaggagagctgaggtctatggcctatgacatgccagggtcaatcagtttgagaacaggcagtcctggatcttttttttttttttttttttgagatcgtgtcttgctgttgcccaggctggagtgcagttgcgtgacctcggcttactgcaacctctgcctcccgggttcaaacaattctctgcctcagcctcccgagtagctgggattacaagtgtctatcaccacgcccagctaatttttctatttttagtagagatgggctttcaccatgttggccagggtggtcttgaactcctgacctcgggtgatccacccacctcggcttcccaatgtgctgggattacaggtgtgagccggatgtttttgaataccttatctgggcattcaatcctggtaagattgtgcacagcacatctgagtatcatgtagcctgatctgcagcagggctggagatgccatgggttagggcacagtgagattttgctcaggtattagatggagaactttggactttctgctttaaggggaatgtttagagcctagtctcgcctttgattttcttgtgcactgccaccccccattccactttcatccaggttttactgagacattgggtgagtgtgttcagagcccctttgttctgctggaggtcccttctgtgtctctatacccagacaagccaagagcctccctgtggaaaaggagactgtttgtgcagtcaaggagtgacagggcctggtgtgaggggtggtggggcagaagaagaagagaatttgtcaggaagaggccagaactggagagagacagaaccaggctacactgcagttctattccccttactaggtatttaaatgtaaggaagttgctgaacttctgtttcccacatgagaaatggtgataatagattcagccttgcagagcagtcgagtgggttttctaagcttacgttgtaatttctcttgggtacagagcacccagcaccgtgtagaatcttcataagtgttagctgttactgtggtacaacattacttaaaggaagttggaagagttaactccgcaaatctggggaccctaagaagctgtgtgatgcctcagcacttgagcccacatggaaaggctgtggccagggccctgacctgctgtgtctgcagtggggttgtcccagccctcatgggcagctgaccttgagttctggccttattttcccccctctcagggcttggagaagatctctgcctacatgaagtccagccgcttcctcccaagacctgtgttctcaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaaccaca

SEQ ID NO: 38083 - DNA, 8214 bp, Homo sapiens
cgccagtcccctaaccctgaggctgccgcgcggcggtcactgcgccggggtagtgggccccagtgttgcgctctctggccgttccttacactctgcttcaggctccagtgcaggggcgtagtgggatatggccaactcgggctgcaaggacgtcacgggtccagatgaggagagttttctgtactttgcctacggcagcaacctgctgacagagaggatccacctccgaaacccctcggcggcgttcttctgtgtggcccgcctgcaggtgagtgccccctcccgcgctacccacgccggggccgggatgcccagaaggcgcttcctcgggggcacacgtggccgatcgggccaggaatgcagttcttcttgatgagggtactaggacgcggcttccgcctcctgggcgggtccacctcctccgctgcgcccactgcccggccctgcccgggccacggtgccctctcgggctgcctggagctttccccctcctggcctttgcaccggctgctcggtctgcaccgatttggcctctcgtccactaacttaacagattgcatacagttggtacttctggagagtcttctctgacccgtgtctgggaattggttgccttctgttctgtacataacctttgttacagcacttctcacctggcattgtgaaaatccgtttacctgcctttcgctcctcatctaagaggtcctgaaagctgggaccatgtcttatttgtaataatgctgtgttcagttaggtcaaggggctgcatgaactataaccagtgttggtaaatcattgctcttcagcccagtccattcattcatttagtacatattcttccggcacttaacactaagggtataaacatgattgagtaaagtggctgtttcgaggaactctcagtctgtaggacagaggtgcaatagattatgttcaaaacctttttgacagcgtcgaatgagacaaacatgatctctgctaacatcgtgagttcttagttgcaagcaacagaaactggctgatttaagcaaaaaaaaaaaaaaaaaaaaaaaaaagaatgtgttgaaaggctattggagagctcacagaatgaccaggaaggcaggagtacaaagctgacaaaacggacaagcataaagggaggcacagcaactgtaatacagtgggcatcacacaacagaaccagcccacggagcctcttccacgccactgctgaacttggtaaacgtggatgctgtattgtccaccaccccctgccctggacactgcctgcctctgtacatccctgcagttcctgaaacccaaatgtgtcagcctctctggagtccctgctgtcttgggcactagcttctaattgaaagccccagaatgtcccgattggctaagttttggccacgtacccatgccgtgattttaagcaaaactgagagaaccagcttctggcctttgaagcctcaaaaatgggagtcaggctctgatactccctattcccaaactcgtaaggtagggaatttcccaactgtaggaagggagtccaaatgcttacagtcagggcaaggggaagagatattaaacaagggattattcagttacaggtatatggtccatcttaaaaaggaggcatgcaaagtgcaatggggcgtatgaccagggtacctgacctaaccaggatgctcaggaaagccctgcctgaaaatgtgacttttaagttgagacctgaatgattgtagaggtggggagcacacaaaacagggaacagcatcttctgcaaaggacctgaagaaagaggaagctggatctttcagtcagtgtggctggagtttagtaaggggaatgtggcatgaagactggagatatgtggaagggccacatcttccaggaccacagaagccaaataagacacactgcagaactaaagcacatgaaagatagatttctatctccaaaagcccattctggtcacatggaaaatagatttgaaggagggaagagtgaatgtggagagttcaagaagtttttgcagcaatttatgccaaagataatgaatggcatcttgaactagggtggtggcagggcagggtggatggatttgagaactaatttggagataacattgttaaagcatagtgattgagtgtgaagagaataccaaagatgactcaggtttttggcaccaggtagatgcaggtgatgtttgcagagaaaagaggaaaatccggcttgggaggagaaaattttaagttcagtttgaacattttgaatttgaaatgcttgctaaacagtcaagtgaacagaataatattagcaaacatttattaagtacttactgtgtgctaggccctgttctaagcacttctgaagctcagaagagagatctggtctgggtttaaagatgatcagaatatttgaagccattggaggggatgagaatgtcttgagcaaattgccaaatgaatagagaaaatggcctagaccatgggtgtccaaccttttggcttccttgggccacactggaagaagaaaaattgtcttgggccacacataaaatacactaaaactaatgatagctgatgagctaaaacaaaaacaaaaacaaaaaaaaggcccatgcataatttttgtgatgtccgccaccacaggtaagcaaaaaagttcttgcatccaaagggttggacacccatggcctagactgagccttgagcaactccaacatttaaaaatcaggtaatggaggaggagttggcaaaggggattgagatcaaggaacagcctgaaaatcaggaaagaggcagatcaggagaaggtggttacctatgttccgctgagaagtggaacaagatgaggaatgaaaatagtttattggatttagcaatacacaaccagttagtgtgaattgtaacttttatcacatctcctggtgtcctgccagggacatgtggtcctagaagaacatctcttatgctgaataaaggtactggtcactccaaccaccccaattcctgagatgtctgacaagtttttctagaaaatataagtgacagggataaaatataaacctgaaaaggatcctagaattatcgtttagttcaactttttaaatttatctataaggaaactaagctctggaaagatggaaagaaatcttcctagaccaaataagccacataaggattctgtattttatttgttttgtttttgtttattttttagtttgttttttcatgtaaggatttttaatcttccccaggactctatcccctgattgcccacctctgtgaggaaagaagttaaactagaaacctaatttcattacttattagttccaagaccttaggaagattgcttaatctttctaacccacagtgtttattgctgtaaaatgggtataagaaagttgttagcaaaataaaacggaatggtccataattatatattagccaatagcactgtgtacaaaatgatccacccgccacggcctcccagaatgttgggattacagacgtaagcccctgcacctggcccccaaaacacactcttttatccatgtctttgggcatgctcgtcccctgcttaaatggccttcccatttgcagttagtgttaggtgctcttatgattattgtagataaattagtataattcgtgagtattagtgttcataagtacacaaatcattcatcctcaaatgccaggtccctcagggcaaatttggtgatatatgttggtaggatactctacagacataaaaggagagagaatattataacccacatgtagccatcacccagcttgtctctaagtaaaaatttatgtgtatgtaagaagactgggaagtaatttgcaaaaatgaaaacaattgtgttcaggcattggggttatgggattttttttccttaaactttttgtttttgttaagatgtctatacatattcagtgtatgtttcatttttaaagaaaaatatttaaaaaacgtaatccttgggatctgggtcctgtctgtttaactttatattttccacagcttcttatgcatagaaggaactcagtttattgactgttttaattgcatggagttcaaggtaaatcctttttattttgatgagggaaatttggattcaagtggatattgatcatatcactttgatttcctttgtaggattttaagcttgactttggcaattcccaaggcaaaacaagtcaaacttggcatggagggatagccaccatttttcagagtcctggcgatgaagtgtggggagtagtatggaaaatgaacaaaagcaatttaaattctctggatgagtaggtggcttctaattataagttaaacagtaattaattcagaaagcagattgtatgtgaggatgtgtacctgtgtgttagtttttcaaaaccacatactacagacatattcattatacttttagagtcaacataaaaggcatgataatgtgagtttgctaaaaggtctagaaaggctatattttctgataaagatttggggggatgtttgtaatctcttatgtaaaagatggaagcccttatttttcattctattgtctttcataatttttctttatagtttcatactgtgaaaaggcatgaagatttctgtaattgttacatatttttgttgattttgaaagtacttgaattcagtttttaaagaacaattatttaagatggcaggtgaatcagtaaataagtaatactttgtaaaagcatctgaggacatgttagaaatgctttgatactttttatgactagagctctcagagttgtgtggcagagcatttcatacaaagaaaagttgcagaaaagagtaggccttgagaagagagggttatctgacatgctcgatactttacctcacttgtgaaggagaaagagccatcctctctacctttgttctaggtggatattctcttgctgtcagaacaccatccatttttgtagcccaaagaacaatgtttccatagtataaagttgaaaaaaaaaacaaactatattgaagcctctttaaagacaagataaatacagagagttatgttaggagtataacaagtaatattatgtctcaggccttctaattgaaatgctaagctaagcttacttttttttttttgtaacggagtctcgctcttgttgcccaggctagagtgcaatggcgtgatctcggctcaccccaacctctgcctcccgggttccagtgattctcccgcctcagcctcccgagtagctgggattacaggcatgcaccaccatgtcggactaattttttgtgtgttttttttttagtagagacaaggtttctccatgttggtcaggctggcctcgaactcctgacctcagatgatccacccacctcggcctcccaaagtgctaggattacaggtgtgagccactgcacccggcctttttttttttctttttgagatggagtcttgctgtctcccagcctggattgccacagtgcaatctcggctcactgcaacctccacctcccgggttcaagtgattctctagcctcagcctattgagtagctgggactataggcgcccaccaccacgcccggctaatttttgtattttagtggagatggcgtttcaccatgttggccaggctggtcttgaactcctgacctcaagtgatccacctcagcctcccaaagtgctgggattacagatgtgagccaccgtacccagcctaaatgctaagcttacttttgatgtggtaaatttatatattctctatcccaaatacatagggagcaagtatgttcagatgtagttaaatgtttaatcccatacaccatcttgactattataaaaagaccttacccagtgagctaaattggctaggtcaaatgtggttaaaatttggctgttctggtttcaggcaagaaggggttaaaagtggaatgtatgttgtaatagaagttaaagttgcaactcaagaaggaaaagaaataacctgtcgaagttatctgatgacaaattacgaaagtgctcccccatccccacagtataaaaaggtaagctatttacagactggtggtgattactttttaaatttcactgagagaaactaaagaatatattgtttttaaaagactttaggcccaacgtggtggctcatgcctgtaatgccaccactttggaaggctggggcgggcagatcacctgaagttaggagtttgagaccagcctagccaacgtggtgaaacctcatctctactaaaaatacaaaactaggaggccgtggtggcgagcacctgtaatcccagctacttggaaggctgaggcataagaattgcttgaacccaggaggtggaggttgcagtgagctgagatcaggccaccacactccagcctgggtgatagtgagacactctcaaaaaaatttctaaaaaagaaataaaaggttttgtatgttttaaattccatgtaaacatttattttaataaaaatgtttttaaatataaaaatgatagttatttacctaatgtacagattcaaaaatattatgtgtaatgatagaattatgtttttaaaactatttattaaaaaaatttttagaaatatatgtgagtcagaattctagacatgtattttctccctttctttttttctttctctctttctttctttcttttgcctggcaataaatttttgcttcatttttatgatgtagacatgtattaaagtaggaaagaatatttatgagtgtattttaatagatttagtctctctctctttctctttctatatatatatacatatatgtatatatatgtatatgtgtgtgtgtatctatatatatatatatatgcttttgtaatgtttttctccccgtaacacagtattttatgaataccaagattcatttttataggggaaaaaaacatactttctactgctgaaatgtttttcatccctaggtggagaaagaaacgtcacactgcctttcagaatcagggaaatcacccttgcaagcacaagacaagaatgtgggatagagaccccaaaattcctgttcagaacctaagcttagctctctgttggcaggcccaatcaggtcatggcacctgtaataggtaatctggttcctaggcctcgtttggaattttttagtatgaaacctagagaaattagcctggtatagattatgaaagtaccgctaaacacagttgccatttattcccccatgtccaattcagagcaagggtaacctctggcgttgtaaccgaaactgctctctgtaaactttaaattttttttgaagaatggtattttttttcttaaaaggtcatataaattttatatagatatgtttgtcttaatattaaaatatttaaaatcatatattgagaaagttgatattccatgaggatgcttcatttggctttgaaaactccatacacattcatgctcagtgtgagaggaatgatggtattctattttatataattgtttattctagagttatctgaaagctaatacttcatactttgagaaggcaaataaagctgtggtatggtacgttaaattatattcctaactgaaagggtttttttgtctgtttgttttaaccatttccagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctttagaacataacagaatatatctaagggtattctatgtgctaatataaaatatttttaacacttgagaacagggatctgggggatctccacgtttgatccattttcagcagtgctctgaaggagtatcttacttgggtgattccttgtttttagactataaaaagaaactgggataggagttagacaatttaaaaggggtgtatgagggcctgaaatatgtgacaaatgaatgtgagtaccccttctgtgaacactgaaagctattctcttgaattgatcttaagtgtctccttgctctggtaaaagatagatttgtagctcacttgatgatggtgctggtgaattgctctgctctgtctgagatttttaaaaatcagcttaatgagagtaatctgcagacaattgataataacattttgaaaattggaaagatggtatactgtttttagaggaataaacgtatttgtggttt

SEQ ID NO: 38084 - DNA, 49665 bp, Homo sapiens
gggcactgcgactacactgaggttctgcccactcctgggcagcttcttagctgggtggcgaaaacaaaaatgccgcctaattggtcactggccctttctcatgaatgaaggaggtttctgttttaagaaataaagtgactcctcagccgttgattcactgcccacagggagattttgagcagaggcttcctaggctccgtagaaatttgcatacagcttccacttcctgcttcagagcctgttcttctacttacctgggcccggagaaggtggagggagacgagaagccgccgagagccgactaccctccgggcccagtctgtctgtccgtggtggatctaaggtaagttattcggagttgccacttgcctggtcttatttcttcacctctgacctatttcccaaagcacgctgtttctcctttactgaaacattctgcctctactttcctctgtgttcgtctcccctcctttaacttgttcgcacagagaccatcttagctgagaaaatgacagtgaagtttgtgctgcaaggatgtgttgctagtatagtatttcaggccagcgagccccgccgggttaaccctttgaggagaggaggctcgcacacggggacagctcggagctgcctgggaaccattcgtttgggtacttagtgtccccacaagtttctctcaagaattcaagccccacttctccaaagagagagccagggatggcaaagattaagtaattggctttcagccccagaacacgtcagtggcagttttctcaatccttgtttcgtgcaggggggaaaaaaatcaacagcacatttttgggccaggaagttctgctgagctctgtgctggctgtgagccgcctcccggcccctctccgcagccgccctccagccctcccagcctggcgctggacggagcctttgggaacaagggggagaaatgccagaacttgatcttagaagctaatcaagcttcttgtgactttcaagttcaagatggtatcttagaatagggggatttttttttttttaaaggaacaggagaacaagaggccaaattttttaaaaggacaagaaacttggtttcaagttcttcacttcttgtggttccatgacttaggcaattcactctgactccactaagcctggatttcttcatcagtaaattgatggggggtggtgatctaacatgagtgtgtcaaattcccttataaaacaaagccaggatagtcccagaggggtagtggtaatgggtggtcttcaagacttgttttgtttaccgattattcacatattttaattttacctcccactaccagttggttacccccttgaggaaaggactttgtttcctgatatttttctacctcccagaatccagcatgctaccaaatgcctagtaggtgctcaccccccttccatgtcaactgctttgatttctgtttcactcgtctgctctcaaggcaagaggtaaagcagcagtcagggcgaaaggctgggagacacgtgtctctgcgggagggctgcctggaattgaggccttattactggctctagccaaataggagaaaacagggagtttctcgaattagttcatgtcccatttgggttacccaggaaggatagtctgtgctattgtccacagagtcaaggcaggccagagaactggcagacaagcccagctccagaagccagagttactgctgtagctggacctggaaaccactcctcagctggaccagtcactgtgtgtggggcctttaatgggaggggaagggaaactatgaaacacatcctaataccatgtaagggtgatgactgtgattagagacattattagatggcggatacacagaatccttaactttttccagaccgtgacttaaaaaaaaattgtcattgtttctttttggcaattacttgccatcaatacagttcaaacaggccctagctgactgggatgggctggtgcaggacttttggtttctgtgggatgtcctggtgtagtccgtgtcatgtttttaggcatttctctctattcccctgggatgaaaggacaggaatttcaagatatttcacctgcaatgagttcctgattttattttcaaacaacgatgcaccattatctgaaagcaggctaactgttgtgcacttgccagcctcgctctaatccttaaaggccacacaccacagtcattcttaatctgctgctgcagctaccagtcactccatgatggagcatcaaaagatggataatgtagttactctgctctgttccttgcatggggtgggttaaacagaagtgaggtctgagtaatgtaccaacatgtcggatagaaaggttcttaactcagggttactcatttttggaaggtgtagagacaggaaatgttaaagcctgcttctcctgggattaaggagttagtgactttcaaatgctctgaaaagaaaaagaagaggagaagacagtcatatctgcaggcattcttcaacaggcattcagaaagattatggtggggtagtttgtctaaatgaaatctttgttttacacgttgtagaatggaaatctcaggaatatcctgaattcaaatcatttttcttctgcaggcaattttaaattagcttctaaaaacatatatgaattgcaggcaactgctgcagaaaaaaaagagtgaacacagatgaggcatattcaactttaaattcctttcagatccaatgaaatgacccctaatgtttgatcacatttccttatcaaaacaatcctgcagtctgaaggatttttccatgagaaagtgtctgaggactggaatcaagaagctgccccccgggcctctcctgtttcttcccaatgcgttgtcaccaagatatttttagttcatgaaactcaggctgtcctttctcccacttatggtctttgcctcccgtgcccagcaggcctcctagaagcacacatgtgcttggctgtgactactcagctcactctgtagctgtgtgtgcacgccttgtgtgtgtgtgtgtgtgtgtgtgtgtgcacaccttgtgtgtgcacagaccttcccggataccaggagttgtagactggctgaagaagggtgggcttccatccatggggtgatccttaggtctgtgctggtttggcttggttccctgataaggcagctgaactcaagccctttaggagggccaggactgaccggagctcccagcctgtgcccctctcctcgcaccccacaggccgcaccccacagactgaggctgcctggggtcttggcagctccctcagcaatgagggatacttgctctccgctgcctcattgtttccctgcagtcaggatgccagtgttttttccctttccccttcccagagtcaacaggtctccctccccgctctgaactctcttcctactctgagctgtctgtccaaactcttcctggcctcccagcttaccctatgacactcttacctttcacctatattcattctttcccttctcttccaactgccccttctcatacccagcactacatacaaattacaagtaaataagtgtctctcctacaccaataaaaggcaaatacaaaaaaatccttcagcgtttccccactttccttacttctcttccgttctccttccttcctttctctcccttcctcttcctctcttggtttttcctttctaccccttcctctccttcactccgtggctgtggctgaattagggatcacacatgtgcttagagaaaccatcttatctgaagaaacaaaaaaacaaaaaccaaaacaatgacaacgacagaaaaaaaaaaaaaacatgggctggtttgaggttgttctctaaatgtttattataacttctaatgtgatggagtcagtgtgttcccattagtccttctcctcctcatttagtagctcagaggagtcccagagcaaacttcctcaaatcaggtcggttcatactgcactgccttcagcctgatgtgagtcttactgtgctgggtttatgtccaagggccagtaaatattcccttccttccagggctcaccactgtttcaaatcctctggcaagcccagtggaagaacttctctgtatgggaaattcagcaagtaaacttggaagtatttgttcattggagtttgaatctgagccaaacagttcactcaaaaccaaccttccactcagcaaaccagtgttatgaaagtttgcatgcatttgggcaggaaacaaaggacattaatgagtttaaagatttttttttaaatccatgacttttggacatttattaaaaagattactctctggggaatgaagtaaggccttgggaatcttgtaattgaaagtttctgatccgaagtagatctcaggatcctcccagctgtaaatttatagatttctttttaatgtccacctgaaatattcatgctgtgtgtctctaggacgcttcaaacctattcctgactcaaagaaagcttaagaaaaaatccaagcagttgtgatcaccaaggcctgattatggaggagctgttaatatggtttattaattactcaggctgctcactcctgtccttcctctgttccttgctgtgctatttgtcttcttctggggacataacaccttcattaaatcccatccgtccttgccttagagttgtcccctggaagatagctcccctctagatgcatcaccatttatcatcaccctttgttggtgctctgtcaaccagttttcaatttattttgaattcagttaatgattaaaatttaatgagatccagtcaaatgcttttctcaaatcaagatgcctctgcagcctcatctgtatcctcttgtgatggcgtgaaggaaagccatggcagatttccagcctggtgatgctgtacagaacacaggtggcctgcttccatgcctcctcagcttcaaggtgaatggctctgaagcatatttattacagaatctcctaggggttatgtggcttccccatcccctttcttccctcccaatagctgaaccagtcagtgctcccaaccgagatgcaagcggttaagtgcacaggatctggtgccaaaccgcttatatttgaatcacagctctgctacttaatagccatgtgacctcggaaaagttacttaccttctctatgccttgcttttcctgtctgtaaaatgagtctgacaatagtacttaggaaattagagtgggtgtgaggattaagtaagttaatatatctatcacacttggaacagcatttcccacgtagtcaccattcaataaatattaacaatgattgctaacaaagagtaaagttccttaagtatgtcagtttcattaggtttgtattttggcttatcagtgtacaatctatatcaacagtaaactacaaccctagagccaatggttaccatgacctgtttttagcaccagcctgttgctcagaatggtttttatatgtttaaagggtgtcttttcttaaaaaaaataaaaataaaaaaggagcagaatatgaaacagacacagcatgtggcccataaggcttaaactatttactatctgtcccctttgcagaaaaagtttgccaacccgtgatttatatggtttaatggaaagagcttggagatctaaaggcttgatttggcttcacccatcacttgttaagtgactatggaaaagcttctcaatgtgtctaagcctctgtaaaacaggaatggcaaagtggtaacacgtaccctgcttatggcctaggcttgttttaaggaccaaacgagatgatgtgtatcaaatgtgccggaaatgactcatatatacacgtttgttaaaaagatatggtctctatacattagcttcatagaatagtattagcacctgggtgtaaaaccagggaatactgtttttaaaaagagagctctgaagccagataataactgcagttgtcgttgcggtaaaaataacaaaatggccattgctttttaagagcttgatatgtgccaggctctacattcaacactttatttacatctactctttatcctcaccacacccctatggagaagtgttgctattttccctattttgcagatgagaaaagtgaggcccagagacgttaggtaactttgtcaagatcacaaatctaatcatgcagctagccggcacagggagaatttaaccctagggagtctgaacccagagcctgtgcatttaagtattgcatatgttcccacatcctaggaatatgtgttgatttagggtaagcccatctggaaggcagaagccactgttcactgtggatgtgggcatgaagtctgttcatgtgtgccctgggagagacttgcttcccacacaggccacggtggactctaacggacctgaagaaagggaggcaggcatgatgggaggaaaagctttttggtgaactctgagatcagaaaggtagcgctgtgaagactaataggctctgtttcaaaaaactagtaagttaaggaagattgtgctaaaagaggaaaagattgctgggaacagacatgagcaaacagttggaggcagctcaaggggcttgactgagagctgtgtacagaaaaaaaaattaaaaaagagagagggtgaagcatgggaaaatctgtcactgggacaccaagggagcattgtcacatggacagcaagggagcattgtcacatggacatcagggctgctgacatctggatgtgacattattcgcaaaactaggcagctcggggcagagtagagaagcccagagaaaggtatcaggcccgaggaggcaaaaaggaagacaaagcaagggacctggagagagaaactgacatatttgagggaagatgcccatcagatccaagagctagaaccacagctcacagtccaaacggtgatgagagtccagagattaaaagctactgtcaggctgggtgcagtggctcatgcctgtaatctcagcactttggaaggacgaggcagaaggattgcctgagcccaggagttcgagaccagcctaggcaacatggcgagactctgtcgctacaaaaaaaaaaaaaaaaaaaaaattaaccaggtgtggtggtgcatgcctgtggtcccaacaatatgggaggctaaggtgggaggaagacctgatcccaggagggcaaggtagttgtatgtccctgggaatcacctctgtacccagctcatgcccacccatgcttaccccaggcacatgttctcaccctctgctgaaaggtttttgatatttgaagagatatgttcactgtctcctgggcggtgtcatgagttcctcattcgcattggttcttaatctttgtgagcatcagaatcactagtggagcctttccttttcattttttatcttttaagtcaaaatagatgcacttgttacaaaacttaaatagtataaaatgttctgaaaagcaaacctctttcctaccccattcctagccatccaattcccttcccagaggcaaccactgttcctcatttgagatggcagatatacgaccttatatcatacaaatgatggcataccctacacactgtgctactcttgaatttttttaacttaataaatcttagagatagttccatttcagttcacacagcccttcctcattcttaaaggatgtggagtgctcattgtacagatatactacagttttaaaaatcagaacctttagacatgtgggttgtgtctggtcttcgctattataaacactgcggcgttgcctgtcttcgtagcctcttcatttcatacaagatatacatatctctgcaggggaaattcttagaagtgaaattactaggtcaaagggcataagcttttaaaattctgatagttattgccaaattgcacagatcacatttcccttggcaaagtatgagagaacctgtttacctgtgagacttaaacaaaaatacactagtattttacatacaataaacaaaaatactcagaggccctgggtgtggggcctgggctctgtattgggagcctcagagaggggttctgagccaggaactctcctgggcttcttcgccctccagccccgctctccccccaggatttgctgatgagcctgagatgacccagggcactgccagcatgggggctcccagggtcctagttggcaggtctcctgttcccctgaggagtcagtgcttgctccctgggtcatggctggaaaacagggcttttccacttcaatccaggcaccgccctctggtagagactggagcaaaggtcatgccagagttacaagcacgtaaatatggagaaagcctggaaaaaaaaaggaaaaacagaaaaatgggtcgggtcagaacaagcaagaaccaggctcacatgcacagctgttccatccagttatatgtccccaggactcacctctgtccccagttcatgcccactcgtgcttacccagggtacatgctctcaccctctgctgaatggttttctttgtattttaaaaatacaatggtgagatactgagtgattgctttttaatgtttagtatttttacactatggacattaaagacaaaacagataaaactgccatccttgacataacccattaatctgtctgtggccccctgatgtggcatttgtaattgttctctatgactgcctcaggagagttggcagggttgcccactttctgccagttcagacaggggtctggggctggagggggcctgtgtggtagtggcaggcgtgccccacccttttcagttctaggtggagctctgcagaggcacaaagaccagcaactccctgcctggaatctaagagcagatgctcccattacactggctgatggcatcacctttattctgcaagtaagggttgtggtcaatcctgcccatgggcaggacctttgggcatggcccagacctaacttgggtgcttgacacatagtgggcacttaataaatgttctggagaggaaaaaaaaagaagagggaagggtcacccacgtggcataattttaagaactctgaggaccaggcccaccagatactccttgctacccaacattgttgttgacaacattctcattgtcactgatccggctacatggacctgtctgtcccctctctgaaataggcatcaactatttattcattcagtgaatctttattgagcacctactatgtgccaggtgcagttctaggtgttgagaatatagctgtaaacagaacagtcaaaaatcatgcccccaggccaggcgtggtggctcacttataatcccagcactttgggaggctgaggtgggaggactgcttgaggtaaagagttcaataccagtttgggtagcatagtgagacctcatctctacaaaaaaattttaaaagtcaggcacaccgactggcgcagtggctcacacctgtaatcccagcactttgggaggccgaagcgggcggatcacctgaggtcaggagtttgagaccagtctggccaacgtggtgaaactctgtctctactaaaaatacaaaaattagccagacgcagtggcgcacacctgtaatcacagctactcgggaggctgaggcatgagaatcgcttgaacccgggaggcagaggttgcagtgagccgagattgtgccactgcactccaacctgggtgacagagcaagactccgtctcagaaaaaacagaaaaattaggcatgatggcgtgcgcctgtagtcctagctacttgggagactgaggtgggaggatcacttgagcccaggagtttgaggctgcagtgaaccatgatctaggtactgctctccagcctgggtgacagagcaagacccccgtatcacaaagaaaaagaaaagagaaaattgcacccttaggaagtttatattctgggagaagggagaggcaatgagcaaataagagattattagatatttgtgtatatcatatacatttgggtaatatataagacagtaataactgctggataagaaggtaaagcagggaagggagatgggaatgagaggagagtgtaaacattttagggagtgcgaccagggagacctccctgaggtgacagccaaggaaagacctgaaggagaaaggaagccagccatgcagctgtgtgggggaagggtgttccatgaagagggagcgacaagcacgaaggccctgggacgccggtcgtgggttttctgcatgttacttagtttcctctcttaggctggatcacagcaacttgaaggtaggaagaatgttttctgtgtcttcagaaattactgtgattatctctcactgcatacctcctttttttttttttttttgagacagagtctcgctgtgtcacccaggctggagtgcagtggcacgatctcggctcaccgcaacctccgcctcccgggttcaagcaattctcctgcctcagcctctggagtagctgggattacaggtgcctgccatcatgcccggctaatttttgtatttttagtagaggcggggtttcaccatgttggccaggctggtctcgaactcctgactttgcgatctgcccgccttggcctcccaaagtgctgggattacaggcgtgagtcacggcgcccggcatgcataccctttggtacctcttgaagtttgtatcacttgtggttatttaaaaagtaataaaactatttcagttgggcgtatagtcagaagggggatacacagcattgagttggacacatagttgagttctgtaattatctgctgttttgagtatttgatagtgacatgtttgaaacaccagggtccattttgttttttaaagattattaattccatagttttattagaagttgtttcttgccatgccaggtttatttactaaatactcaaaagccatgtgttccttttcagaccagtttattttattttcttttgagacagagtttcgctcctgttgcccaggctggggtacaacagttgtgatctcagctcactgcaacctccgcctcccaggcttaatcgattcttcagcctcagtctcccaagtagccggggttacaggtgcctgccaccatacccagctaatttttgtacttttagtagagacagggtttcaccatgttggccaggctagtcttgaactcctgacctcaggtgatccacccaccttggccttccaaagtgttgggactataggcattagccaccgcgcctggccagaccagttttttaaaaaattatttttattttttgagacaggttcttgctctgtcactcaggctggagtgccatggcacgatctcggctcactgcaggctggacacctccagggctcaagtgacctctcacctcagcctcccaagtagctgggactacaggctcacgccaccgcacctggctaatttgtttaattttttgtagagacagggtctcattatattgccaaggctggtcttgaactcttggggtcaagtaatcctcctgcctcagcctgcaaagtgctggggttacaggtgtgagccaccacgcccagccccagagcagttttaactgaagaattcccaccagaggatgacctcagatttccagtttatgtgagatgactgccctcatcactttttttaaagcctcctccaagcccccagatggctcctcagctagaagagtagaatttgcaactttttttttctttaggtagaaaagcgcttctaaggtactcacactggaaaacccagtgagaatggaaatagttgtacctgaagagtgaggattgaaagcaaatcccatggcaataaagagaggacaggaattagtcctcctgccactcagctcactttttgcatctctttgcctcccattcagctgtgtgcccacaagtgcatgtagacgatgacacaacagtcagccaggccttgaaaaaatattttcgttttctgaccggctgaagagcatgttgtgtggcacatccaatttcataactgtggaaaaattgcaagaaagaaagggaaaaaatggtgagcattttttttttttttggagatggagtctcgctcttgtcgctgaggctggaatgcagtggcgcaatctcagctcactgcaacctccacctcccaggttcaagcgattctcctgcctcagcctcctgagtagctgggattacaggcacatgccaccacgcccagctaatttttgtacttctagtagaaagggggttttgccatgttagccaggctagtctcgaatacctgacctcaggtgatccacccgcctcagcctcccaaagtgctgggattacaggcccgagccactgcgcccggccaaacattttttaaataataaaaagttgcgatatttatttacaggttttttgggtaggctcttgttcatttttataaggtctgatcactttagctgatgaggtctccttttctgcagagccaatgagcagaggacatacacagcctgaaaaggacaaggacagggaaagggagagacggagggaggagggaaggccagccggaagttagaagttgagttttctgttgcgtcagaaaacagagcaagggtcgttgtgcagcaggtgggtaagtttgataccaagtgggagaagactgtcaaagagcattcatttggcagggagtggagaggtatctttctgtaggctgttaagtatatttggtggaaaactgctggccccatctgtgtgaaaggggagcatttcaaaatgcatgctgtcctgatcccattggattgggtacaaggtgcaagagaaagtgaattcatgctctccgaaacttgttttagaacataatttatgtaaactgactttaggcacagtgagccctcagtgaatgtggttgaaatgcgacatggatccaaagtaggaatttttaaatccagacataatcccttttctctctctggtatttgaagtatgctgtgtactagccttgcatagaataaccctctgggatttcttctttttcacttgcttgctcttttacgacacctgctctgcagcctcctgcaaacccccagttgctcctgtgcagtcctctggactgcgttcttcctgcccctgcagtcaaggcatcatctcaatcagtttaatgatgagaggagactggttttctttctcattgtgttaggtgaattaagagttcttcttacagctaaaagcaatattgcccggcccgttggataaatgctctgcaggctaaggtctagtttagcgagccttgctggttcaactacatcacaaaccagatggtcatggctacctttgttgcaggcatagtgcccagagggaattaagtcctccaaatgacctaaaattaggtagaaaatgtcactctgaccttttttcaatgtgttttaaacttgggcttgctttctttgcttaaaaaaaaacacttttattttttaaaattaggaaatagtcaaatggaacaaaattataaaagtttaaaaggtgaaaacttcctcccactcctctcccccagcttaattccatcctcaaaggcaaccagtgtagcaatgtctgtatatcctccacacggtttatacatatacaagcagatatgcacacagaaacacacattctcctctcgttttttacacaaaatagcagcatagtatgcacactgctctgcgcctggcttttaaaaaaaactcaatatatcttagagatcattccatatcagttactaagatttatttcttcatgtattccaagcacacacgaagcagcccacattatgataatttctctttcctcaatacttggcagttgattttcatctgtgttttccccttgctggtgaatgatttctaccacaggatggtccaatcacattctttgaattgccttccagataaaatatcttaataagcattagtgcttttgcctggaggataagtaaacaattttatgtgattagggctttgcaagcacattggtgtctcactgttaatttaaaccacatcttgaatgaggtcccttaaggtcataaagtgaggactccaagaatttatctgtcttctaaggctatagcatgttttctcttgttccagaaactagaatgaaccgaagcattcctgtggaggttgatgaatcagaaccatacccaagtcagttgctgaaaccaatcccagaatattccccggaagaggaatcagaaccacctgctccaaatataaggaacatggcacccaacagcttgtctgcacccacaatgcttcacaattcctccggagacttttctcaagctcactcaaccctgaaacttgcaaatcaccagcggcctgtatcccggcaggtcacctgcctgcgcactcaagttctggaggacagtgaagacagtttctgcaggagacacccaggcctgggcaaagctttcccttctgggtgctctgcagtcagcgagcctgcgtctgagtctgtggttggagccctccctgcagagcatcagttttcatttatggaaaaacgtaatcaatggctggtatctcagctttcagcggcttctcctgacactggccatgactcagacaaatcagaccaaagtttacctaatgcctcagcagactccttgggcggtagccaggagatggtgcaacggccccagcctcacaggaaccgagcaggcctggatctgccaaccatagacacgggatatgattcccagccccaggatgtcctgggcatcaggcagctggaaaggcccctgcccctcacctccgtgtgttacccccaggacctccccagacctctcaggtccagggagttccctcagtttgaacctcagaggtatccagcatgtgcacagatgctgcctcccaatctttccccacatgctccatggaactatcattaccattgtcctggaagtcccgatcaccaggtgccatgtaagtgatctttacctcctctgggcattctgggctgggtgactgaagaaacaagggcctcacatcaatgcttcgtgtcactaggctggcatgaacaggtcagaatgcagggagggcattctgcttctcttaggggctttccatgtgtggctggatttgcaaagggcctgcagagaatgctttttcttagcctaaagcctgtcccacttggagtctccttctctagggacctttaaggacaaaatgggttcctctgtctgggttagtttaacaaacctgcctagaagcagagagatgaccaaaatgatttctagaaaatgtattttttgttctaatctttgggcatatgggttcttccttctcgtcatctttcttccccatcttagacttggcagagaaagggcttttagtcaaaaacaaagcaaaacaaaacaaaaaaccagaaggtgcccagaatgtcattgagactctgggattcgggccattacatgaaaatgaagttgtttctgtgattttgctgcttaaatccttttggacacttgagccatccacagctaccctacattccagccactctaagactggcagtccccctacttgtcgcgatggttcacatctccatgcgtttgccaggctcttctctctcttggggatgttcttccccttctggtgtgtttgacccagtttcaatacaccttttaaaaaaactgctttatcgagatctaatatacatactgcaaggtttacccttaacccattttaaataaaaaattcaataagttttagtatatttacagagttatgcaaccaccatcatacacattttttgagacttagctcaagtgtccctctggaaacctccccagatcacgttctccttcagggcctctgtctccctcctgctctggccctgttgggacacctaacaccagcatggcatctaattatgtacgtgtctcctctccttctagactgcaagtttttatgcatctgcaaatgcaaacgtgtactttcaattcataattccccaggatttaagcacagtgtctggcacatactagactctcaataaactacttccgaaataataatatgtatcagtgcaggaagcatctctgaaagtgataagtcttaggttgagataaaaggttctatcaccattttttttttcctactaccattcttgatgttaaatctccgctgaggccactggaaaataacaaaagggctttacagatgaaacacagggctgtgaggcctgatatttttcttagcaaataaacactggacagaaagtagttcagagtgtaagaagtgcctgaccaaaggcctgatgcgcagctttaaaataaattatagaaataattacaaatgctgtaatcaaccataatttacatattagtacatgtatactaagtataaagcttcctaaagtgaagagagcaacacagtaattcataactcaaaaaagaaaaaaacaaagaggagatagagaaatgtaacttagaagatgcttggaagaaataggtaagaatgagtgtgagatcaggaatgagggcaggggctggggaagcaggagggtgtaaggagaatggggccttgggctggagcgggagaaagagcctctgatgcctaaaactgggacgtggtgtataaatgctgggaagtcaacagagtgggagtgcatggatgccacccctgctctaagcgcccagtcatagggtgggtgtggtggtggattcccttaagtatgaatcactgagaactgaatgttggcaaggtcaaggctgtatttctcagtgattgccaggtttaaaaggagtaatttgtgagaataataccataaactactttttaacattctgttatctgtatttaaaggtaagttttcaccaggcacggtggctcaccccactttgtaatcccagcactttgggaggccaaggtgggtggatcacttgagatcagaagtttgagactagcctggccaacatggtgaaacactgtctctgctaaaaatacaaaaagaattagccagttgttgtggcgggcgcctgtaatcccagctactcgggagactgaggcacaagaattgcctgaacctgggaggcagaggttacagtgagccgagactgcacctgggcgatgacacagtgagactccatctcaaaaaaaaaaaaaaaaaagataatttttctgatcattataatatttggtcactcccaaaattaaaatatgcccagaagttcaaaaaagaaaagaaaaagttttcatatttctgccacccaaatagaattccttattagggttttgacatatcaattttcagtgtttttttctttgcatatatttttaatctaaaattaaaatagttttcagtgacattgagtacttattccagaatcatttaaaactgcttcattgtatttcatcagacgcatctaccaaattgttatgaacctattctttattgttggacatttaaaatagtttccagttttctgatccaataagcaatgctatggcaagcattgcatacatatgtttttaactgcacttccgattaactccttagattaatgcgaagaactgtgaatacttaaggctttgtgatacagtcccaagcagctgactctgactactaacaagggaaagcctcattgtgatagacaaaaaaagcactgactcaatgttataatgaaggtcccaggaccttctggaaaatacttcccacggaaaatacttttcctgttgttggagctgaaacagcgccattggcaatccagtctttggaggtgagcgttgtcccattggggcaggctcctttaaaaggcaaacactcctgactgggaacactttttgtccctattgccccaggacctgctttctttcatcatttcaccatccccttgctctctgtattatttccttctgttagggggttggggagagacatctaggatccttggggcgaaaagaggtgttgaaaggcagaggggagagaatggggataggagaggggaataattcacagaagatacacaaatagccaatatgaaaattaaaccaagctcaatatcattagatttaagaagtgcaaaattcttaaagataccttttccttgattagttgtgcaaaaataaaaactttggacaacatccagtgttagtggagttagagagaaatgaatattcccaatcactcttgataggagtgtaaattggtgcaatctcccagaaggcaatttcactatcacagttttatatgtgcttcctctttggcccagcagtttcacttataggaatctgtcctatagaaacattaaacaagcatatacaaatacaagaacaagaatgtttattaaagcattgttgcattagagtaaaaacaaaaacaattacaatgcctatcaataaggggccagataagtcatttgtgatttatgtatactatggactactaggcccatgttgcactgaatacacattctgacatcaaaaagattaagttgaaaggcaagagctgcagtgatgatcccatccatgtttattttttaaaaactatataggtttatatatacatattaagtctagaaggatctagtggtgatcttggtggggaggggagcagggaattaagaggagacaggtatattttccttctaatttcatatacttttgttgatttttaaaaatagcaaacggccgggtgcagtggctcacacctgtaatcccaacaccttgggaggcagaggagggcagatcacttgaggtcaggagttcaagaccagcctggccaatatggtgaaatgttgtctactaaaaatacaaaaattagccagccatggtggtgggcacctgtaatcccagctactcggggaggctgaggcatgagaatcacttgaacccggaaggtggaggttgcagtgagctgagatcgcgccactgcactccagcctggtcaacagaatgagactcagtcttaaaaacaaaaacaaaaacacatagaaaacataaaaataaaaatagcaaacaggtattacttctataattaagaaatgagtaaaaactgaaaagaacaaagggaaacagcacatatagaaggcaagctcgccccaattcaccttgcatgtcccttggccctggctcccatctaaccacagagaagagggtcagggttgccagtgctgatgggttttttgcagggcattgtagccctagaatatttatgaggcctccagcagcaatgagtcccacgaaggttgctgtgaggattaaatgagataatgtattaaaggcactaggaaagtggctggctggtggtaagccctcaatactaacagcttttagttattattgttattatttaaaagcatcctgtagcccagttctgcagggtgctcctctacttccagatcccactcactggcacagattttaagcattcatggcaggtgtacaaatgcttagtttcatgtcagggctataactgcacttaattgctaacaaaaccacttcaaaagagctgttcacctaagggatgcttgtgcagttggaaaccatggctacgtggctctactcagctttagaagagcattacttccttacccattaatgaatatataaataaataatgatcaccatgcaaatggcatatctaagctttttgcaagttaaagcaaaaatggttattggtcgcccctttcatgtaaaaaaaaaaagttttcaaagtaggtggaaataagaaagggaataagtctacgttttctcctcaccccaccccctggagaagtcggcctcctgctgcctccgaatccttccactgaaggtcgccagcatggagttcatggctgtgcaatcaaatgaaactcatgatgcaaatatattgggaaaagagagagaattaagtctagagagccctcattttattataaaattattgctttctctaccaaggagactgaatagaataaaattacaggtacatgtgtacaattgtacctgtggaccaaaaaaaaaaaaggggagggattatttgtatgctagaatgcatgcacaaaaaataaaccagatggaagaaatgataaagaaggagttgcctttcaggaacgacagctgcttacagctgtgggagttcctgcaacagtttatattggccattttgtttcctggctaaactgattgcattatatcacgattttttttgacaacttgaaaatcagattttatttctctctcataaactcttttaattcttaataaggaagaaaaatgttgcatgttgtgactgataaatggaaaacctcatttaggatttggtttacatattccaaatggtaaaagctcagtaacatgaagatcgtgtgtactcaggccaagaagatcacaggattgacaaataacatacagtcctgggcgcccatttgtgattgtgcaagattttcatttttgctttgtgattaacactgcctctgaactgaggagttaccatgctagcaaatcatttgtctatcacatcatccaccttccctctcctacagaattaactctcttgatggaactgtaggcattggggacaagtccgcagggaagctatttctgaacagggattctcaagtaggtggctgtcgactcatatgtctccccttctcacacactaactagtgtgggtttgtgtttaaaaacagacacccacagacacatagattttctctttctctctccatttattttgagctaatcccaagggaactgtatcctatttatctttgttcaccaagtgcctggccatcgaggttcaataaatatttgttgaatgaataaaaagaaatctgttctctacttcctggggaaaggagtgagccttaatcatgagtagagtctttgtaatgtgaagccttggaaaagccatttttttttttttggcctgggagggaagcaaagaagggagtcaatgaaatttggaaacagaacctgtccatccacttatcaatttattcagcaaatagttatacaccgtccttgttttcatggaattcacagtctactggagagatggataagaagtagaagtcagaaacagaatgacaaattataagtgctataagggaagtaactggttgttggaacagacattaatagacaggttgaccagagaatctctttaagtagacatctgagctgaaacctaaaggatgagaaggtcaaggaagcaaggagctaaggaagcaaggagcttgatgtcattaagataccaaaagcaagtcagtggggcctagcagagtgagcaaggagagaatggtgtgctagaagatgaaggctggatgggccatggtgaggaatctggatttttattctgagttaaacttctttatgaaaatggaaaattgaactctataattctcaatatggaacttagaacagtacttgacatgtagcaagtgatcaataaatgttagccattattttacatgtatagtacccaagtaaattggcaagccttcgtcatagtaattggaaaaaaatgattaaaactttagcagtgaaatgatggtcatttacttgataaacatagtttttatttagcaacttttcttgtttcttttttttttttggtatttttttgtagagatgggatttcaccttgttgctcaggctggtcttaaactcctgggctcaagagatccacccacctaggcctcccaaagtgctaggattacaggcgtgtccagcctatttaggaaccttttccatacaaccagtcaaattccagacaaagctggtcagattccacttacaaaagggaacactcatttcttactgatccactgatactcagttttcctttgttttcaacaataaaaggacagcatggaggactatattgtcagtaccctaattttaaaaattgatgaggtgtatcattttcatctgctcacataaactggcataactttttaccacaggtggccgtttctgaaatgaaagttacagctaatcaaacacttagcccacatgccttggtgattttaatgatatgatttgttgctgtgagacaaagacatgttgtgagggaaataatctgttagaaatcatatgaccttgattcaaaggcttttgattaacagcaccaacatccgctttctggaaaagaaataaaccctatgattagagcttggtagtccttttaaagcaaataaaacaatattagccattcattaatggatataggaagaaaaatggcttcaaacattaaaaacttctcaagatactttcagctttttcctcataaaggcttttaaggccactggcaaagtttctcctcttttaccttgtgtttctccttcctacttctggagggagacaccgattaaaccaaaaaacccccaaaacaaatggacagcagaagagaattaagacagtctagggcagtggtccccaacttttttggcactagggaccagtttcatggaagacaatttttccatggactggggatggggatggtttggggatgattcaagtgcattacatttattgtgcactttatttctattattgttacattgtaatatataatgaaataattatacaactcattataatgtagaatcagtgggagccctgagcttgttttcctgcagctagatctgggggtgatggaagacagtgacagatcatcaggccttggattctcataaggagcgtgcagcctagatccctcatgtgcgcagttcacaatagggtttgcactcctgtgagaatctgctgctgatctgacaggaggcagagctcaggcggtaatgcaagtgatggggagtggttgtaaatacagacagagcttcacttactcacccactgtttacctcctactgtgtggcctggttcctaacaggcaatggactgataccagcctgtggcctgggagttgggagcccctggtctaggagacctgtgccctagaaagtattaatagattgtgcagtcctaaatggcttctctttttctgtaagttggctttgtaactattgagccttcattcattcatctattgagcatcccctgggtgccagtactatccttggagacatggtggtaagaggacacagtccatgctttcacagagcttatattctagtagggaaggcaggcaagaagttgacaggtaaaagtcatgcttacttatgcaaacccatgataggaactacgaagaaagcaaaatagggaatgggataaagtaactgggtgaagaggcaggactctttggacaggtgatatttgggctgagctctgaatggcaagaagtcagtctgtgaaaatctagggcaaaaacattctggacaaagagggtggcaaactcaggatcccaaaggagaggacaagtttgggatattcaaaatgaagccagagcttagtgggccagtgagagtgtagtgggaggcaagatctacaggggcgggaacctgatctagcagggtggattgtaagtgcagtccaccaagacggttctagctacagctgggtttgtaaagggtctgctcatgcaaggctcattgaaaagcagggctggcccctacctggggacctgatagcagtggcattttttgctattttttaaactgagggaaaggagcagtagtgacttgctctgttgccctgaaactgcaactggtgatctggaccccctggaatatatccgccctgccctgagaaggctgccaaggtgaagcctgtgcagtagaccttgtcctagaccataggagtctctgtgggcctgtcttccattctgagaacagtcccttcaagtcccagtctcctttgtcatccaggtgcagggatagatctaggcagatctgtttctcctcctccccctctttaaacccctactacttgtcatgaccaggcctaagcaatatcagggcaagggtcatggggtcctgccaggagacagtctgggatggaggggcatggtcacttttgccagaagaagcatgactggaaggacccaggtggtgacatgggtcaaaggagacaataatagattgagtccagggaatctgaccacacttgagagactagcttgggcacatcgccaggtcacccaaacagtttcctgagtctaggcactgggaacctggaggaggccacactagtgaacgtgcacattatttatctcttgttctgtacttgaggccatcattcccctgaatgttcctttgaaaacgtagatggctcctgactgctttgccaagctaagaatacagttcttttttttgtttttgagacggagtcttgccctgttgcccaggctggagttcaatggcacaatctcagctcactgcagcctctgcctcccaagttcaagggtttctcctgcctcagcttcctgagtagctggggttacaggtgcgcgccatcacacccagctaatttttgtatttgtagtagagatggggttttaccatgttggccaggctggtctcgaactcctgaactcaggtgatctgtctgcctcggccacccaaagtgctgggattacaggtgtgagccaccacgcctggccttaagaatcaatttttatccacattctcagcttctcattttggtttcaacctatcagtcacttttttgtttacttgccagttttattttgctgtacatccatatatgtatcctatctacatggcaggcaaacttgattattacatttataatcagcaaaataattttaagatcaatgagggttgatcttaaaagaatcaaaataattttaagatcaatgaggatttttaaaaaacaaaacaaaacaccttccttcttgtcctaactagttacgcctcctcctggatcgtcttactgcttatgtgggtaggaggggcagtgcttggatcactaggaggtgctcattgctcatcttgcagggctaccatgtggctcacttcagtcctcttgcatctctcgtatttcccaacaccttaccccctttgggcctgggccattccctcagagcccttccctctcacccttacttggttccctgcatctctcctctgggcttttagttctattcttttgcgtgattaagcattaggtctctcctatgcttaactctggcagcagcaggctgcccttccctggggaccctcctgctcctggtcctggctgggacccactttctcccaggttgcacattcacataagtcactgccagctctggctttgctctgagcccagccctcttcaagcagccctggctccaagtgcacgtaggctgtagcaggagaggaccaagggagttggagggtattgccagttggttggctagttcccaggaggatgagccaagttttcattcatttacctcttcttaagaggagagtggggtgtgtgtgtgcgcgcacgtgtgtgtgcacatgcacgtgtatgtccacttgggggaggaaaatacagagcagtgattctatatctatcatacagataatttttcctagccttgggttcgggacatgaaggaaattgtggtaggaatggtggtgtgaaagaggttcttcatggttggattttcctaagtatcttacgaaaagaggagcctgtgtagagttttttgaaaagttttttgagctctccagctggaataccaaactggtgatttcgcagatgtttttatttaggacaaaaaaaagtgaatttcgtgaaaacactcaagtaattaacagtagagaaatacggcaaacatcacagaggtggtaacagatatctggacccctcagctgggatcaagacacaaatgagcatggagcttatgactcctttcacacgaaggagctagagttgatgttccctgttgtctttgttgtcttcacctacagatggccatgactaccctcgagcagcctaccagcaagtgatccagccggctctgcctgggcagcccctgcctggagccagtgtgagaggcctgcaccctgtgcagaaggttatcctgaattatcccagcccctgggaccacgaagagaggcccgcacagagagactgctcctttccggggcttccaaggcaccagtaagtatgacaggcccaaccttcaggcatttttaacatggaaaggaattatgccaatgcaatgaagatgtaacagaattctctataggtttgctaacccacgttagtgagcaagtcacatagtggaatgcccaatatagacttttcaggtcaggaggaaacggaagctggttgacaaggatctctttatcagacatagaaagccactagtgactagtcgaaattctcttgaaggaaaggctcttcagatgttctccaagtcacacccctttcttttattttcagatcatctgaatttttagtccacaaaatagatttttgattttactacgactgacttccactgttagccaactctttatatgtctagtgtctgttcctgtttaagcctatttcttactttaaaatgttaaattcaattaattttccatcaaaatttaaaattacctgttcttttctttttttgagacagggttttgctctgtcacccaggctggagtgcagtggtgcaaacttgactcactgcaacctctaccttacaggttcaagcgatcctcccacctcagcctcctaagtagctgggactagaagcatgcgccaccatgcccagctaacttttgtatattttgtagtgaagggatctccctatgttgcccagctggtcttgaactcctgggctcaagtgatccacccaccttggccttccaaagtgctggtattacaggcatgagccactgtgcctggcctattattttcttttgtaataaaaacattcatacatgttgagtaccattattaggtctctcctatgcttaactccgtattttcatgacttcagttgtctaactcttcaatcttttttttttttttttttttttttgagatggagccttgctctgtcgtccaggctggagtgcagtggtatgatcttggctcactgcaacctccgcctcctgggttcaagctattctcctgccttagcctcctgggtagctgcgcgccatcacgtctagctaatttttgtatttttagtagacacggggtttcaccatataggccaggctagtctcgaactcatgaccttgtgatctgcccgcctcggcctcccaaagtgctgggattgcaggcatgagccactgtgccctgcctctttaatcattttttttcccttattctctttggactttccttttctcttaatttatggatctaaaatatataggtaaaactcatgtaaatggagcttcctcatttatgacaatatttggaagaaagtagattaaatgtttacttttgctcaaaagcaacttttatataccactgtaaaactagattctgtttttacagcatagagtaaaatatgaagttcctattagagtggatttttcagaaatacagaaagcggtaattagtttgaacatttcatggaaagaaaaaaagcccactttattaacaatggtgaagaggcacatgcctgctttctcttttgctcagaagcccacaaaccctcatattttctttcaagacagatctctttttttctctctttcttttgggacaggatctgactctgtcacttagggtggagtgcagtggcgagatctcgactcactgaaaccttcgcctcctgcactcaagccatcttccaacctcagcctcccaagagtagctggaactacagacgcccgctaccacacccagctaatttttttattttttgcagagaaggggtctcactttgttgcccaggctggtttcaaactcctggcctcaagtgatccacccacatcagcctcccaaagtgctgggattacgggtgttagccaccgtgctgggccagatcccttatttttctaaaccataaatacatggagtttaaacaatggaattaggtaaaatgtgattttatagcaggataggcactctaacagaagaaatatctaaaattccagggaaataaacaaaatgtaagcatctttatgaaataagttttgtgttgaataggaaagagaatagtaatttttaaaataaacttttattttcaaacaattttagacttacaaaagagttgcaaagataatacagagtaattggttttatagcatcaatttaagcctgttctgatcttcttgatctattttatcactttaggataatgaaaaataagttcaggtagaggagctaggctgggcttggtggctcacacctgtaatcccagcactttgggaggcagaggtgggtggattgtttgagcccaggaatttgagaccagcctgggcaacatagcgaaaacccatctctacaaaaaaatacaaaaattagccgggtgtggtggcacatacctgtggttccagctactaaggaggctgaggcaggagaactgcctgagcacaagaggtcatggctgcagtgagccgtgattgtgccactgcactccagcctgggtgacagagtgagactctgtctcaaaaactaaaaaacaaacaaaacacacacacacatacacacaaacccatccaactgaggttgggcatagtggctcatgcctgtaatcccagcactttgggaggccaaggcaggaagtttgtgaccagcttgggcaacatggcgaaatcccatctctaccaaaataatacaaaaattagccaggtgtggtggctcatgcctgtggtcccagctactcaggaggctaaggtgggaaaatcacctgagcccaggaggtcaaggctgcagtgagctgtgattgagcctgggtgacagagcaagaccctgcctcaaaaaaaagaaaaaagaagccagctaattctcctcttactcatagtttgaaagagaactttaattcagaaagtttactctgtcattaatttccatggtattgtttttatacagaagcttttgaatattatcaaggccttaacatttctttatcatataagcaatcatcttctataacaactaagcaacttttgaaacaatttttttggtataagagaatttaatgcaaaagaactggaatgagtttttcttggagaaataaaaaaaaaaaagaaaaagaaaaaaatatggaatgggatcccccattagctgaaagcatattttatagaaattattttctctatattaataaaaatataaaaaataatcttaatcattcatattttcaaaatatagtacagttgagattctgtgtaattttattttaaatcctgttacataagacttttagaattcctgattactccttgggtaaaaatatgaaaagcgtaagcaacaatctacaaaaactgggcatatacatagagattttgtagtcaaaacatttttttaaaatttataatatgacacaatttcaaacacaccacaaataacaacatccatgttcccactacccagattttaagaatgttaacatattgtcacatttgcttcagaatttttttttaagaaataaaacattatagagacagttttagtcccaccaccggttagcacaataccacagaacagggccaccaaagaggctgtctcctctggcggtcaggaaggttgagaatcagaaagccaacaccgctgtgaccactgcaatggttggatcggttctgtgccagatagatctccactggtgaacaatagatgcccatgccctgccctcgacgcttgtgaagctggtaataggacactgggaggccttctggggaaaactcagcacctcatcactgtgcttaccgacagaaaccacagaagcggcagacgcatgctctccatttccttctctcctccaaatctcacacgaggtcatctgattgttcatctcagcagaatgctcgtgggaatactggcaacgaaaataataaagatgctatctaatatggtagcaacttctttaaagggtcttcaaaatcagatttccatttatatgtcaacagtacaaatacttctaaatctacatggccctctttaccttttgatacataattaaatgttacctattatgagctaaaagtcatgtctttttatctgaatgcctataacatcaaccatctgtgtcacctgtcatactactttgttttgttggtgaccttgtctgccctgtgcatgagacttgtttttccaattaaacaaatcttgaatagagaaatcaaatcctgcttccctctttggagtcagagcacaggccctcacatgtggcagccagctgaaacgcttattgactacaactccatggagctcccctcttccttctgtctcagttaagaaatagaggcagaggagagagagcccactgggatcttcccatagttctaaaagtctttctgtccctgaaggtttgcctttgtaaagaatgaaaattgactgtaaatgtattcctttctagggaccagccacatcaccagccacctaatagagctggtgctcctggggagtccttggagtgccctgcagagctgagaccacaggttccccagcctccgtccccagctgctgtgcctagaccccctagcaaccctccagccagaggaactctaaaaacaagcaatttgccagaagaattgcgtaagttgtttgcaacattgttctctccttcctctttttttttttttttttttttgagacggagtctcgctctgttgcccaggctggagtgcagtggtgcgatctcagctcactgcaagctccgcctcccaggttcaccccattctcctgcctcagcctcccgagtagctgggactacaggtgcccactaccacacccagctaattttttgtatttttagtagagacggggtttccccatgttggccaggatggtctcgatctcttcacctcgtgatccacctgcctcggcctcccacagtgctgggattacagatgtgagccaccgcacccggccactccttcttcttgtgaggtcttatactttgtgatggctggatgatcactcgtccctaatctcgaagattttccttttttttaagacagggtctcactcctgttgcctaggcgggagtgcggtggtgtgatcatggctaactgcagcctcaacctcctggggtcaggtgattctcccacctcagcctcccaaatagctggggttacaggtgcataccaccacaaccagctaatttgcttatacttttactagagacggggttttgccatgttgcccaggctggtctcaaactgctggattcgagtgatccacccgccttggcctcccaaagtgctaggattacaggcgtgagccactgtacctggcctcataacctcagctatttctcatgtacacagtaaaataaaatgcacttttttgctttttgcttaaaaagtaaccagcattttgtatgaatgtttttagtgattctgacaccactagtaacactcaaaaactgcttacctctagatttccttaagcacatactccaaaaacaaataaccccagtgccttttccctcttctaaatgatgctcttgagtggacttgtccctgggtaaattgattggatgtccatgtggtattgggcagggacccagcatctcaccataagttagcagcagccatcaagaatgaggtcatttcctgtaggaatgagcaatcttgtttggaaaaaacggtctcacattctccatactgcatcacaaccaaatgcaaactaagccttttatttaaagaaacattcaactaagcgtaaggtgatgattctttttccacattttgctgccagaaccagaaatgttgaaatatcaccaaaatgttctcatattaaggtcagtcaggacagtaatttccagaaatcttaagaaaacagccactacttgtgaaattattatatgatgtgcttgctagagaagctcaggtaattctaatatgcattttccaaatctgggaacctctttgaaccaaacctgaaacaaagccttttgcatctgctaattccttttgggggatctgtgctgtttagtcattgacaactctgaaagctctctatgacaatgattcattgctgttttcattcaaaacattttatttctgaacactttcttaagatcttaatcattttaattttgagcatttctggagaacagatgctgccccacatacattatagtcctgatatcaatctatagatcatatatatcttaccataatctataaaggaagtcctcaaatacgtaacaattgggtgaatgttaggtgttcagaagaaaattgagtgccatctatatatctggctgcttaagtgagttaatatgaccattatacacacttccatttgggaggtgtgtttcaaaaaacctcagtgtagatacagactcgtattttctctccagcccccctttcttctccatcttctgccccaagggcttcctgagatttaagtggtccattccagactaaaagccaacacaaagtaattattcagctttcacattaaaatgctagtcagacaatttccccaagactttagcctgagaaaacactggttcatcctgactgggtaaagcttatccaaactgtactgtctgctgctctaagctgacccagggatgagtgatggagtctgtgatgttggactgcccagaggcagtgtctcttcttcaagctgctgaagtgtttttttactaacatatctgagctgtgctttggtctactccaaacttgctggcctttctgcaaaagtgagtggattgcggggaagaagggagcggggaaccagtttctcactctcctcccacttgctattgtcagaagagcgagatttcagggcagcagagagcatcaggagatcaaaagaagacactgctgggtggtcccttagcaagttttagcttctttgcctgctgggagagtattccttgggcacagtgccaagtgtctctaagaaactagtcatgcctgatcttaagggctcgcggattctgggtggtggatttccttaggcttgtctgagcctgccagtgctctcctctgtcgctctgatttccattcacgctgagcagtctgcactcccttggacagacccactggcattttgggcctgaggagctgtgccctgaggacagcatacaacgtaggcataagctcttagagcaccccaagcccaaggtttcctcttattattctagaaggacaaaagatattgcatataatttagaagtttgtttacaatagaataatttgatcagtttctaataaatgtaaaaattttctcttagggaaagtctttatcacttattcgatggacacagctatggaggtggtgaaattcgtgaactttttgttggtaaatggcttccaaactgcagtaagtattttgtccaaatagataactgaacagttatagtgagtacaatggagagaaaagcagcagaagaaaaagtgtaatagctgttggtgttttaaatgatattatttgatttatgtgattatgcattgaatgcttatagatttaggtaataattttctagattttaagctatctgaagtctccagcatttttttcctgtatgctgtttgagtgaccccaagtacctctgaacagcaagatcagtgctaatgctgaccacatatgcagcggcccctggcctgaaggaaacgccgggctcttgctgcactttgtacctttgtcctttctcaccaatcatgcccactttgtctgagtttcccatgatgcaggaagctgcaggcttcaccatggtcacctgcttatttaacaaggaccttttgttctgcactgggttatgaggtttgaagtagaatcctgcagcctgaatcccccattgcgcacagctgccattttcataccttgacgcagtgatgcttctggatgggtgatactggccaggtttggggctggtctaatccagttccaggggaggctgacctcacccagccctgcaagcccactgtgatcttggctccagaaatctcaggaaacacacactgcccctgtccccctgcagtcccttgacacagtacagcttaaagccatgtaaatttttctctatgataaataaagtaccacatgatgctactcaggggactggctttcctcaaacactgagataacttcttttcctttccagagccctcttctaggccttttctagtgaattctagagagtggtgaaaaattaagggaaatatctatgaatataaatgtctatgggtaaagagggatacttagtaactaaatatcaattttaaaagttatttagtattgtttaacaggagtttttatttgaagctttctttattctataagataattttttttttttttttgagacagagtctagaactgttgcctgggctggtgtgcagtggtgtgatcttggctcactgcaacctctgcctcctaggttcagcctctcaagtagctaggattacaggtgcccaccaccatgcccagctaatttttttgtgtgtgtatttttagtagagatggggtttcactatgttggccaggctggtctcgaactcctgacctcatgatctgccaaccttggcctcccaaagtgctgggattacaggtgtgagtcactgcactcggccaagacaattttctaaaaaatgaaaatgaaagttcttttttaaaaaatgcatacaacttatacaatccaactccataattatatagagactaatatttccctttctcatttctggtataagaaagcactatagcagccaggcgtggtggctcatgcctgtaatcctagcactttgggaggccaaggcagacaaattgcctgagctcaggagttcgggacgagcctaggcaacatggggaaaccccatcacgactaaaatacaaactatggccaggcgcagtggctcacacctgtaataccagcactctgtaaggctgaggcgggcagatcacctgaggtcaggagttcaagaccagcctggacaacatagtgaaaccctatctctacaaaaaatacaaaaaaattagccgagtgtggtggcacatttctgtagtcccagctacttgggaggctgaggcaggagaattgcttgaaccctggaggtgaaggttgcagtgagccgagatctcgccactgcactccagcctgggtgacagagcaaggctctgtctcaaaaaaaaaaaaaaagaaaaaaaagttggcatggtggtgtgcgcctgtagtcccagctacttgggaggctgaggcacaagaattgcttgaacctgggaggtggaagttgtagtaagccggcatcacaccactgcactccaatccagcctgggcaacagagcaagactctgtctccaaaaaaaagaaaaaaagaaagcactgtggcaactgtgacataaaatcaaattacactgggtgtggtggtgcgtgcctgtagtcccagctacttgggaggcagaggtgggaggatcacttgagcccaggagttggaggccagcctgggcaatataacaagaccaggtctgtaatataaataaatactaagacataaggccagcatttcagaaaagatcttactttttgtcatttccaaagacacatactgattgcccctggaggagagcttaggttttgtttgtttatcttcacaaccaggggccacataggcagaatttaaatctgtccctgaccctcatctctatgaagacttgtggtagaaatcacagagcccggtcctggacagctaagttattattgacacatctagatccccttagtggaatgaaacacttaatgagtaatttaaggagagtgtaataaggggcctattacaaagctttgggtaggttttagagagtccaattttattggggatagtgcagtattctggcactagcaaaagcagggagttgttactgcccctaggtctaaagagtcaaagaaggaattcttactggaagatgaagaggatggctatattagtttgctaggattcctataaagtactaccgattgggtggcttaagcgtagaaatttattttctcacagttctggagtctggaagtccaagatcaaggtttcagcagggttcatttcatcctgaggctgtcttctccttctgtcctcacatggtctctcctctgtgtggacacgtctgtgttctaatctcgtcttctatggacaccagttctgttggattagggcccatacatatcacctctttttatcctaattacttctttaaaggtcctgtctccaaatacagtcacattctgaggtagggtagggagatagggcttcaacataggaattttgggaacacaattcagcccataatagtagctgtgtggaggaatgatcataacaggagctatggactttgggagagacttggagaaacaaatggaagatatccagctcattgcaccacccaggatgtccactacagtagctgggaataatttagagtgcttggataataacaataatcactattttttatttatttaattttttttgagacggggtcttgctctgttgcccaggctagggtgcagtggcacgatctcggctcactgcaacctctgcctcccaggctcaagcaattttcctgcctgagcctcctgagtaactgggattacaggcacctgccaccaagctcagctaatttttttttgtatttttagtagagacgggttttcaccatgtttgccaggctggtctcacactcctaacctcaagtgatctgcccccctcagcctcccaaagtgctgggattacaggcgtgagccaccacgcccggccaattatcaccatttactgagtgcttatttcctgcctggcattatgataggccttttccatgttaactcattttagttctcacaaccaccgtaggaagtcagtttattaactacatattacaagtgaagataagatttagagagttttagtaacatttccaaagtcatgcaggtgggaagtggcaaagccaagacagaacccaagctgtccgtttcttctcaaccctgacactatattgcttctctcccatataatagcaatggattagtgacacagtctcagaaagctacaaaagcgttctcaagagtagtcgttggccatcacacatttgaaaacaggagtcatctaaaccaaaataacagccattccatttttcatgtaaagacacatattctgaactctgtactctatgtatgtgatagttcggtatacacagggcatggtctctttccgtaggaggcttagcatcaggttgaagagacacagcagacataaatgaaacatgtcctgaataaaagaatgttatcatacgtgttaattgtccagtatcattagtggtcacaatggggtagagttaggtgaagtgaggaagaggaggagattggcatgtgggaaggattcacagagcaggggggtttgtgctgtgcctttagggtacaggggactccaatgtggggagtaaagtagacaggatatgtgaggaaaagagaggcgaggctggatcatggatggcgaggctggatcatggatggatcatggatggcttttcaagtgatctgcctgccacggcctcccaagtgctgggattataggcatgagccatcgtgcctggcctggaatgacatttaggacaagtaatctgggagcagtgcagctgaatcacgtaacccctccccagggacactctccctgagtcacccattccagtatataatccctcttcccatcaagagcatctcgtaaacacacacgtgcacgtacacacacacacacacacacacacacacacacacacacacacacacacacacacacactctgcagtataagcctgagcccaagaagggccttcttatttggtttcttataaaataaaaaataactgatctttctccttttaaaatatcccttcaaaaacttgaatgctgatagtaaatatcagtcttttcaaggcctaagagttctacttctgactttcatcataaacctcttccctaccgtttcagtaattgtttttgtgactgttccttggctctgctccaagtttcatacaatccttttgaaacatatagattgaaactgtacataataccataataatgacctcactaatgcaagtaaagcaccacaattgtatctcagttacttgtatgccacacatccattaaaatgttccagaattatgtttgcctttcaaatgtctaaattacagatatataatatatgtatattgctggcttatatccaacttagtggtataccgtgtccctcagatttttaaaaacctgattattgtgtagccatagatatattttgatgtgtatcacaatatcctaattatggacataacattaactacttaaatgcctactaatgttgaaatagggaatattttcagaaaattatattttgttttttagacctatgtgctccttcttgcaaaaagcattagttaagttttggagctttaaatgtatatagtattgtgttttcttctgctctgcatcttgagagaacctctcattaagggccaactcccacatctttttttttgcagattgacatatttgaggatagaatccgaggcattgatatcattaaatggatggagcgctaccttagggatgtaagtacattccaaaaaccagagtttgttttctggtgagaaagacaatgagcttatgaagttgttttattaaagaaaccctggcatacccacctaagtctgaagctgagaaagccccaacaaagcctcccttgttggaagccgtgcaaagacttggaaaggaaggacggagtcgccctcttggacatgcacaggcaggaaataacggtcaaaccagacacaggtggttgataacaatcagaggaaacaatcttttgacgagaataggaaagaaggaaatgaaggcggagagtggggagagagcagcagaattcaatttaatctgaggccaccccaagtgttttgtagaattgggctgaagaggtttcctaggcagcctcgcaggctgcacagcacaccacccccgaggtgcccacgtgcagccccgtgatttgttctccactgacagaatctataccggccactgggacacgttgtgctttaacaagatcgaaattgattgctgccagcgtgtccgtgtcggctgcttcttttggagggagccagtgggggacgggagtctcagcaggctggggtgttgcacttttccttttgtctgcagcctgatgtttgctttgtgctgaagggtctgttcctactgactgtgctaatgtgtacacgcagaagacagggcagtcgagtgcagtgactggcagctcagaaccagctggagggagggagggtgcttcttactgttggtgttgcagtgcctttttgccacgacacagactcactcagtgattcgggctttcattagaggtttattagtgatggttgtggaaaatggtaggcaaaagcacatctatttgagagagcccctctctgagccatttgctctgcatgttcaaggtggggctgggctggagacagaagggagaagcagagataagagtctgcctgagtgggggccagtgcttctctttctatggagaatgagcctggccctccaccccgtgtgtcagagaatgcccacagtcctgctggtacacttccataaacatgcctttctccctctcattaacagaagaccgtgatgataatcgtagcaatcagccccaaatacaaacaggacgtggaaggcgctgagtcgcagctggacgaggatgagcatggcttacatactaagtacattcatcgaatggtgagtggggaggggatcacaacacctcactgtcccctggggatggataccttgtccagggaagtcccattcttccccagagaccagctgaaggcagcatgatgctgggtgaagagctccaggcttgccatgtcaggagaggagctgttggttctggctccatctaccttagggactgtgggcaagtccctgcacctctgggactcagttgttcctatcagttgcaaggggagagcaatctgtcatctctaggatccaagattctggaaagacgtgctctgctggcttggctgtttaccagcaactatgaagtcctaggaggcaggagacggggtggtgaggagggctggcccctgcagctgtatcatgttctgtgccctaccttttcagaaaggcaggtggcgtagtgaaagggacacctgctgttgcatcatgtgggcctggttaaagttggcttcctcatgtacaggctgtgtgaccgtggccccactgcttaaactctttgtgcctcaatgtccctattcacaaaatgggtcactaatacttacaggattgtcgtgaagatgaaatgaaataatgttttcaaaatatctggtgcatatcagatgctcaaacaagggaagggagtgttcttagctcatgacaggtggggaactatggggcctggttatattcaaataagtgggagacatttaggatattaaacttgtccagcatgggataaaactagaacattctgaccgaaacaatcacccagcgttggaactggctgttttatgggctacgaatcctccttctccccgtgattatagagacgctgtgagacagtttctgcttgactaggaggcggtgctacacttgtgactttcaggctgtcctgtggagttcccagtgggtgcccatatgtgctggaggaggggctgggtctgcgcctcccacccctacctcagccagagctggtctgtacttctcaggcttgtttgttgaccaaggattctgagatttaaaaaggcttggaaaatcactggactagaactgataagctccatttcagctctaacacttcatgagggggaaggcacctggaatgggcatagagtgtcactaagatgggaagatggggagggcacagtcaggctgtctcggggcacacagctttacctcaggggaagcagatgtaggtcccaggtctgtcctgtgggtcagcagcgtgggaaagtaggagggtgggtattccccatctgagtcttcatggtctctgtctccctttccaccaagtgcagaccactcacgtgagctcacaaccaaactgaaggaagagccgaggcaaggtgatgaggttaaaaagtgaggccagggagtcaggagataaggctccctcctcttctggtctcaaccagtctcacagcccttgtacagtgccccggaaaggtatcattcctgggagtaaactgcctgaaaaggtcatggctggctcggggtgctgccggcccttggttgtctgatgcatgtctgcatggcctcagagcacccaatgtcctgtctgcatctctaggaacctgccagtcccagaagctgacagctggtgcgtgggaagggctcgaggcctcagccagttcctaaggaaacctgtctagctctgtgggtgtgtggtgtagccaggcagtaatacacagcttggcctcagagcttgtctgactgtaccaactggaaccaaactgtcgccaaacttggtttcttgggccacaatgtcttgggcccttactcatcatagaaggggtcgaagaggtcagacacagaagtgccttcctgactgcctggctgacttcctgcacccctctaggcaacagaaaaccctggaacaacaagaacttggccatgacagaggtagtgcagaggtactgatgagtaactgcatcatacagtgaattagtttacagaaactcagtttctggaagggtgagagaaaataaaaatgcactgctgctggctggcccctccacaggctgggcagcctagtgcacaagccaaacttcacagtatacggagtcctagaagtcaaacaaaactcagtgcttcacttgtaacttatgcaccccatccccttcctttcatgtgtactcggtgctggtgtggtgggtgcttctagctgcacagtacttgggtcattttaaaatatgttcttggtgttatcttatggtttttagagagaggtggttccgaaaaaacaccttgtggaggatttgtgtgtgttgtgtgatcgtgtgtgtgtgtgtgtgcgtatgcaactatgtgagagtgtgtgtttatgaggggtttctatggtgatttcaataaccagctatcaccactgtcactttcttctctgttctgttatttccatgcacaatgaaaacttctcagttataaaaatgaattggaagatgaaatggttggaaacacataattcctcgtctccttctcatcagatgactgaaagctttgtgctggtcacaggatttggaagactctaactcccctcctattgaaaattctgatttttgagagagttcttggtagctaaatcttcttgggctaccacagtgtcagagcatattggaactggtgtgaggaacctaaagcctggcagatggagctcttcgcaattgacatcccctctctgccaagcccatcttgtgctctagtcacagtgcattagtagctggtcccaaccacatcaacacactttcacacctccagacatttgctcatgctgttgcctctgcctctgttttccctacttgaccaaaatcttttctttcagtgcccaaatgaaccctcttttgtaactgtccttccaatctctgatgtagaatggatggcccccattctgggcttctagagcaattgttaatacttttcacccggcactctggttggtaatttccctttctgcctgctcactagactgctggctttgtgaagatagggactgtatctgtggtgttctgctaagctggctctcctgatttgtagcacttacctatttccatggtataaatactctccaataccatcgccaatttcaagctatcagtgtgaagtcactgaacacagaattaggaagagatgcacacaacaagcttttgtgagctgctgcaagccagttccagcataccctggaaggtatcctaatccttaaaacccaaagtctgacatagaatgtgacttctaacaggcctccaataaacgactgatgagtgaatggaatagatgtgtaatggggaggccttaaaatgttaagtgtgtggcactcaagtatggaaatcagaataaaaatgccatgtggacgtgcatgattatgggtaccattaactcctcatcctcattcctgaaattaaaccttcacatttgtttggtttcagatgcagattgagttcataaaacaaggaagcatgaatttcagattcatccctgtgctcttcccaaatgctaagaaggtaaacaaacaaagaaacaaaatcctcataattcaatctttggtttgctttgccatctgggattttaaatggaaaaccttgtccattctttttttctttcttttctttttttttttttttgagatggagtctcgctgtgttgcccagcctggagtgcaatggcgtgaccttggctcactgcaacctctgcctcctgggttcaagtgattctcctgcttcagcttcccaagtagctgggattacaggtccctgccaccaagcctggctaattttttttatttttagtagagatggggtttcaccatgttggccaggctggtcttgaactcctgacctcaggtgatctgcctgcctcagcctcccaaagtgctgggattacagatatgaaccaccatgtctgccatcaattctttatcaatccttagagataacaatgttaccagaaagatcaacaagttgtaccactcagttcagcagtatgaatcaggagggttttaaagctatctgataggatcactgctgtcctaattgttcaaagaaccgttgcacacaaagatgtagtttctgttttaactcaagaaagaaaaagagaaggttcatgtcatacttcttatctcttgtacataaaagtcaagatgtgtatggtttttgctggctgttccagggaggcatttcattgcacatagttcagctctcaaagctaatgattacaggaattaaatctatagttacctgagtgaactttgccgtgattcatatgaggcttttcacaccagaagggtctgccagcaagtttggagaatgggggcaaaaccacctgaggccacattccatgcttggcaaagggaaggcagtggtggagtaaacatgttgagaatcagaccacagcaccctaaactcaggccctgtttcaccctggagggatcctcagatgtcaagactgcactgagacccctgccctggatgagggaggctccagtttatgggaacgggacacctcaggctgtatggtgcacagcctgtgcgatggcacacctttctatcctccctgcgctgcctttgcccagggtctcactgctgtcacttactgatgagtctccttactggtctcatctccactttgaccttgtgctagccatcctctcctctgccatcaaagaggaacatccaaaatgtaggtctgatctgtttcttggtagcttacaaattttgtgccgttttcccattgactacaagatcatatccacctttcttagcacgatctatgaggcctctcagaagaggactgtgtccccttgcgtagttttctctcatcaccctctgtagatgctgtgtgctctggtcaccctggaccatttcagcatgccctcacacatgctgtgttcttttgtctctgtgcctttgccttttctgttccgtctgcttgcaatgcccttccctaacttgcctgcctagtgaactcttacttacccttatatcacccaatctctctagcctccccgacacctcttttggttgtttgttttgagacggagtcttgctctgtcatcaggctggagtgtagtggtgtgatctcggctcactgcaacctctgcctccagggttcaagcgattctcctgcctcagcctcccgactatctgggactacaggcatgtgctactatgcccagctaatttttgtatttttagtggagatggggtttcaccatgttggccaggatggtcttgttctcttgacctcgtgatccacctgcctgggcctcccaaagtgttttttttttttgagacagggtcttgctctgttgcccaggctggagtgcagtggtgcaatctcagctcactgcaacctccacctcccaggttcaagcaattctcctgcctcagcctcccaagtagctggggttataggtgctcgccaccacgcccagctaatttttgtatgtttagtagagacagggtttcaccatgttggccaggctggtcttgaactcctgacctcaggtaatccactctcctcagcctccccagtgctgggattacaggcgtgagccactgcgccctgccctgacacctctttaccttcatgctgatatatttcattgtccctttcttaagggtgcttaattctagcaccttgggtcaatggtatgtgtttgggttgagggtactgggaataattgttgagaattattggagcatggcgatatacaaaatagaccaaattttcattggttttgttattatttttaaatctccttcagacaatgcccgtattacctgagcccagcacaggccgctctcaccacctgtccccttggtacaccattgactagaaaatcatttgttgacattttgctttcatcctaagatttgaagtcctcaaggcagtccctgcgtccttttcatttgggcatcctcagtactcagtatgatgcctgccatgcagcaggtgctgcttctaagcacaatacctagagaagtcccgtcctatagtccctaggagttagactcaaaagcaaaggccttatggtggcctacagggcactatccgatacagccccttctacttccagacctctgcacctactcactctgctctactcacagtggccttgttgcttgtgaacagacccaacacactccctccacagggccttcgcactgactctcctatctgcctggacccagacaaccacagagcttgcttcttccactcttttaggtctttgctcattttctcagtgagacctctcctaagcaccccgtttaaaactgcaaatctttcacccttgccccagcactccctgtcccctttcttgtttaattcttctccacagcatacatcactgttgaacacactatccatttacttattatctgcctctccccaccagaacatccactccatgagggcagtctgacactgcacccccaggatccctggctaacagtttctgcctctgcctgatcactgaggtctgatgggctccttctactgcaggccagacctggggctggagtgaaagagtaatgaattgatttaagcctacggccctggcatacttcttctgaagtcacaggggaattcacatcactctgtgtgacctctgtcctaccccttttatgtgagggtggtgaaaagcaagttgaaatgcaaagggtaggtagtctgggagactgacagaaaatgctgtgcacatgtggtttttataatgagatatacagcttgtacccgaagccaagaacatttcacatgctaaacctttccaaaagcaaaacagcacaactcccaggatagtttggtaggaaacgcccatgtagggaaagccagaaatgtttgggaactgagcctgggatctggcatccaggtttttctctaatgacctttgctcctgtcattctgcctcccataggagcatgtgcccacctggcttcagaacactcatgtctacagctggcccaagaataaaaaaaacatcctgctgcggctgctgagagaggaagagtatgtggctcctccacgggggcctctgcccacccttcaggtggttcccttgtgacaccgttcatccccagatcactgaggccaggccatgtttggggccttgttctgacagcattctggctgaggctggtcggtagcactcctggctggtttttttctgttcctccccgagaggccctctggcccccaggaaacctgttgtgcagagctcttccccggagacctccacacaccctggctttgaagtggagtctgtgactgctctgcattctctgcttttaaaaaaaccattgcaggtgccagtgtcccatatgttcctcctgacagtttgatgtgtccattctgggcctctcagtgcttagcaagtagataatgtaagggatgtggcagcaaatggaaatgactacaaacactctcctatcaatcacttcaggctacttttatgagttagccagatgcttgtgtatcctcagaccaaactgattcatgtacaaataataaaatgtttactcttttgtaagattatgttttacttatctcaaaggagatacatataatttataatgatatgggcagttgcttccagggacatcaacaaagctgcttagatataatattagataaatataacagaccactctgtattaatggattaaagccagctagttaaacaaccctttttaaccataatcatggaagctttattcttgcaataaagatttttaggctgggcgcagtgactcacacctgtaatcccagcactttgggaagctaaggcaggcagatcatttgaggtcaggagtttgagaccagcctggccaacatggtgaaaccccatctctgctaaaattacaaaaaagttagccgggcatggtggtgtgcacctgtaatcccagctactcgggaggctgaggcaggagaatcacttgaacccgggaggcagaggttgcagtgagccgagatcatgtcactgcactctagcttgggagacagagcgagactccgtctcaaaaaacaaacaaacaaataaaaacacccatttttaacaaaacaactttatatagcatacagccatgattctaaatagtatgattatggttctcaggatctgactacataggtaaaaatatttgcatatgtgtatgaagtgttgggggatgtaggctagaattgtagtctgtgttctaattttggttctaccaccaattagctgtatgacctttagcaagtcctttaacttttcttagattccagggactcatttataaaatgacatggacaaaagcatctctaatcactctaaaagatttgaagtctaggacctaaattctaaatactcttttgaggagtgactgagttttcattttcataattatgtctctcagaggacaaatttacattttcttaacagagacattttcttcttctttttttttgtttgagacagagtctcgctctgtcgtccaggctggagtgcagtgctgcaatcttggctcactgcaacctgcgcctcctgggttcaagtgattcttctgcctcaacctcccaagtagctagacctataggcgcctgccaccatgcccagctaatttttgtatttttagtagagacagggtttcatattggccagactggtctcgaactcctgaccttgtgatccgcccacctcggcctcccaaagtgctgggattacaggtgtgagccaccacacccagccaacattttcctcttttaaaaaatatcttctcacgcctgtaatcccagcactttgggaggctgaggcaggcggatcatgaggtcaggagatcaagaccatcctggctaacacggtgaaactccatctctactaaaaatacaaaaaaaatagccgggcgtggtggcaggcgcctgtagtcccagctactggggaggctgaggcaggaaaatggtgtcaacccgggaggcggagcttgcagtgagccgagattgcgccactgcactccagcctgggcaatagagtgagactccgtctcaaaaaaaaaaaaaaaaaaaaaaacttcaacaataccctcaggttgataattttggatatctatctgtatctatatatcttgtttacctggtctccagaaaaagaacacatacacatatccatatataaaatatgtatacatgtatcaaatctacgtaaactataaaggtgggatggctttaattatggcccaagctactaagacaatgaagactttttggggctgcaagctactgcttcccttctttatctactagcctcttaaacaaggctcacttgtgctacaagacagtccaccgttttgttttttttttcttttttttgagacagggtctcactctttcccaggctgcagtacagtgacacagtctcagctcactgcagctttgaccttgccgggctcaggtgacccttacacttcagcctcccaagtagcagggactataggtgtgcaccaacatgcttggttaatttttgtattttttgtagagacagggttttgccatgttgtccaggctagtctcgaattcctgggctcaagtgattcacctgccttggcctcccaaagtgctaggattacagatgggagccaccacgcccagcccagtccagctcttatatgtagcacagggaaaggacaaatacttgtcaactataaataagaaacattgctaatgcattgcaaagaacactagtttcatttactttataacttagatgtctactgggtgagacgaatgtctttgttctttaaaaaataggaaaagagaagaaaaactagcataacataagtactcatttgtaagactttctgacatgtaacattagttccgtagttttgagacctggtagaactgactttcatatttggataacctggaaaacacccaaacacaaacttcaagtcttctttctcttttttcattatcttttttagtctgaggtgacaccatcattaaggattcgacacccgtttgtaaataaaatgacatcag

SEQ ID NO: 38085 - DNA, 43274 bp, Homo sapiens; identical to SEQ ID NO: 36014

SEQ ID NO: 38086 - DNA, 5787 bp, Homo sapiens; identical to SEQ ID NO: 37156

SEQ ID NO: 38087 - DNA, 207924 bp, Homo sapiens; identical to SEQ ID NO: 36276

SEQ ID NO: 38088 - DNA, 5980 bp, Homo sapiens
gagcctaggactgagggcgatggctgctgtggccgtggctgttcgcgagggtgagtgaagagccgggcctgcctactggtacgcggagccgacgagctccggacagctagtgccgggccttgagcgcctttgggccccgccgctccgttccagcgccacgctgggctccggtctacacagtctcgagcgcagtcccgcgccgcgcaccggctggttgctgtgaggagggtcggtgacccctccattcctttgatccgccgcgcagtgcgtccccacgcggatccctggctcgcctcgcgcctgccggcggatccgtggtcatgccaacccagcagccggctgcgccgagtactcgtgcccccaaaccctcccggagtctctctggctcactttgtgccctgttttctgatgcagactcgggatccgggatgaaggcggagcttccccctgggcctggggtaagtgaggcttccctcccaagccgcctgccaagcgctacgcaggaggctgtgccagctttattccgccccagctcccatcccgtgtcggtttatttctcagtaaagccaggagattttacagaggtcttgcaaccctagggatatatgattctgtccctggaggagaaacgtcagcctctgtggatgtaagcttgcaacaggtagcttgtggaagttaggaagaactagggatttaaccatgtggaaatcttgtaagcatccaatagtatttgttcccctttggaattgttggggaagagcagtatcctatgtctgtgtctcaggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaaggtgagtgaggggtctcttttaaagggctggggtgtggagctggtagagggatgtggtgggagagataagggagagacaggacaaagttgatttgagcaagtgtgtaaagcaaagaggtttacaaggagagaagctagttttagctggggcacggatatcacctgcctgcagcttgggcatttttttttttaatgcttttagtaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggtatcttcccttcattttaagacctcccttactcctaattataacgccagctcaggctgcccaatagtaaaacagctctcccctctcattcttgggacccagagttctgaattgttcctgcaaccccattatcctatccctatttccttttctaccctattctcccgttttctccacctcatcctgtttttcttgatgccccttataccctaagagcaaattacacatttcaagacctacagtgtcctgaaaacatgatgattatctttcaggagtgaagcgtctccctgagtaccctcaggttgatgacctacttctgagaaggcttgttaaaaaaccagagcgtcaacaggtaggaagtgggtttggtgcctggctagaaagagcctagggaaatggactggagggaggaaaggtgctgggtgcaaagtgagaaggataggtgcttgggtcagagtagtcttactgttcacttcctttccagctttatcccatcctttttaaactctgggccattggtcctgttcccttgttttgtcaaggttcctacacgaaaggattatggatccaaagtcagtctcttctctcacctaccccagtacagcagacaaaactctctgacccagtttatgaggtaggatcctatgaaattgtcataacttttgagtctgaggagttttagtaagtcagtattgaaagtttctagtaatctgagatggactctgtaggaaaaagtatgaacccaaggcagaactgtagaggagtggggaaatctgctagtgaagggagttccttttcatcaggggcaggtgggcagtagatgctcaagctccctttcaaagtatgtgacaccgccatcccatcagcatcccatcctctgtgatccacccagccatggtgcgactcggcctgcagtactcccagggcctggtcagtggctccaatgcccggtgtattgccctgcttcgtgccttgcagcaggtatgtcccatcctgttctctcttatgatccaaccccacctcccccaatactaccccagcttctgtcacccaaggtcatctctgggggacagagggaatactcctaccctcagaacattttcctcagtgaagcttacccccagcccccgttcagagatctttattaaggggtattttgcagatcaccttgtgtaccctataggtgattcaggattacacaacaccgcctaatgaagaactctccagggatctagtgaataaactaaaaccctacatgaggtagggacaacactataagtccactcccagctcgcccaatctttgtcttgtactctttttcctgcttttctatctctcttttcattttgtgttctattttctttttaaagactttttttttaaatgtgaaggctttgtaagttgtgaagagttgcgcagatataaggtattgctgttgtattatagcttcctgactcagtgccgtcccctgtcagcgagcatgcacaacgccatcaagttccttaacaaggaaatcaccagtgtgggcagttccaagcgggaagaggaggtgatgagtatgagaaataaggaaggcatgcacctgtgggtaaaattaagaaacatgttaaaaactcccgggaaggccaacgtaagcctttttttgccctagtcaagggttaaggaatggtttggccattctgacttgtgccatctctgagccctctataggcttgtcatcatacacatattcaagcacctggcatgatcatcagagggataaaagtgtccatttcttgttcactaaggattttactccatttaggccaagtcagaacttcgagcagccattgatcggtatgtgcaagagaagattgtgctagcagctcaggcaatttcacgctttgcttaccagaagatcagtaatggagatgtgatcctggtatatggatggtatggtccagaccttgtgactgagcagattgggagttggaatgatctgaagaagggactacccacttgcctttgggaataagttagtcatcagttactgacatttataactgaatcctcctcttcattcactctagctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtaagtacagaggaaaaggactccaaagttggcggtgaaaaggtgtagtagtatagacataatctcaccttcccaaagttacagttttgtttttgttttgagataaggatggagtgcagcgacgtgatcacagctcactgcagtcttgacctcctgggctcaggtgatcttcccacctccgcctctgagtagctgggactactggtgtgtgccaccatgcccagctagttttttatttttcttgtagagatgggatatcgctacattgcccaggctggaactcctgggctcaagcagttccccctgtctcggcctcccaaagtactgggatcataggcatgagccactgtgcccagccacaattatttaaaaatattagaattatatagccctggcttggtgccatggctcaatgcctgcaatctcagcactaaggcaggaggatcacttgagcccaggagttcaagaccagcctgctcaacataatgagaccctgtacacacacacacacacacacacacacacacacacacacacacacaccccaccccacccccaccccgggcatggtggcatgcgcatgtagttccagctacttaggctgaggtgagaggactgcttgagtgcgtgcgcgcgcgcacgcacacacacacacacacacacagctacttaggaggctgaggtgagaggactgcttgaacacacacacacacacacacacccgggcatggtggcatgcgcatgtagttccagctacttaggaggctgaggtgagaggactgcttgagcccaggaggttgaggctacagtgagctgtcattgcaccactgcactccagcctgggtgacagaatgaaaccctgtgtcaaaaaaaataattatatagctctgtttctatttaattggaaaaacactgacagtatattacagcagtctagctattgcaaaaacattacattaaactagcaaccaggaagagggaacaagacaaaagtaacttcaaagtttacttttcctgtgggagatttggtgggtcagtggtcaggtgttttcacagaagaaaagccatcattaagatttattaggccgggcacagtggctcaagcctgtaattccagcactttgggaggccgaggagggcagttcacgaggtcaggagttcacaatcatcctggctaacacagtgaaaccccgtctctactaaaaatacaaaaaattagccgggcgtggtggtgggcgcctgtagtcccagctaatctggaggctgagtcaggagaatggcgtgaacccaggaggcagagcttgcagtgagccgagatcatgccactgcactccagcctgggcgacagagcgagactccatctcaaaaaaaaaaaaaaaaaggatttattaattgccggactcagtggctcacgcctgttatcctggcactttgggtggctgaggcgggcagatcacctgaggttgggagttcgagaccagcctgaccaacgtggagaaaccccgtctctactaaaaatataaaaatacaacaaatcagctgggagtggtggtgcatgcctgtaatcccagctactcgggaggctgaggcaggagaatcacttgaacccaggaggcagaggttgtggtgagccgagatcgcgccattgcactccagcctgggcaacaagagcagaacttcatctcaaagaaaaaaaaaaaaaagatttattacttgttgtctgtttttgtttctttcccttcttttcacaggtgttgagatttattacttgtcttaatgttgctgtcctgtaagtaggggaccttattttgcattgatacaacaatgacatttttttcttcctcttctcctgtgaaacaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctaggtaaggaggcaaaagagaagcctccagctacctgtgaagacttgagagggagggagaggggcggataaactagaacttcttttctgaaagaacataatgggtacgccttccattgcagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggttaataaatgccatactccctaccctcagc

SEQ ID NO: 38089 - DNA, 15527 bp, Homo sapiens; identical to SEQ ID NO: 36216

SEQ ID NO: 38090 - DNA, 11972 bp, Homo sapiens
gcggcgcggagggcgcgggcccgggagccagggagcgagcggggcgcccggcagcgcggagtcagcgccgcgggggccgcacccgactcgcgcctggacactcgcggggcgccgacctggcagggtgagcccggcctgccgagcctgcgctgggagcgcgggggcctcgaagtcccagggccaaggggagggcgtgggggttccccagaagtttcggacccgggactgggagcggcgcgaggggtccccaagttccagggctggagggagcgcgggggtcccgaagttctggattcagggtctgagaggggactgcgtgggaggttcccaaagttctggacccggcgttggaggaggctgcgaagaggtccccaaagctgcggacctggggtggggtactggggtgggaggggtccggacgtcccggacccagggactggaggggtggcagggggtcctcgaagtttaggagtctaggacaacgcggaggaccggggtcccggacccagttagaggaggagtcacgaagggagtccccggagttaccgacctggggttggaggaggcagaagaggtgtcccccgaagttctggacccagagacagggggcgtcgcgggaatctcggaagttccagggtcagagcccgcgtcccggagttggggcgtgcactgggtgtcctgcctcgggtggggatgggatcctgaattaatattaacccccccgtcccccgcactcgggtgcatgggatggggcctcatccaccggccagattggggatcccgggcaccgggcggtgtcggacccccctccgggagccccgtggccggcggcatccgaggcgcatgactagttggtgagtaactttccccaaacgctgcaagtcgcagcaggagctgccggaccggaagggcctgggttccggggacccctgtgttccccaactcccacccggcgcaggacccgcccccagtccaggccagagctgccgccccacccccactcaggggctccggtttcagaccctgtgaccaggacagcagctgcccaggacaggatagggggggcatcccccctttgaccacagaggccgctgggccagggcctcccctcccccacctgtcttccccctcctccaaactcctccttggtcccctgcagattcggggttgctgaatggcccaatggggaggttggggagccctggtctcccagtgtggattctgctctgccctcatggtgggcattgggattggctgtttgtctacatcttgtctttttaacttggctgggggctccctggggatttggactctggacttcaaggtgtgcttctgccctagggtgggagctgctgggggtggggtccctctgcagggtgtagtggggaactggtctcctggtactacacacctctcaacgccccattttttggtggagagccccgctctggccagtcatgggtgaatgtggtggaaagaactcagcagagatttggcctccacagctcagcctgggatggaggggacttcacgggggtgcaataaccaggacaatgagaaatttacatctggatgtcagcggccaccaggctcctctcagagggccatctcctgtacagggtgttgtgggggcttcccctagacaaagaaagatggggtctgcttgctctgagttatctataataattatcttacctttttgtttctttttataatttctttcttttttgagacagggtctcactctcttgtccaggctggagtgcagtggcctgaccatagctcactgcactgcagccttgacctcctgggctcaagtgatcctcccacctcagcctccccagtagctgggacggcaggcacatgccaccacacccagctaattgtttaaatttttggtagagatggggtctcgccatgttgctcaggatggtctcgaactcctgggctcaaaggatcctcctgactcagcctcccaaagcaccaggtgtactttgggcctctcctgcctttttgattgaaagttccatgacgggcacacctggtgatgggtcctgagatggaacctgcttggcctccctcagcctggcctgagggacactcatagtccctcctctctccctaggggccaaaccagtgctcctgccacctctctggctgccccctagagcctgcccatcccagcctgaccaatgtccacagccaggtgagctcccacctcccccagcctggccctgagctttctaagtgggggtgcctggcccccaccaaacaccctctccccacgcagggagcagccaatcttcagcacacgggcgcacgtgttccaaattgacccagccaccaagcgaaactggatcccagcgggcaagcacgcactcactgtctcctatttctacgatgccacccgcaatgtgtaccgcatcatcagcatcggaggcgccaaggtcagggtggggtctgggtggggcagaggcaccaggagtcctggtgacaaccttgggtctggtggctggcttgctgtgtgcccaagggacaggaaaccctaagccttcccaggccctagtctctatctcctgaaagggttcagagtaaagaccttcaagaccctaatacaaggtaatacctggggggtttcatgtttgttagtatctgtcccatctaccttgaactttgttccccgaccctaggccatcatcaacagcactgtcactcccaacatgaccttcaccaaaacttcccagaagttcgggcagtgggccgacagtcgcgccaacacagtctacggcctgggctttgcctctgaacagcatctgacacaggtgggccgggtgagggggagagtggagggaaccgatgagactgggcccaagtcttctcctgggctcactctgggatcttgggcaggtcccctatcttcccatctgcaggatgggattgtaggatgagttgagactgaagcccctttaagcttccccggtttgattcctagttcatttttctgttttttttttgagataggctgcagtgatcttggctcacgcaacctccgcctcccgggttcaagcgattctcctgcctcagcctcctgagtagctgggactacaggagtccgccaccacgcccagctaattttttgtattttattagagacagggtttcaccatgttggccaggctggtctcgaactcctgacctgaaatgatctgcctgcctcggcctcccaaagtgctgcaattacaggcatgagccactgtacctgctcttgagtcctagttctactgcctgtagctctaattttggacacaccctgctcctctttgggacatcaaatgggtggctgggctgggctgggcactttcccacatgccccagcaataccttcatcctcacctccctgcaccctgtgccgtctctatacttccattattatctttatccgtggttttgttgatgatgagtgctttcacgaagatcttcttctttttttttttttttttttggagataatgccttgctctgtcccccaggctggagtgcagtggcacgatctcggctcactgcaacctccacctcccgggttcaagcgattctcctgcctcagcctctggagtagctgggattacaggtgcccaccacctcgcccagctaatttttgtatttttagtggagatgggattttgttggccagggtggtcttgaactcctgacctcagatgatccacctgcctcggcctcccaaagtgctgggattacaggcatgagctaccacaccaggctttctttgttttcttctagaaggtttagaatttacctttcttctttttttttccctccctccctcccttctttttttttttttttttaacaagatcttgctctgctgtccaggctggagtgaagcagtgcaatcatggctcactgcagcctcaaactcctgggcacaagggatcctcccacctcagcctcctgactagctgagactataggcgtatgccaccatgcctagctaatatctttaatcttattttttttagagataggatctcactatgttgtccaggctgttcttgactcctggcctcaagcgagcctctcactttggcctcctaaagtgctgggattacaggcttgagccactgcacccagacaatttacttttttttttttttttgagacggagtctcgctctgtcgcacaggctggagtgcagtggcgcgatcttggctcactgcaagctctgcctcccaggttcacaccattcttctgattcttctgcctcagcctccctagtagctgggactacaggcgcctgccaccacgccctgctaattttttttgtatttttaatagagacgggggtttcaccgtgttagccaggatggtctcgatctcctgacctcgtgatccacccaccttggcctcccaaagtgctgggattacaggtgtgagccaccgcgcccggccccaacaatttacctttctaatttaggtcttttttttttttttggagacagagtctagctctgttgccaggctggagtgcagtggcccgatctcggctcactgcaacctcttctctccaggttcaagcaattctcctgcctcagcttcccaagtagttgggattacagacacaccacacctggctaatttttgtatttttacaaaatttttgtttttttaatttttgtattcttagcagagacagggtttcactatgttggccaggctggtctcaaactcctgacttcaggtaatccgcctgcctcaggctcccaaagtgatgggattacaggtgtgagccactgcacccagcctaaaaaatcatttatttatttatttatttatttatttttttgagacagagtttcactcttgtcccccaggctggagtgcaatggtgcgatctcggctcaccgcaacttccgcctccccggttcaagcaattctccttcctcagcctcccaagtagctgggattacagtcatgtgccaccatgcctggctgattttgtatttttagtagacatggggtttcaccatgttggtcagcctgctcttgaactcctgacctcatgatccacctgcctcggcctcccaaagtgctgggattacaagcgtgagccaccacacatggccttatctatttattttgagacagagttttgctctgtcacccaggctggagtgcaatggcacaatctcagctcactgcaacctccacctcctgggctcaagcaattctcctgcctcagcctcccaagtactaggattacaggcgcccaccaccatgcctggctaatttttgtgtttttagtagagatggggtttcaccatgttggccaggctggtttcgaactcctgacctcaaatgatccgcccgccttggtctcccaaagtgctgggattacaggtgtgagccaccgcacccggcctaaaaaattatttttaaactaaggaaatttattttaaaaccggggtggtggggggaaacatatcctatcctaactggaaaactggtattgctttgtcataaataggtggtaaatgtaaacatgtaaacatttaatacaacaaaaacaagaatgagatgattactttctcattgacttctgatgtctctcagagcctgagacctaatctctttgttataaaggaataataacaggtgttaaagacagattagcacccacctgaggctctctttgttgaaatagccctgataaagattaaaagggaccccacatgttggctcatacctgtcattctcacactttgggaggccgaggtgggtggatcacggggtcaggagttcgagaccagcatggccaatatggtgaaaccccatctgtactaaatacaaaaattagctgggcgtggtggcacgggcctgtagtcctagctactcgggaggttgaggcagaagactcgcttgaacctgggaggcagaggttgcagtgagctgagatggtgccactgcactccagccagggtgacaaagcgagattctgtccccccccaaaaaaaaaaaaaaaaaaggctgggtgctgtgcctgtaatcccaccactttgggaggctgaggcaggcggatcacttcaagccgggaatttaagatcagcctggccaacatggtaaaaccacatctctactaaaaatatgaaaattagccaggcatgctggtgcatgcctgtaatcccagctactcatgaggctgaagcagaggctgccgtgagccaagatcatgtcactgcactccagcctgggcaacagagcaagactccatctcaaaaaaaaaaaaaacaaaaaacaggaaaagggccattctggggaacatggctagaccccgtctctagaaaaaattagccgggcatgatggcacacacctgtagtcccagctccttggtggaggggtaaggtggaagggtcacttgagccagggaggtcaaggctgcagtgagccgagatcatgccactgtactgcagcctgggtgacaaagtgagaccctttcctaaaaagaggacatgggaattcctttccctttctcaatgtggcccaatgtatttaaatgccacctctgtgatctgatgccacctgcccacccaccatggtacatcatttttcaaagtttctctccttcttccaaggtgtgtgataaggggatgggtacggttcgaaagtggcggggctgtcactgagtgatggtgacctgtttgggaggatgggctggggttttactgtcttttcctccccactcccttagtttgccgagaagttccaggaagtgaaggaagcagccaggctggccagggagaaatctcaggatggcggggagctcaccagtccagccctggggctcgcctcccaccaggtcagcactccctactcccctatgcctgcctgggcacctgtgagtcagccaggcgctcaactgatattgggggaccttgatattgggagaccggggcactctgctggtcgtcaagacccaatgcttccagatgacctaaggttagacccacagcagggaccacagaggagtggtgtggagtgtgtcatagagggtctggaccttgcctggggccggtggggtacacccagtaggtcccagtagcaaaaccagctcagatggcaggatggaagactagaaattgaaatggctaagtgtggccgggtgcggtggctcacgcctgtaatcccagcaatttgggaggctgaggagggaggatgacttgaggccaagagttcgagaccagcctggccaacatggtgatactccacctctgctaaaaaatacaaaaattagccaggcgtggtggcatgcgcctgtagtcccagctactcgggaggctgaggcaggagaatcgcttgaacccaggagatggaggttgcagtgagccgagatcgtgccactgcactccagcctgggtgacagagtgtgactctgtctcaaaaaaaaaaagaaagaaagaaatggctaagtgtgaggcagaacaacgaactgtccctgcgtgttttcccacattaatttattcagcattatttattgagcacctgctgtgtaccaggccgagggctgtgcacaggggttggagagatgaaaaaaagcatgagcctccagctgctgcctgcactgggctgcggtggcgctggcctctcgcagggcacccgccagcttgtctaccctcagagccagtggtccaggcagtggggttgctcacgaaacacgaattcggcctgggcagggcttcctgctgaaatcctaaacgtgatgttgaagttcggcctcagggaagggaacagcagggaggtgtccgattgtacccctcccctaccttacaggttctaagtatcttggtttagactaacctgcatcagacttgctcctgggggtggtgaaagcccaggaaggcaaggtcgagggcgtgggcatggaactcccagcttaggggccacagggagccatggagggtgggtgaggtggggagggacacacttggatcctgtgctgtgaaggacctgcttagggtgcataggtcaattgcacccccgatgtgacgaccccagtcacatcagccttgatcccagctgatgtggggtcgtgacctattcttttccccgtgcctaggtgcccccgagccctctcgtcagtgccaacggccccggcgaggaaaaactgttccgcagccagagcgctgatgcccccggccccacagagcgcgagcggctaaagaagatgttgtctgaggggtgaggggcgggacttgggggcgtggcaggggcgggggtaggggtgggggacgaggaggcggttcttggaagccaagggagtgccaggacggcgggatctaactgtggactcaagacctggggaaggggatgaggatctgaatgctgccccatccagagccgaccccgcccctaccctgcgttggccacgcccctctgttttgaccccatccctgtctcttctcgctgctaacctcgccccgtcgatgcctctctggtcttaggataaccaccctgaccacgcccccatcggctgactctccccaacctcccatccctccctcaacattcccacagtgtcactgggcggactccacgtgcccccttctttgactcggtcctcgacaagaccccgcttctgcgggactgccccatccccaagctcagcaatcagtgtcgccacatccccagccctgcgtggccctgactccgtgccctagcccaaagccacccctcctctggccccgccccctagcccagcatcgcccgtgactccgcctcagcccagcgccacccaccctggccccgccccctaaccgagcattgccgctgactccgcccccagcccagtgccactccacccctgccccgccccctagtccaacttcgcgcacgactccgcaccctcgccagccttcgccctgacctaagcccagagctatcccacccctggccccgccccctagcccagcatcgcccgactccgccccccagccccgtgtcacccactgccgaccctcgtgtctctgcagctccgtgggcgaggtacagtgggaggccgagtttttcgcactgcaggacagcaacaacaagctggcaggcgccctgcgagaggccaacgccgccgcagcccagtggaggcagcagctggaggctcagcgtgcagaggccgagcggctgcggcagcgggtgagggcacccctccctccgagagacccccacctggcccgggcaactgtggagaccgcgcctcggcagttcccatctgccctgggttcatggactagctgtgtgacctcagcaggtcactgacccagcctcagtttcttgctctgtaaaatgggtttgagacaatgccagcctcagagggtgatcagacactaaagtccaagctgtgcagaggggggtggtggcaccaaccaagggagatgggtgctcggtcctgggcgtggccagacaggaggcagattccctagaggttgggcgagcaagggagagtgcaggcgggggcgtcaggggctgctattcctgccctacaggtggctgagctggaggctcaggcagcttcagaggtgacccccaccggtgagaaggaggggctgggccagggccagtcgctggaacagctggaagctctggtgcaaaccaaggaccaggtgagtgccaagtgtggttcctgggcctcgccttccctcacctcctgtgggaaagccaggacccccgcaacagaccctgggaactcttctcctctaggagattcagaccctgaagagtcagactggggggccccgcgaggccctggaggctgccgagcgtgaggagactcagcagaaggtgcaggtgtgtgtgggcacaaggaggtggggtgacggtgggtgacagtcacctcaacagacactcaggacaatatctacctaagatgataaagtattgggaggcccagtcctgtggaaggcctgatgcccagcaggtgccgcgtgaacagtggctgttggtacagtttcatatccatctatgggttcaacaagcaatgcttgagttcctgctgtattcccatgccagaccccgtcaattcctcctgttctcagcctgagatcacagagcctgcattggaactaggtctggcttggcttggctttatttttttttaattctttgagatggagtctcgctctgttgcccaggctggagtgcaatggcacgatctcagctcactgcaacctccacctcccgggttgaagcaattctcctgcctcagcctcctgagtagctgggattacaggcgcccgccactacacccagctaattttttgtatttttagtagagacagggtttcaccatgttggccaggctggtctcaactcctgatctcatgatttgcccgcctcggcctcccaaagtgctgggattacagacatgcgccaccgtgcccgggcattttttgtgtttttagtagagatggggtttcctcatgttggccagactggtctcgaactcctgaccgtgagcaatctgccctcagcctcccaaagtgctgggattataggcttgagtcaccacgactggccttggcttggcttttgctaaaggctttatctgagaaatgttcagggggtacttttttttttttttgagacggagtctcactctgttgcccaggctggagtgcagtggcgcaagctccgcctcccaggttcactccattctcctgcctcagcctcccgagtagctggaactacaggtgctcgccaccatgcccggctaattttttgtattttttggtagagacggggtttcaccatgttagccaggatagtctcgatctcttgaccttatgatccactcgcctcggcctcccaaagtgctgggattataggcgtaaaccactgcgcccagccttttttttttttttttgagatggagtctcactctgtcacccaggctggagtgcagtggcgcgatctcggctcactgcaagctccgccttctgagctcaagcgattctcctgcctcagcctccagagtagctgggactacaggtgtgcaccaccatgcccagctaatttttgtatttttagtagagatggagttttaccatgttggccaagctggtcttgaactcctgacctcaggggatccacctgcctccgcctcccaaagttctgggattacaggtgtaagccatcactgggcgtggtggtgtatgcctgtaatcccagctacttgggaggctgaggcaggagaattgcttgaacctgggaggcggaggttgtagtgagccgagatcacgccattgcactccagcctgggcgacaagagcgaaactccttctcaaaaacaaacaaacaaacaaaagaaatgagggcagaagctaggcccctgtggggtgtgcattttattcctggtgtgttgggcgccctaggatggctctgggcagaagagggacatgaaggtggtcagactctggatgcctcgggcaggactggtgatttgttggggcccccaaccctgcccaccctttcctggcaggacctggagacccgcaatgcggagttggagcaccagctgcgggcgatggagcgcagcctggaggaggcacgggcagagcgggagcgggcgcgggctgaggtgggccgggcagcgcagctgctggacgtcagcctgtttgagctgagtgagctgcgtgagggcctggcccgcctggctgaggctgcgccctgagccggggctggttttctatgaacgattccggcctgggatgcgggccaggctgcaggcggcatagttgggcccattcgtcctggaaagggactggggggtcccaacttagccctgggtgggccgggccgggctgggctggggtgggccccagtcggctctggttgttggcagctttggggctgtttttgagcttctcattgtgtagaatttctagatcccccgattacatttctaagcgtg

SEQ ID NO: 38091 - DNA, 11677 bp, Homo sapiens; identical to SEQ ID NO: 36506

SEQ ID NO: 38092 - DNA, 3222 bp, Homo sapiens; identical to SEQ ID NO: 36126

SEQ ID NO: 38093 - DNA, 647564 bp, Homo sapiens
gcggccgcgctcgtctcgccgggctgttcgcgggcaggccctgccctgaagggacgaatcggcttggagcgcgggaggtggagtcggccccggcggtcgctccctggacccaacccgaggctgacccaggcccctgcccatgcggggcgcccctggctcggaagagtcccccgggccgggagcagctccaggcagcggccccggaggaagaggaagaagggacagtgctcagcttgggggacccggaccctcgccgcggcatttggagccgggggcagtcccgaactctgtgcttggcaccgccgctccgagtagggcagcgcctgccgggaccctgacccggaccccctgcgcctcgtaggcggcggcgccgccgcgccaccctgttcttccgtgtctccctctgcctggcggcagtcacggccaaggtaagagccccggagcgcgagagtcgccgcgggggcgccgtggtgtgtagcgccggacaagttctccgaacctgtggctggtaccccctgtactcgggatgccggcggggaggccgggcacaccctctgctgccccggccgggagccctggagaggctggaggtggaagcccccagtctccgaagtccccaggaccccctcagggcctgctcggcttctgggcacacaggctgctggcagggagcgagccaggaggagtttctggttaacaccacgagggcatgtgaccgatacccgcacccccggccctcttgttagcggtgagcacctgtggttcgcggagcctgccgtgtttggagagggccctgttgggcggtacgcaactacctttcgtggtgtgatgctgtgaataacttttcttgttccttcttgcagacagtcctgcgcaatttgggggcgagcagccacagcttgcgagtccctctttaggacagagtggttggttggcattgctatctgtaggggggaagcccagccagcatgtccttcctgttagtcaaagctgcttgtgaggagtgatcagtgtatagctatccagacattcttgtaaatgtcactgcttttgaagttttggagtgaggactccaaagtttgtgtatcctcaagttattttgttcattgccttatcctcttttaaatgttcctcttaaggaacctcagttgtacaagcctgtccttgcctgtttgaaatttattaaacctgtgagcttcccccagaacaatctgattttaaatgggtcacttcggagggaacagattgtctcttgcacactgaatccatcccttgggtgaccctgtttaatggggttggactctttttttttttttttttcgtctctgtgctgatgtgcctcggttgagcaggtttctgctgaattcagaatccgtgaattttgtcactcagtccattaaaatgatctcctgagggagcaaaatagcagcttacatttttcgtgaatgtcactggaagttttacagggtcttatgtaagtgcccagagagagagagagaggagggagtggggggagatcaggctcctgcttccttcaaggggagaaacggagggggtggcaggtgggggcgtccgcctccctgacatgcagatgcctttcttctctgacacaggtgtggagacctgaagtgcttatcattccgtggaggcagtcacctcgggttaatttttcttctcacttctcctgtcttcccacctcaggagtcagctttgatagacttaagataaggaaagcttctaaattaagaagggaacaagtggtggttgtttcttctcccatccctcacaaatgggtgacatgaatgaattactcactggcacgcttggtcctccctaggggtaaaaataaaagaaataaaaacgccagctttaagatttcacacatctcttagtgtacctttattgttcaagagtactttagtgaaaattgcttgtggagaacacatttatcgagcctgtccctgttaattccataccaggaagaaaactcactcgaacagagaggcaaaaatcaccaagatttagaggttagtgggttttcaagagtggcgaggaaaggaatcaaatccccctggcaggagagagaggtttttaacgggaagatcggattgctctggagtgagcagtagctgctgacaagtgtgggccctcctgcttcacttaatgaagtgtgctggggtgtggattaactttttgatgtgagccaatgcagattcctttggcttttaaaccatacctggaagggccttagaaatgaaatgaaaggtttttttcatctcatcataggtctcggaagtgcttccatctcttgggaaggttgtgacgaaggtttcctttgtttctgggttcctgagctgcgctttaaagttgatgcacagtgcagggagggtgcgtcctgtagtgtcgccatccttcagccacctacagtagcaggacactaggggggactagttatcttttccaccatcgaagaagaaaacaccagggcccatgttactgtggtttatcttgagggttcatgagcctgtggtttatgttgagggttcgtgagactgtggtttatcttgagggttcctgagatgaactttttgggatctagtacatgcttgcactagtgagtggattctgagtgcctaagggatgggcctgctcacatctaaattgtcatttggacaactcagaaccagttaactgcaaaatgttatgtgacattctgaaaagactcagttataatctctaagtatttaaggactacaaaaaggctctatcctttgaatattagaccatcctaactttaagttccctaacagtttgtaatcaacacttttggtgtttggtttttgactgcatattccctgcagtcatcataaaatcacatggcttcaaaatgtctctgcagtggactccatcaaacttaaaattccccttaaaaatacattccgtatacttagagatgttaacataacatttgacggtgtagttgcacttccacctcagacgctgtctgcacttttaatagtatgaaatcattaatgtccacagcccttccagcagaattggaagataattctacttccctgaagaacactgactgccccattgcctaggtttacccaagtagctaagtcttatcaaagctgatcccagaggtgggagtagcggggagacaggaaagatgcaaggtagaggccaagaagagcctgcttagtttagaatactgtcacaaaaacaggcagatatcaccaagatgttggtcacactggattctaaaaggcccagttcagcatgtagagttagactctgtttgaaacctgtgaacccacctgagttattacttttcccttgaactctggggtctggtagacggcatttgtgaccctttacccatacgtgtagtgcacatttaggtagttgaaggggagctattgttgtggtctaggaaaaatggtcagcagacagctttatttctaacattaagactttatagattgattctcttgggcacagtacagccaaggggtaagagattggaacaggaaaataccatcgcatttgccattgagcaccaacgattgaagaccgatcctgtggagaatatatgctgtcatcctgagacatgaatgaagtcttatgaatttgatggaagccaggtggcagaagtagaggcaggaggctggccttccttacggtccgtgaacaagatgaaggtgtctttttggctagagattctcagaaaggaggagcatactgcattgggggtgggggatataagacccaaaaggctgagagctctagacaccctgccactgacacacctcggggatacagccaccttggaaaatctgcttagtgttggtgaggtcgctctacatggagtatttgccattgagaggtgttcagcatttctctgtcacattggcgtatggagagtagcaggcagcaacgagtgaaaggcttcgttaaatgtattttataagacttttcatcttttcgtttaacaaataataatagaccatctaccctgtggcaggtgccatgctctgtgtggaggttacagagtcaggttacatttagcttctagtcttttatgggaggcagacattcagctatttgtttgtttgtttgttttttcttttttttttgagatggagtcttgctctgtcagccaggctagagtgcagtggcatgatcttagctcactgcaacctccgcctcccgggttcaagcaattctcctgcctcagcctcccgagtagctgggattacaggcgcccgcccccacgcccggctaatttttgtatttttagtagaggcggggtttcaccatcttcgccaggctggtctagaactcctgaccttgtgatccacctgtctcggcctcccaaagtgctgggattacaggtgtgagccaccgtgcccgggccagacattcaactattattaccaggtaagtactatcctgcagacttgttcaagggatgagtttgaacttcccaggagagtagggaggaaggggatcacaggcagaaagaacagcatggaaaccctaaagtatctattgtggtgtgtatggagaatagtcatagttagtgtggctggaaggtgggatgtgcccgaagagggaaacgcggtgttagaagagaaataatttaataagattccatgctgaggactgtgcccccgcttcttgctctgtgtattcaaatagtggcaagaatggttgcgagataaaatctgagcatgctaactggttatcccacattgttattaaaaacagaaaattttttcttttgtccgttatcattctacgtacagcattttgcctattctttaaaaaactattagcaatgcaaataaagaaagggtcccttatcaaccctaagtctgccctcttgtgtacatgaattacacctggcactttcattatgtcattatgcagcagtgggaaaaatgacaatgttacttgacaaatgatataatatgaaaaaaaaaacacttaggtgagaacaaattccattttatcagatatgctctgggtagagttatggttgtgtttaacacctgaacaagattcatattatgatcatttcagttctagtctaaacttcctttgctgttagaaaagaaagagttttgaatattgagaatgggagggtaggtgggcatgtgtgcatatgtgtgtttcttgggatgaggaaactatggtgaggaagagcaagcaacagtgtaactgcctgaaggatattagatagagaatgtggaaaatcacagttgtaaaagcagtctccagggccaggtatatttagtatagtttttagaaacagcagccagaaggataatgggaataaaagttagaagcctctctctctctctctctctctgtgtgtgtgtgtgtgtgtgtgtgtgtgtgtttgtgtttgtatgtttgtcttgtctctatcatccatccctatgttgattgggagacaggatgctttaatcaagccccaggggatcaggggtttagtcttacagcatcctgtgctaacttgctgtgtgaccttagaatatttcttggcatctctgggcttcaggcgctgtctctatacattagtgtgttactgatcttgtaagtaggaatttagaggcccagggagggaaagggcttgcttcagtcagttagcttagcctctacactgagcactctttaggttgtctagttttctccttcttaaatggaaagaaagaggcctgaccagttcataggtgcactcttccttgaaatataaagcactgcaaatacacaaggctgaagaaaagaatcacaaagtctttgtgattggtcatagccattttcataaagcagcagccagacttgccagctaacttattacctatggtggaaacccgttagttctgaaatgttacactgttctttgaccactatttgagaattaagtgctttgtgattaaaaacaacagcaacaatgctgaatcttgtaattatttcataattaagtaaataaaagctgaggtgacctctccggattttgcaaagccctgaatgtaacttggaaggggaaacccattcatttggcctgaacgggagattaccttgtaggggagctgctgggtgaatatcaaaggtcttttgaagaaaaacagagtagaagagcaattgggtagatacacaagtcaggaaaaatgcaaagtgacttagtttgatgcctccaaatgtgtgagttgctagaaagagggctcctcactatggctgatctcctgggggtagaggaaagaggagatctgaagtaagtgcagtgtaaatagaaggtttgttacattcttatttgggagttgaagccaagtggaggagtgctgtattttaggagaagtgggcatataaaatgtgatcttaaaactaaataatttgagataagttaattgcagtacaaaaagatttttaccttactaaagggattcatagtgagtctccttttaatagctaattccgttattatatttcaaattatttgatgaacacaatcatgatagacccttttgggagcctcacctgttatgcaaaaccaaggacttttcggttgggcacagtggctcacccctgtaatcccagcactttgggaagccgaggcaggtggatcacgaagtcaagagattgagaccatcctggccaatatggtgaaaccccgtgtctactaaaaatacaaaaaaaaaaattagctgggcatggtggcgcgtgcctgtagtcccagctactcgggaggctgaggtaggagaatggctcgaacctgtgaggcagaggttgcagtgagttgagatgccgccactgcactccagcctggggaaagagcaagactccttctcaaaaacaaaaagcaaacaaaaaaaacaccaaagacttctcaaacataaacgaatgttttaacaaataacccgctaggagcctaatattcaactgtattgcagaaagcagtacagtggttatgtaaactgtcattaccgctaacctaacacatggagttacatcacttacttacttttggcagattacttatttaactactgttctgcctggagataacagtactcacctacccaccttcataagttccttaaccacccgcacattctacctctaagaatatatcaagaacaaaagtggtttaaaaagtaaattaggtaagagtttccaggattctgagtttttataattgcagagacatggaattcattttgttctgcttgagtatacaggagaggcggtgtgtatgagacattaaaaaatatcaaaatcaggccgggcttggtggctcacgcctgtaatcccagaattttgggaggccgaggtggggggatcacctgaggtcaggagttcgagaccagcctggccaacattgtgaaaccctgtctctactaaaaaatacaaaaattagccgggcgtggtggcgcacgcctgtaatcccagctactcgggaggctgaggcaggagagtcacttgaactccagagacggaggttacagtgagccgagatcacagccattgcgctccagcctggaaacagtgagacttcgtctcaaaaaaaaaaaaacatgcttgtctgctggttcttccttcactgtaacagaaatatctagggcttttttttttttcattgttgttcttcctttatctcttatgaggctttccaaaaaagattttgttctaggaatggaataaactgtagggcgtttaaggcttcagaggtaattttgggcaacctggagttgcaggtaatcacaggctggggctggaattgaaaatgcagtctcacccataatttgagcctcttttgtcgcattatggggctgtgccttggacaggcagcagacgcagatggagatggaaccctgactactgagagagctttgcttttaacatagtccttttctgaattaccaaggccaattgggaagaaaggacttgccgatctttccagctctccatggtagccatagaatttaggaagatttacagcagaacgtgggcatctagggatttctttcttccttttcttttttttaaattttaaattcagaagggaatcttgggctcttgagtgttattctgtggttagggattgctgcggcttccttggatacattaaatgcatatttgttattattgagtaaggttaaccttgctgcggctaactcgaagccatcccctccccttttgtttttagaacagttgcgtagatccttcatgtgccaacactgtttgtttaagagccttcttgactgatgtcagctctcatctggaaatggcattttgtggttgtttcagaagccaagggaggcatagaggcaagcccataggccggtggggctttacctttcttcaggagtggtgctggtgcttagtaggtctgcagttagtaagtagttgtgtccacactgaatgatttgttttgtgaatgaatggtcatgttttcattactggggtggaggtgatgcgggagggagaggtgggtgagtaacagtagacttaaatggtgatgagatagacttgagctcctcaaggcgtctcctagcagcttttgttttaaaaatgtgaaggatatttcagatcagcagaatgaattctctgaaggatcattgttgtggttcaaacattgatggctttgtaaaaaggcaaggagagtacaataccgaaatgcgtgctttctttcctccgagtttgtagggattttaacttatctggaatgagaagaatggacatgctgtaaagcttgttcacatttacatgacaagttgccttgaaaatgcctggaaagacattttcaatatgagaaactttaggatggttgttgtccagcatggatgacgatgattatgaaatgacttaggtgtagaccggcgctcccatgtcaggaggatgaagtggacgtgggagaatggagggagggactcagtacttggtccccagcaggaagaactctcctcgaccatattggtgtctttacccatttcccaatatgactccctctctgctgggtttctcagttacaagagcactctctgatgccttccgtctgtaaggcagagctactgtattgagagactaccaaggctggaagagaccttggagccccactagaccaacaccttcattttacatccgtagaaactaaggccagacctaagggaggtcaagatgattattcagaggggaggtggaaccagaacctaggctccctggtcctcagctctcccttctctgcagcatgctctgcttccatccaatctgcacccaaagcacgttcttccagtgtttcttttgtgccaggcactctctcattcggtcatttttgttatttcattctcacagcaaccctgggagggggatgtgctcactctcccacttcacagatgtggaaactgacgcttgtgcaaggcccacagccatgaagaaggagccaggactcaactcgcagctgttcagactcctcagtttgttgttccaggaccgaccttgcccctggcttccctgcctctctgacctcgctgtatttcctaggactcctctccaggttttctttgttcctagcctactaggcttcacctaaaaatgccacttgttttcccacttgagtggccttgttacgctgctttttttgctggatccaaccccccatcctctctcttgtctctggctgaaatcgttcctgactgtaggctctgtgacactgtctctttgtggggtttccttcacttgctcagccaacgttgatcaagctcctactgtgtgcaggtcctggcttgacagcggaacacagaggtgcagagttactcatcgtccattcaggagcctcgtcttggtgagggaggaagagtctcgtaaggggatgagtgaaagtcaaagggcccagaggacagtgtgttgggtagcattctgcttgaagaagtcaagatgagaatattagatttgggtcttagtgattaggagatgggaggatagggtaggaggaggcgtcaccaaacagcaaaccaaatcaaaggctgtgcttggccatcttcaactaggcattgtcagtatctacatactttaattcttattccttcacttaggtattagaggctgtgagtacgttacacccatccttatatctatgaaagcaccttgcgaagctcttagtacttacgactcctccactcaacatttattatattaaattcagagcttcctgtccctgccctcgagggacatagttggagagcttgcaaaaaatgtgtcataagttaagcaacaatagaagattaaatgaacagttacgagcaacaatagaaaggaggtagcagtgtagtgaatggatgtgtgcactgtggtggctgaacacggatgggaagtcagaggtgggagcttcctttagcttctcaaactcaaaggaggggtgggacttgagttgggtctttggatacaagacagttaaaatctgaatggaaggattaagggagggtagtttggcaagcacaaatatattttttgggttggagaggaagccagcttgggtttctgttagcaaggagttgcagatgaagttggtgagttaggccgggcgtggtggctcatgcctgtaatcccagcactctgggaggctgaggcgggcgaatcatgaggtcaggagatcgagaccatcttgactaacgcggtgaaaccccgtctctactaaaaatacaaaaaattagctgggcgtggtggcgggcgcctgtagtcccagctactcgggaggctgaggcaggagaatggcgtgaacccggaagtcagagcttgcagtgagccgatatcatgccactgcactcctccagcctggatgacagagcgagactccgtctcaaaaacaaaaacaaaaacaaaaaaaaaaaaacaaaagaagaagttggtgagttaggggctgtgggctttgggaaggcagggtgacttttcatcagggggatgtggtgtgctaaaggccctggttttggaaggtgcacctgcatcgtgcctgggacaaattgaagcggggagagatggaggctgggagacagctggacaggattttgtaccagttcatatatgaagttctaagggccgccaggctggaactgttacaggaggacagaagcccagggaggcttgtgaatttttctctgttgaatcactggctcacaaacatttgcttgatatggaagtctgagatggctttcattgcccactgtaatatggccttgttggaataaagtccactcgtgacacaagcagcaagtcttaaaatagcgctttctcctttggcttggcttggggtagagctttggtgaaaatacacttttcggggcctctcttattgggggtttgttcaaatgggctcagggttatagaacaacctttttcctagccttggatggcacccaataaggggtataatagagaaaattcttcttttcctcatgagtggctcctaaagcagctgcgtggagctgagagcaaagtgcttggagctctgacatctgggttctggattcaccttaaaagtgaagccaatttctttgcttcctgtgacggctggtgtttctctgtctgaggaggagcttgctttgagattacggtacacacttttcagcattgtggggtaagccattctggataacagaatttctcaaataggataatccaatcccttacagacagcaagtctttatttttaatctttaaggaatgagggtttctctaggatgttctgtgtacttaccctcactggctcaccatcagcccctggaaaacttcagctgtcatattgggacgcacaaagcttgttatgaaccagccctgcctttctctgcagtctcaccccccacccctggccaccccccatttcatgcatcatcaatctgtaacttaatcattttcttctttactgatttttttccccctagacctgtcaagctgtgcacatacccctcctgcccggtaagctctttccttctttatctgcctgggacacttgtgtttttccttcagaacccagctcaggtagtcctgcctcttaagcttttcctggtactgagcactgaaccgcatctgcacctcagtctgacttctgcagctgcactttctgcgccgtaacctgactgttttgctagagagcgggagcctttcagtaaaactgcatctcaggggatcttctaggttttaccgtatgcctggaacatgcagtcaatacaataaatggttgttgttgtcgttttagatttcagtgaatttgctggccaggcataatgtaaccctttctgatgaaacctcgagtgtcatactgtgctgcagtggtggatgggttgatgtgaattagcctctcaaagtattccggaatctaaagaaaaccttccccctctcaccaatgaccagaatggccattgggcattcctggggtacactgatgccttcaggaaatctggtggtgctggtgaggtagaatgcatcttagtcatcactgcagacctagaaatgtcttcacacaggccgggcacggtggcttacgcctggaatcccagcactttgggaggccgaggcgggtggatcacgaggtcaggagattgagaccatcctggctaacatggtgaaacccggtctctactaaaaatacaaaaaaaaattagccgggcgtggtggcgggcgcctgtagtcccacctactcaggaggctcaggaggctcaggaggctcaggaggctgaggcaggagaatggtgtgaacccgggaggcggaggttgcagtgagccgagatcgcgccactgcgctactccagcctgggtgacagagcgagactctgtctcaaaaaaaaaaaaagaaatgtcttcacacaagctctcaagggctgagtattgaagtggaggattagcaggtaggaggacttgaagaaccttgtaccttttatgtttaatagtattccccatttaaagagccagatgcagaatggcagtcataattgatggagaaattatcagacggtgatggggactggctagggaggatcgaataaatttgtacaggagcttagcagcagtgcctaaagactcttctccacataaccacatgtttatgttagaatatttagtattgcctctagtattcgtgaggtccatttgggtttttatggcactgcccttgtaagccaggcgtgagtgctgcatgaataggtttgcttagcaaatcacagaggagtgacagaggagccctgggcttatcagaaggtttgtgtgatccaggcactagcaaaactttatgaacttgcacttggcacgtggtgttggttatatggttcaggaagccctactgcttctccagtagtggtctgatttaatccataccaaggggtgcttgttctgggtcttagcttttgccattttcctttttcttctgcttggaattatctataactcctttggaaatacagcatttttgagctcattaaatttgttaatgtgtgtattatgttgagaaagcactcagttatttagagttgcttcattccctttcccttcatctctttgccttccccaccttagagtaattgtgcttggttaaccaggaaaccaagggctcctggggatgaagaagaggccagtctttctcttcttagccctgtccagagatctcagaaaatttgcagaggccctgaaggtaaaagcaaatggttgcccactaatcacctgaggcagtttttcaggagttttctgtctaccttgcacttttctctcataggaaatttgggctctgacagttaagagagatggcagccaatgaatgggataggaaaggccccttccttagcagtttgtaagaaaaggtactgaggtgtgctttacaagtattatgccttttgacagctctctaagctgagtagtttcattttacagctaaggaaactgaggcttggagaggttatttgctcaagcaataaagcccagagactggaaatgaattttgttttcagaatatttgcttttaatctctgtcctataatccaacaacccaggtgtcctaatactggaaatatacatacccctgggaaatacatgaagacttttcatggagtatgcagatgtggatacttctaagaaaataaattttcacatctccagcctcacatatgtgcccttccctgaaattgatcagcctgagatgatccctgtctggtccacggttctcccaatcctcctttcatggttatcctccctcattttgtttatttttatttttatttaattaatcaatttatttatttttgagacagagtctcgctccgttgcccaggccggagtgcagtggcgcaatctcggctcactgcaacctccgcctcccaggtttaagcaattctcctgtctcagcctcctgagtagctgggactacaggcgcctgccaccacgtctggctaatttttgtatttttagtagagatggggtttcaccttgttggtcacgctggtctcgaactcctgacctcaggtgatacaccctcctcagcctcccaaactgctgggattacaggtatgagccactgcaccaggccctgtcctccctcattttataaaggcacatctcttagccagaactagtcttattctggcatgttgctctgggtatgaaaatctcaagggtcacctaacaaagggactatttgaaattggtatgttgaggtccttctaatcacagcaatgccacatggttgcctctttcccttttgtcttttacgtgttgaaacttggtgccagaaacagggcatttaagcccctttctcatgtgagagaataatataacattttcagttcttaaaaaataacttgctgttggatttttaaaatgaatgatggctatcagattgctagattccatttaaaactgtgatgtgaaagttttattttaaaatgttaatgtttacaatatgctgaaaattgtatccttagaaattgtgtagttgaggatgaaaactttatgtcagcctaaaaataggcacggcagtacaagtttttcaaatttcagaattcaagggcccaggcatggtggctcatgcctattatctcagcacactgagaggccaaggtgggaggatcgcttgagcctaagagttcgagaccagccctggcaacgtagtgaaaccccatctgtataaaaaacagttaaaaaaaatcagctgggcatcctggtgcatgcctgtggtcccatctactcaggagactgggaggtggattccttgtgcccaggaagttgagggtacagtgagccctggtcacgccattgcactccagtctgggtgacagagcaagatgctgtctcaaaaaaaaaaaaaaaaaaaaaggaattaaaaaaaaaaaacttaaatacctctgtactattctgtctcagatactgaagtttggagtgggtaatttttaagttgatttctgccatagacccttatacacctgaatatttttttccataaaatttaaaggacatcagtatttcctaaagctcatacattgccctcctgattaagcacacttgaaattctgttgggtttcaggataatgtaaacatcctttaaatgttgatgaaacttttacacatgtagctagtcatgtgatcgtgtatgccagagtgcctcaatggctcactgaggactgtttcaggtacaaattatagaaacctaactcatagtgatgttaaataaccattccactttatcttcttaagtgactgaagacccgagggcagcgtcaggcagggctggatctaagtcctcgaacagcgtcaccgactctactgccccacgcctggctctgccttcttctgtattggcttggttctcaggcagcctgtccccatgggatgccaggagccctgggtgcacatctgacttgccccaccatcgtagctgagggaaagcatctttttcccagtacatctggcaaaagtcctggttgtggccaggcgcggtggctcatacctgtaatcctagcactttgggaggccgaggcggggggaccacgaggtcaggagattgagactgacctggccaacatggtgaaaccctgtctctactaaaaatacaaaaattagccaagcgtggtggcacacgcctgtaatcccagctactcaggaggctgaggcaggagaatcacttgaaccagggagtcggaggttgcagtgagcccagcctggcgacagaatgagactccatctcaaaagaaagcccatgttgtaatctggttggaagaacctccaccacatccccggagctggtaggaggaagtcagtcctatttgaattgcttgaagagtggggaaggagtcattctaggagagaagctgggtagacagaatggccgaaaatattcagtaggaagattaatctgaagatctagaagtcatacaaaagagaccacaggtctctataaaaccttttgactgtcctgtgtgtacttcccctaccagcgccagtcaacactttccctgctaggatactcatccgcccattgacacagtggtgtcagtgataccttctattccctgcatcagtcatttcaagactttttttgttttgttttgttttttggagatggagtctcgctctgtcaccaggctagggtgcagtggtgcgatcttggttcactgcaacctcctcctcccaggttcaagtgattctcctgcctcagcctcccaagtagctgggatcacaggcgcccaccaccatgcccagctaatttttgtattttcagtagagacagggtttcaccatgttggccaggctggtctcgatctcttgacctcgtgatccgcctgccttggcctcccaaagtgctgagattacaggcgtgagccaccgcgcctggccaatttcaagacttttaaggacacggtgaagaatctctgacaatgtgttttgccattctttttttttttaactgttatgtgattttatttattttttaaaaaaattcagaatggtggaattccatctattttagtttgccagggtggccataacaaagtaccatagactgtggagcttaaataatattaatgtattttctcactgtcctagaggctggaagtctgagatcagggtgttggcaaaagcctctccctttggcttatatgtggctgtcttttcctgctgttttcatatggtctcccctctgcgtgtgtctgtgctctaatctcttcctgttattaggacatcagtcatagtagattagggcccaccctaatgacctcattttaacttaattacctttttattttttgagatggagtttcgctcttgttgcctgggctgcagtgcaatggcttgatctcggctcagtgcaacctccgcctcccgggttcaagcgtgtctcctccctcagcctcccgagtagctgggattacaggcactcgccactgtgcccagctaatttttgtatttttagtagagacaagctttcgccatgttagccaggctggtcttgaacccctgaccttagaagatccaccagccttggccttccaaagtgctgggattacagacataagccactgcgcccagccttaatcacctttttaaagaccccgtcactaaatacggtcacattttgaggttctgggggttagaacttcaacatacgaagttgggggaggggatgtaattcagcctataacatcatctgttgttttaatgctgtgaatgggttgtattttgaaaaacatgtacatatcttgtttgaaacacaaattagtaacagattcacctaggcagtgcagactgtttcagggatggttaagtttgatgtagagtttattattcgggtactgctttccctttaataggagtagagagaagacaaaacgtacagatgagaactggttgtggatttgcgaaaaatgcttggggttggatagtgagaatctggacctttcacctccctaggctcagtgctgccgtgttggaattgtagcattgtccttgcaattgacagcttctctgcgatactctgagggtggacttgggttgtgaaatgagttttatgactttttggggaatgggatgggtggctgccctaaggcaggactctgtctttgagaccaacagctcatcctattcttcccactggagcagtggattggccaagagctctgctgggcacgccagcactcccgtgtgtgagagagtcttgtcgtcttgtttttttgtgtgtcttacggaccaaagttttcaagtgtggggttttatgagtccatttggcccacgtcgtaaaagtgccactgttgtgttggaatgatttctgttcattctcagagctaatctttaaggttctgcctgtgacaaacctgttcatcgttccactttatcaagaagttgtcattgttctcgctcttgcactaattactgttttaatgtggcttgtgtgttcattgtctggtctgtctctgtttagaatgaaacatcacagccaaaaagatgtggggagtaggtagcagctttcaaattgtagtcttttcacattagaacccaaaaatccgcttcccaaattttgcttgcctgcaaaccagaaatttcagtacaattttagaaagccatttgctatacgatgtggttaaagtatgcatatgttcaggttgagggcctgaataagtcatccatgtatcatcacccctttatctgccaacatcgattgtgttaactgattggaagattgtcatttcaacattttaatttaattttttatagagatgctatctcactctgttgcccaggctggagtgcagtggtgtgatcctagctcactgcagccttgaactcctgggcttaagcgattctcccacctcagcctctccagtagctaggactgcaggcatgtgccacctcacccaactaattaggggattgtctttatggaagacatttcacagtgtctgagagagtaggacataggatcaagaagttttggcagaacatggtttattgttatttccatgctaatatttcctggctccccttgggtaaggtgcttactttctttgcattcatttcctatggcagccgtaacaatgtaccacgtgctgaatgacctaaaacaacagacattaattgtctcacagttctggaggccagaagtccaaagccaaggtgtctggaggagtcagcaggaccacactccctctccagtggctctcggtgagaacccttctggttctcactagcttctggtgattgctggcaattcctggtgatccctggctggtagacatgtccctccagtcacatagctattttcttcttgtgtgtcttcacattgtcttccctctgtacatgtctctgtgtgcaaacaaccccccctccctttttttctgagacagagtttcactagtgtcacccaggttagagtgcagtagcgcgatctcggctcactgcaacctctgtctcccgggttcaagcgattctcctgcctcagcctcccgagtaggtgggattacaggcgtgtgtcaccatgcccagctaatttttgtatttttagtagagacggggtttcgccatgttgggcaagctagtcttgaactcctcacctcaggtgatctgcctgcctcggcctcccaaagtgctgggattacaggcgtgagccactgcgcccagccagcttcccctttttataaggacagcagttatattggattaagttccacctaatgacctcattttaacttgattatctctgtaaaggccctatttccaatgaaggtcacaatttgaggtaccaggggttaggacttcctcatgtcttttgggggattatttcaacccttaatactgtctgagcttcatttttttctcctctgtgaaacaaggtctgtcatctgttctcgcctttaatgtaaggatcaaacacaagttaatgagaaagcaatctagaaatcgtatcccctgagtgatggccggatgcccgttggacattagaggctcttcattccaagcaagtgacatctaatgagcatttgggtctgacacgtgatgtggtctgtgagaattttcaattgtaagtcctttggaggtaagaatgttgtacctgagctgtgtgtttggtggaaacgtagagtgagccggggctgggcttgcaagggggagcaccacccgggagctgagctgcatcttcttagacgtcaggactgctgtgttcctccttgtcctgacttgcaggccagtgactgctgccctgtggtacaatttgagtgtaaatcctgagatatctgttccaactcctgaatctttcatggagagtgtgggaatgtattctggttttttggtttgttttcatgagctgtattttgatattcaacagaggttcacttggggcagaggctaagaatgttttcagactgcatttctcttttgtttcttcctaataacttgcaatggttaggggaaaaagctacaaaacaaataagccaaaaacaaccctccaaacccacacactgacatttaaaggatttgtgccttttacttgcatttacttacagcattgtacagattgctgtctgaatatatacatctggatgtattctttgagatgcccaaagcactgcagaagtctcacttctttgttaaatagattttcatgttattcccatcaattggatcagaatttctgagggctgctggtcatcgatgttgctttgctcagattcattccttcatttgctgattcactgaacacacagttgttgaccctctgttatatgccaagcactgtactgggcacagtgagggggcgggtgaggaggagaacaagacaaagtcccagtccctgcttgcttggaactctcattctgtgtggcttggttcattgtgagcagattaggttggcccttggctgtcatgcttccaggcaaagctatcccttttgtcacttgccacctgcagttctgggctaaaaactaccatatgtataactcctcttggtatttattggtttgttacatccaattttgcaaagcctgatgcattgtttggttagaaggaatcctctattctactcccaagaggccgctcaacaggctttgatgatccgttaaacccagttccatttttgacatgggagagcctgtaacttttttgcctgttttgattttgagtcctttatagggtattttgagagttgggcaccatcaggcgggtttgatgtcagtgcctcacaggtgggcgatgaagttctgggatcaattttgttatatggccgccttgtacagtgccacactggaagcttacattgcaagacatgttcttttcatggcgagattgagatgtggtaattgaaatgggaatggctgaaaggaatactgatgtctccatactgcagggaggggtccaaagccatcttgctgaagagcagcaggggtttgtggtcctgttcacttctgatagggagcagcataaatagcacatcctgtcacttcccgatggatacagttgcgtgaggacttgtttataatgaatggtcctggaaaacaacatctcagggaatgaggaggcaggagggaacatttctgcagggataggagaaggaggaactggtagaagatgtcatggagaattgcataatgggttggttttatcttaagaagaatctttttgtttgtttgtttgtttttgaaatggagttttgctctcgttgcccaggctggagtgcaatggcacaatctcggctcaccacaacctccacctcccgggttcaagcgattcttctgcctcagtctctggagtagctgggattacaggcatgtgccaccacgcccagctaattttctatttttagtagagaaagagtttccccatgttggccaggctggtcttgaacttccaacctcaggcgatccgcctgcctcggcctcccaaagtgctgggattatagacgttgagccactgtgctcggccagtcttaagaagaatcttgtaatgatcttgtggaaggagaggaggaaataaaagtagggttacgtggtgtaaagtgctttgcactccctctgcatctcatggaaatgcagaacttttgggctcccaagagggatgtggaccaatgggatgccttagtttgtggatggggggcggggcacttgggcccagatcaagggaaccgtgtaggctcacaccaagttaatgataaaattcaggccacttgacttccaaccttttattttctccctcaagcccaggctgtcttccgcatcattcaggagctcttttaagcctggctcaagctttcttggggcctgtgggccgccaaagaaactgcatagtcctcttggtaattgttgggtaccttttgggtggctacagctgtggccacgtgtatgctgaaaggagtgacaggactgggtctcttgttttttaaacagggtctcattgctacaatcattgaatgtattttttaaagatgaatataaaacagctaccctcccaagcaaatcataaaacaaattatgcccttgccacccagaactacagagaaacagcaggcacttcgtggcacagagagtaatggctgcaatattaaaacaatgatgggaaaaccaggatccaatagctgaaagcagggaggaaaacagcctcgtaatcccccagggataatgggtctcaccgacaggtccctgtgatttattgtgcttaatgtacttatttttatttgtccccttcaacacggagctttgtcactgaagagatttgataatggcctgtttgcagtcacttagactctcgtaataaagcgccacattttggctgtctgtaggttccgctggcttcattggcattccccctctgatttcaccttcactggctgagctgggatagatctagataagggctgcctcccttgcgtattcccgtcatgctgccctgtcctgacttctgcctgatagccagccttactaggtggctctccaggcccagcttgcctcctgctttcgttttatgctactttgggaccacaggaaggaaccccttattctgcctgaaataataatggatccctgggacttttatctttgtagaccaccaatgagagtttactgcttgcagctttttgggtgagcaaaaataaaagcggaggagtaggtatgtggggtttttgcaaaagaatgggcttgatttaaaggctgtagtgccttctgaatgtggtagccagctgctttgcaaagaagggtgtgtgggattcaacagttgtgagtgagtcaacctgaggctttcatttcagcttcttcctgggctttgaaggaagggaggtagaagctctccagggagctccacaaaggaggcatgactggcctccttcctgcaaaactgtccctgatctgctaacgttggggtgaagaaatccaggaagtgagagacaggggcgataaccagaaaagcagcttcaactgttttccagggcagcatgtgtgtttcctctctttgaggacctctctctgataccccaccatcaggtctggtcggcggggaaggttctgtgctgggttgcatctgacacttggcccctgtagcacagctgggggagagcattgctttcattctgaatactgagagagaacgagtgagtatctaattacggaaaactcaaatagtgtaactgaaaaagactcctttaaaatgtaggagcagcagcaaaagtcaagcacaccaggggtgggagccgggagtggaagggatcagtgtcgctaggcctcagtagatggagtgctgtggacactgtgaagtttgaacattctagcaaggtgacggcatcattgagggagagatggtgctaacaataggacgttgctctcagtcacttgggcaccttttactttcctatgcctctgtcaaaagttttaacaggctcccaagccactggaccccagtacacggtacactttggcctcaaatgtgcccctggtaccttaagatctagcagttctgctgagtatatacccaaaagagttgaaagcacagttctaaagagatatttgcatactcatgttcatagcagcgtcattcacaatagccagaatgtggaagccacccaggtgttcatcagtggaaaggctaaacaccatgtggtgtagacatacatggaatttattcagccttcaaaaggaaggaagtcctgtcacatgcgacaacatggatgaactttgaggacatgatgctgagttaaatgagtcagtcattaaaaagataaatatttatcattccacctatgtaaagtccctacagtagtcaaatttgtagagacagaaagtaaaatggtggtttccagggactaggggaaggagagaattgggagtgagcttttaagggggagacagtttcagtttgggaagatgaaacagtgctggaggtgggtgttggtaatggttgcacaaaaataggaatgtgtgtgattctaccaaactgttcccttaaaaatgggtaaaattgtaagttttatgtgatgtgtattttactacggtgaaaataaggtatctctggcaggcagactctaagttggccctcatgatcctcatctcctgatctgctcttgtgtggtccctttcacttggggtgtgcaggggacttgtgacttgcttctaataagaccagagcagaggcgaaggatgtcacttctgtgattacatttccttatgtaagaccccatcttcatagcaaacttgccctgaaggatttccttcttggcttgatgaagttggcatgttgggggagcccatgtggcaaggaactgtgggtggctttgaggagcagagggtgacccctgcccacagccagcaagaaggcaaggacctcaggcacaaggaaatgaattctgccagcacaggagggagcttgcaggtggattcggccccagagctccctggggacaccttggctgtgtagccttatgagattcatgaaccatagacacagctaagccatgcccaggctcacactgagctataggaactgtgaaataatgaatgtgtgctgttttgagccatcaactttgtgacagtttgttacacagcaatagataactaatatgtagcctcccaggagacctgcctgagtccattccatcctagttttctactctggtcacctcaggtctccatctcctcctcttgtcctctgtgagtgggcagatggcctgcttttctgttttctgtttatgctcaagtgcattcatagttagagccaatttgtcctccttgtgccttcctgctctctctggtttccggtttgtgtgtcccatccagagaccgagggtgccaactctgcccacctctgtagaggtgtactctcctccccatcccccacagcacccccacttgcctctccaatataaggctcatgacacaaaatacaggtgatcggtgatcagattttctagggtggctctaattgcaaatattctgccccatttgttatcccattaaaccattaaactgtcccaggcattccactttggtatataagctcttccgggactggctcccatgtgacaaattgagaagtgccactgccattttttgagcacctcctgaatgtcaaatgcttgattcatgattctcattgtgttttcccaacagcctgatgaggtggctgtcatggtgcctgacttacagaggagcacactgagaccaaatgaggttcatttccttgtatgaggtcacacacatgtgtgtgaccttggaccagatatgggtccagacaaggatgagaactccaaagccctgtcctaacttgcctggggccactgccttggaagagcacagtagtttttctgccagctcccatgtcccagttttgtttgaaaaataagagttgctgcacacagaggctacttcgaggtttctgataattcattctgatggacagcagtgggacagtgtcgggtaggggacacagctaaagcctcaaattgaaataagaagaggagacaagggggtcaggaataaggttgcaactggggtagccaccctagtgagtagagtaggggtccacagtgtttctcacctaggatgtgtactagaatcctctggaaagctttaactgatgctgatgtctgggatccacccctagaaatagtgattttaatggtttgtgatgcatcttggggaccaggatcaaaaactccacaggtgatctgcataggcagccaagatttagaacactgggaaggaggcctccatatggtacaggttgaacaggaagtagagaagacacagccttaggataagggcagggcctggaccaacagcacaacctctctccccatctagagggtgaccctgagtgctcatagggtcagcctctagatggggaggggagttgacccttagacttagagcatccaggtctgcagggccgggagcccagtttggggacccagtgaggcctgctcatgcttttcctgtggaatcgatagatttcctgcatcttcagtgccttcaatgcacttctactcaacatgtagtgaaaggggcggaggtgccctgtgagacttgtgacgttcagcgggccttaataataggcctgcatggactgccttttgtctttgcttagagttcatggttaaacgtggggtttgtggtgttcccatgatacctgaataccgcttgatgagagggattagattgcaaacaccttgtgagtggggaacccaatatttgtgtctgctagaatgagtgatatgatggcttacctgtaccacttaagttaatgattgatttcaacagcttttgaaagttgaagcacagaagtcttaaggtcacttcgggaggtgaaaaacttggtgattatcactgtatttaaaattgtggctctccgataactccacacttgccttctttaccctgctctgttttttcctatagcatcaccgtttgttaatatgctgtgcgtttatctgaatgtgagctgatgacggcagggtttctgtctttttgtgtcttaggcatagagaactctcaataaatatttgttgagtgaatggagtaaatggtggcctctactagtgttagtggatccagaaaggacatggaatagtttaagatttattccttggttgagttccaggaggaactgcaggatttactggggtggtgggaagaggaagggggacagtgctgtggatacattttgttttacctacccttttggagctggtgttttctttctcaattaaaatgtattttctttagcggttactttgtaatggaaaatgacacttctgccagttttagtcttttatgtgttctaaaccgagtcctttcctcctgctgtggcttcaataatgcatcgtttcataagttcacagaatttaatgtgcttctgctgaacccctagtctcagccagatagttaaatgaaaattaaccactgtaggttggattcaaagtcacctattcaccttctccctttttaatccccttccctcactccacgtttgcaaagcagtgttgcatttttcttttttgagaaatagggcatgatgtgtgcctgcacacgggctcttgtgtgtgaatgggaatattgatttatttcacaatcagagatccatgaaaaaataacactgtgaacatacacatttttgaaatgctgcctcttccgctgaagtacagtggagtgtagggacctgtagcaaactaatatttaacgagggtgccactgttgtaccacctttagaattcacagtggctgctagtgaaactggcatgtgtcttgacaaggctgtgaaatgtagtcagtcttctttcattcattcatttgttcatttattcagagccagatgatcattttgtatgcatgaagcacctgagtggtggatgtgataggctgattgcatttgtggcctcaaatcttcacacgtttctgatttcctacccaactcctttgacttttgactttaagtttcaccatgtgactagctttggcctgaagtatgaggtggaggggatggtatgccagttttaagcctatgccttaaaagatcttgagcatttctgcttttttgtgtccctgcctttgccacaaagagtgtgccctgccagctgctggtcagaagaagagtaggagaggggagcagagccacgcagccaattcatgggccctcagtgagaaaccaagcccagtctagatcagccaagtcccagctgacctgcaggtgcatgactagaaataagtgatcgttgcctcaagacactggttttgggatggctcattaggtagcattattatgcaacaaatgactgatgtggtgggttgctaacatgattcagacgtgaatcctgtttgaaagaagctttgtagttttgtgagggtggtgagaaggccaggacaagattgtgaactctcgtacgtggtagagaaggtacgaaacgtcttaagaaaggactcatggtgagagtggcttttgagaaggcatttttaggtgatgttgtcaaagtcgagaatagaagaactattagactaggatcctatcagactaggattttgagttaaaaatatgtgatatttcaaagttgatttcatcacagccaatgcatcgatgccaattttccgttaaatttctaatgactttgcttttgatgaaccaaaaccagctcttacaacttaaagctacgctgctgtcagagaacatctccgtttgataatagccaacatttacagtgcttatcacaaagaattttacccagcatgtatttggtctatgtactgtgtgccagggatgtgtttgctaagcattttataggtatgatctcatgtaatcctcctcatgatctgaagagttgtaggtactaatgttgggtcaattttccaggtaaattaaccaagccagagaagggtaagttacttgctaaagtcatgcagtaacatcgtattctcattctccttcctgcacctgtctctcctaatagaatggcatcctctcaatacagttttttttttttttatggctagcacatagcatggtgccttgcacatagttgttgctcaaaaagatgtttttgttcaacaaaaagtgaataaatcttttaaaaaggaataatggcttcatccatgtccatatggaagtcatagccagtaaggaaatgaatttctggactaattcatataaaacaaaggggcaagtttagtggtggagatattggaaatttttataggcatttggtagagcacagaggagagcctcttgattcagccttgaaagataacatttctggagctggtgaactctgaaatgactctcaaatgaggggtctgaatgaggcaagggggaagcaaggggcctgcctgttgaggagacgagagttcacagaaccgtatgcagcttcccatatgcacagaaccgtatgcagcttcccatatgcacagaaccatatggagcccagggtagcttcggggacaggtagctgctcagttgtaaatgtttgtttttctgagctgttgcatgccttggcgctagggcagtaaatctctgagcagctatgcccagtaaagtcatgaaaacttgagtctctgtagtctcataaccccttatttccacctgcctaatgcttgttgctttagggaaactgaggcagcacccccccgcccccaccccaaaattatgacctcctctgtcctgaacaacctgaggaattgttgcctatgagggctggcttatcacgaagctcatggtccttttgaatagatctgagaattttgcagatataaaataaatttgaaatagcttgttgtagtttaaaccttgacagcattatgtgcagtgattcttggtttttgaaacaatttcttgatgattctcaacttgactcagactccagcatgtacctgtgagattttggtgaagttctgttgcagagttttgagcctcagttttttcatttcttgcagctttttgagcctcagttttttcatttgtgaaacagagataaaatatgcctcctagaattgctgtgcgggttaatttgaaaaaaatatgaagaaaagctcattttttttttaagcaccaactactgtgccaagcactctttttagcctctatatgaatgaattcatttgacattttaaatcctcacataaaaccctaagatggaataaacaggagtgtgagccccgccttgcatctgaggcattgtggagtttggtaacttgcttagggctacagggctgggtaggggagaaactaggatttgaacaccagaattatgcgcttaaccctgaagctgtagtagctctgttcctagaatgtggcaggtgcacatgggtcgctagttcccctctatcttcagaccactgtcgttgttctctcccaggcctgaggagccagtgggccagctgggctgggagggcttggcagggccctggcctggctccccacttatggggggcagaaacctggggcctccctttcagcactgacatggctggtggtttgcatttgcctgtgtgttcctcatctgtctatcccatgaggtttcacactacacaagggcgggggccatttccgttttcctggttcacactgtgtttctggcaccgagcttcacatccttccctcattgaacactcagaaagttatgaatgaatgaatacatttttatttagttctcccctcctctatcttctggtcactccagaccactctccctttaagacccagttcaaatgaccccatccccttgtaggtgcctccgtgagtattgcttgcatctcctttgtttcctgtccatgagcccctccgggaccccctgcaaacaccagacccagagcctgcctccccatgttggatgttcccaatcaatggtcttggcgtgagttgattgaacagagtccctatttgagaagagcctgacttatgtctctgctagactttagaggggaccaagaataaagggtctatttaaggaaaccattacacaaaatttccagatacgtattattccagctccagaatctcaaacttctgaatggatgggctccaaaaaatacactttcttttctctcattgaaaaagatgtcataaatggcgctaagaaatgctgccggtgtgcagaagtctgcctagcccaggagggagcttcctggacctttgccacgaaaattgtcagacatacacttgcaaacctgacaattaaaacggaagacaatacaatagaataagaatcttttccatttctgttgaatgagggggcttgagaaaaagctcacgaaattaaaaggagaatgaagacgcttctgaagggagctcggtaagaattttaggggcaggtggcatctgttatttattgtgccagttttgatttcagattacagtatatgctttcttttggggaagtgaggtgatatcctggttgaaagctcaggctttagggtcaggcagatgctgatttacatcaggaacttaaatgtgtaactgactttaagtaagctactcaaaaaccaccagtctcttcatctctaaagggagtgaagtatgttacaaaactcgtgagtgttgtatgaagatatatttgttttttgttttgttattgagacagagtcttgccctgttgcccaggctggagtgcagtgctgtgatcttggctctctgcaacctctgcctcctgggttcaagcgattcttgtgcctcagcctcccgagtagctgggattacaggcacgcaccaccatgcttggctaattttttgtatttttagtagagatggggtttcgccatgttgcccaggctggtttctaagtcctgatctcaggtgatcctcccacctcggcctcccaaagtgctgggattacagcggtgagccactgcacccagcctgtgtgaggatatattcgaaggtgctttgtaggtagttggagggctccataaatgttacccacctcccccgtgtgtgatacaaatattctttatcatgagctttattagtacagttgtccaccacgtgcacatcatttcttggttggaagggaaatggaagggcatttgcaaatgcagaaggaagggattttcatgaggtcattgaagatggtgacaaaatggaagggaggaaggagtttgtttctcaaacagtgttccttcatgggctcatggatgttctgtaagacttttttttattacttttttttttcgttttttaaaaattgaccttttgatgtcatctaaaattaatataagcatcttctgggtcatgaatgtgactacttataaccaaatactggtcctaggtgaggcattgctttggtacaaagtggtccctcttcaattgaagaaagagaatgaagtgcagaggggcctgactgtggaacgggagcattggtggttccacagtgttgtccacattgggaaggaacgatggaatgagctccatgcacagggtggggccaccatcttcaggagaacctggccagcctgagcaaagtggaccatattccttctgggaagtggtggtttaggtcaggggaatagaaacaaacgtatgtgacgttcactgaaacttgtattggcgttgatcttcaaggtaaaccttgtaagtttgttttgatttcaagattgttttagagcaaaaatcataggcatgagaaccttgtcctagtctgttcagactgctgaagtaaaaataccatcaactgggtgatttttttttttttcttgtgagatggagtcttgctcttgtcacttaggctggagtgcagtggcacgatgtcaactcaccacaacctccacctccaggctcaagcagttctcctgcctcagtcccccgagtagctgggattacaggcacccacccaccacgcctggctaatttttgtatttttagtagagacagggtttcaccatgttgttcagactgatctcgaactcctgacctcaggttatccacccgcctcggtctccgaaagtgctaggattacagctgtgagccactgcgcctggccaggtgacttttaaataacacgagtttaggtctcgcagtgctagaatgttggaattccaagatcaagataccagcagattcggcacctgctgagggcctgctgtctcttggccttctcattgcgtccttacgtgaaagaaggggcgagggagctctctagtgtttctgttttaagggcagtaatcctattctcgagggctccaccttcatggtatgaacagctcccaaaggccccaccttctaataataccatcacattgcgggttaggattttgacaaagcaattttgggggggacatcgatattcagaccacagcagaactcattcgatgttcacgtgctgttcttttcacttggaattctgtttccttcacttccccaccctggcctcgataacccctgctctgacccaggtctctgtttaattaccgctttttcaccctaccatcaccaccttgcccagaccaaaacttgccttctgtatttgtaaagccctgcgaggcacttttcccagttgactttataggcttttatgggatgttctggtttatttgtttcttccctgctggactggaagcttcacaagagccaggggtgtctttttgtcgttttccttgccactgtatcctgcagtggtgagcgcagtgcctggtacttggtgctcagtaaacatttactataaaaataattttttaattttaatgtcttacatgtttttctcttctcttttcttctcttttccctccctccctccttccctccctcccttcctttttttttcttttttttttttttttttggcagaatctcactctgttgtccaggtgcatgatctcggctcactgcaacctcccgagttcaagcaattctcctgcctcagactcctaaatagctgggattacaggtgtgggccaccatgccctgctaatttttctatttttagtagagacagggtttcgtcatgatggccaggctggtcttgaactcctggcttaagtgattcacctgccttggcctcccaaagtgctgggattacaggcatgagccattgtgcccagtccactttaatgtttaaataacataggaataaaaacagtttaagcccaaactagattctctgccagtttcttttctctaaatgtgccccctagtcacacaagtcacaggaacatcctgtaggacggctggagggcctaagtcagagtgtctgagtccccaagtgtaggagaggaaaatgggaggtgggaatttactgggtccttactgagcaccagggagcaggattgctgtgggctggcttccatggatctagcctgcacctcagcttggctgcgtggttacctgagatgctcacaggagggagttttaattcagtgatacccttcctggggctcacatcttttattttatttatttatttatttattgaccagagtctcactctgtcacccaggctgcagtgccacggcatgatctcggctcactgcaatctctgcctcccaggttcaagcaattctcataccctagcctccccagtagctgggattataggaacgccaccacgcctggctaatttttgtattttttggtagagatggggttttgccatgttggccaggctggtctcgaactcctggccttaagtgatccacctgcctcggcctcccaaagtgttaggattacaggtgtgagtcaccacgcccggccacatcttttatgatcttttatgagaaacttgggctccagcggaaggtgaacaggaagttgtaggttgggtggttcatctcccggagggtagctgagctgcttatgcctgcagtgagacctctgaatgggtgtcactcactagatttcattataattataactttgttttaatagcctttcagagtttataaagcacattaacaagcttcatattgctctatcaatatcagtagttacgtaaggctgccttatgatactgatatgagataaacattcctatttttgtagataaacagactgaggcttagggggattggtgtgaacttggggctcgggacttcacgtgtagttagccatctgaagtactggtgtgtaccccaattctactcctgggatgaagtctcagaggcaggagttggagctgccccctccgcagagggtcagctaagatatcagcttgaaataaagtggctcagtagcaatgtaattatattttcagcaacttaaaaagtgatagagtcactggtataggaagcatggtatcgcctgtggaacacacacccttgtgccctgcaaacctgggtttgaaagcgagggctgtcactttctggcgcatgtggattatttagccgatgagccttagtttctgcatgggcaaaacgaggatgataatggttaatcagagcattaggatgaagtgagttatcatttaaaaactgcctaactcagcatttaaataagttccagtaattattcgtattcttcccaaggttttacctgcccttttattaattcctcccccccatggaaagcctcacaaatacatgtgctgttggtgccatcatgggctcagggtgactccgcctttgtgtgcttggcagcatctcagaagctgcagagagcctgagcttcagaaaacaggaggggaggttgatttgtgccatcaggaaacctagggttgctcctgtcattgtcctttgtagacaaaggttgacttttggagtaagtgcacgcatgccactaagagggtgatttgcaggaggtggaggctttccttccctgggtaggcagattaaaggcggggttgccggccctccgcagtgtaagccgtgacctcgagaatctggcagctccgcgggatggtggcatctggcctttcagggcctccccaatctggtcttgcccggtctcccacagattccctgcatagttgtgacactccagccaaactgacagtcacttggatgtggcacatgccttcccatagtcaggccctttgcgtgggctggcacaatatgggggcctcagaagagaagtggggtttgataagtgggctgcttctcccacactgactcaccctgaatgatagcagtgtgtgaagagcacactcgttaatgccatcagaggaaagagggtcaacgtacagtgacccaggataatgttccctgcaagcgcatgatcgctttaaagtgctgtgttcccagcagtgtggacggacagctgcagtaatgattcgtacacagaggaagctggcattgaccgaggccaaccgcatggccttggtttctgccctgaatgagctgacattcttgttgaaggtgagacaggtggtgtggttggtgggcagagaccacctgacttagataggttcaagtctttatttttctcattgattcatcacacaactatttactgtgcactactgtatatgaggcactgttctaagtactgtgggactgttagtaaaccaagggacacgagtccctgccttcatagagtttgtgttctggcagagggagatagactaacacacaaaacaaggaaaacatactgtgtctcctgtggtggtaaatactcggagagaagaaaatacagaagggagagagagggagggtggagtgtgtgtgttggcaggagtgggttagggtttgcggttttaaggaggttggtccgggagggtttgcagaggtaattggaggagatgcctgaaggtggtgaaggaatgagtcatggggctttctggggaaagagccgaggcccatgccagtgcaaaggccttcaggccatttcttaattgctaatagagagaccacagaggggtcgtgtgcctggaagggcgcaagcccctaggaaagtattgggagaggatgacagagaggaacccaattgttctgggtctcctgggcacagtgtgcattggaagagatgcatgagctgattcatgtttatcaggatcacgaggctacttcttggttgtgcattggccccaggtagcaaaggctgaaacagggagactgcggagggctgtacttcaggcaggagatgagggtgacttgggccagggagcagtactggaaggctttgagaaatatatgagtctgagtctctgctgcttacattctctatgaccctggttgagttactttgtcttattacactttaattttcttgactctgcaatggaaataataatactgaaacttcctggagaggctgcaaggtggtagccaagcatcaccctgcttgcaaagcagcgctccccgacactgtgggtgctggaggtgtgtgcatggccctttgcatcatatctcactggaagggtcttaagctgctgaggctgaaacgtaaagataacagcagcttcctgccgcacagacttctccggcattggcatccgagcatatctttagaaatcttctaacccattcttggttattatttgcaatccagggcccaaagtgatgagttttcccattttcaacataattcatctggctgtgtgtcatgtctcatggcctcttggatttgtggagagatgggggtgatttgtagacgcacgtgaggaaaattggattatggagtgattagttaaaagagcgctccatcagtctattgaaaaccccatcgtttggggctcttggagttcaagttaatcatagcaaaggtaggagaatggcaggagaaaagtaaaattcctgcccatttatgtaagcaggggatgcatacctgttgtcccatgatcaaatctcacaggtttcctagacatgctgaagtgaggtaattcagtgcatccttttactctgtggaatgtatgaaacttttatttgcaaaataccttatttgtagtcttagttgccttatatgataaagattagccttcctgttccagtgttactgatgagaggctgagtttcatctttggtgtttttcctaagctttaacaatgcccccctgctgagaggtctcctggctggcatctgcttccctcacctgcccctttatcactgctgagggtggaactgggtgtgggggggcatcttggtatgatttggatatagtctgcactgacttgaaacacaggcatttcatttgccccaggttactggccttttttcatttcatagaaggcaaagagaattggccgggtgcggtggctcaagcctgtaatcccagcacttggggaggccgaggcgagcggatcacgaggtcaggagattgagaccatcctggctaacacgatgaaaccccgtctctactaaaaatacaaaaaattagccaggcatggtggcaggtgcctgtagtcccagctgaggcaggagaatggtgtgaacccgggaggcggagcttgcggtgagccgagatcgtgccactgcactccagcctgggtgacagagcgagactccgtctcaaaaaaaaaaaaaaacaaaaaaaaacaaaaacaaaaaaaccccgcaaagataattgatagcatttgcgggtgtggcaaaggtgttagtacctcctctcctctgttaaagtgctattggagactttcattcagccatatttggcctcctggttacagtactgccctgagggctttgcagtgttagcctgatgtctggagaacctgccccatgtgccactgttttcatattcaggctcatgaagatgatcactcacttaagggttcctatttccttaaccttttgtagtgagacattgtaacttgtttcctgaaaccgcaaggcttaacatgagtgaaatatactctgtaggtgggtctttttcaaaataaggtccatgggtctatattctgtatgttttatgagagggaactatttaaacaaaactgttcaaattggggtttatattttgatgaatctgaaaaacaaatggctgtgattctttgctgtgataatttgccatggaaacatatttttgtaagactctgccttttaaccacacttctcttctttaaaaagggtcaagttattacccacatttgataaacccaattataattcttatttctttacctttcatttctcaaaaatcctttccaggtgatgaggtttagaccagccttcccacacagatgctcacctttcctctgagtcctccagctgctcatttggagagctggaggtgacttcgcctgggggatttagtgcagggacttctgggggcaccagggcccgctacaggctttgagcaagttgcttgttgagctggacagtaagccatgcagcgtgttgtgtgtgcagagcttctttttcggccccggggggctcgtaactgtgttctggaaacctggtacacaagaaggcatctggaacgtcagactctccatatgggagcctgtcagagaatgtcgtcgcgttttggcctagcagcctctgtggcatctttatcgaaagtaaaaaaaaaaaattaaaaaagctacttattaagtagacaaggacagtttggaggaggacagtttgtaagaatagcatttattctttgcaatcagaaggctaaaaagtacattaacatacattcaaagtatattaaacataaaatatattctaataaaaagtacattcacgtataaaataaatctcgcttccatccctctgctgctgggttggctgtccacagaatgggcacagcgaggcaggtgtgagggagaagcatatacttatgttaatatgtatgtcaaaagtaagaggagcagagggaatgaaaatatccatatgaatttttttttccagaatttaaagcaacacctagttgaagattcagatgaaaacgtctcagtcccttatggctgggaggtttagcaaagctttcccagaggaaagaacacatcatttgtgtggggtggctctgcttcactgaaatgaccagaacgtagctgttaagcctgggaggatgggtcaggccacaggatcaggtaagagtgtacccttcaggccgcacatggcagagactgcacatgacttgtgcacggataaggtctgggccttatctctgtctcttctggctctggaatatagtacatttctcaattaagcctcagtttccttatctgaatgctggcatggtaatggcagtcttgcaggatagttagaatgttcaaatgagagagtctatcatagtttgctctgctgtttgctccatagaagctgcggatggttgagattttggtcaagacctttctttcgtctgatctgacttgggtccagatacttggaaaaatatggcaatcatgctgggtccaaaaggctgtgggattcttttacttcagcttaaacctgttttattggtcttccggaaatgcttgcagaaataagagcatgttaacgtgggtggacacaatttggagtgcttgattaactcagcaattaataaaaatggagaggtgacaattggtgttaccaagctacagttgaaagcagtgcacttggcctctctccatgcaagcagattggtggagaagccacccatggggaagaacatcagaattcagaagagtgaagcaggttgggaaaaaggtactcagaacaaaaaacagggtgtcaagatgagctggttgcttattacattcatttaatcagcagatgcttactgagtaattcccatgtacctgataccgtgccaggagccgaagatacctacatgaattaggcatagcctcttctttgaagagaggctgatgctgttttggaggtaacagacatataagcaacacattctaatacactatggcgagtacaggatagatggtgtttcaagttcatgcgttaccaaagtaaggagtggttaattaattttactaaaagggagagaacagtattggctttaaagaaaaagtggtttgagccagacctgccagaataagtcgatgggaaaagatattctagcacagaggacaggaagagcaaagacagggaggcctaaaatgaagggtggatttgcagttgttaagtgggaagactagatatagactgggtttgaagtctactctgccacttactagctgggtggctgtggacaaagcagtaagccttcctgtgagtggtttcatcatctgtcaaatggggatgcaggatccatgcctcatggggctgttgggaggattccatgttagtttagtgtgcttgggatgttgtgacccctcctgaacattacagccctgaggcatcccctgttctttgatgtgctgtatataagaaaagagactgggcgtggtggctcacgcctgtaatcccaccactttgggaggccgaggcgggcagatcacctgaggtcaggagaccagcctgaccaacatagagaaaccctgtctctactaaaaatacaaaattagccaggcatcgtggcgcatgcctgtaatcccagctactcgggaggctgaggcaggagaatcgcttgaacccaggaggcagaggttgcggtaggctgagatcacgccattgcattccagcctgggctcggaactccatctaaaaaaaaaaaaaggaagaagaagaagaagaaaagaaactgggactagaaatgtcactatggccaagtattgaaagcatctgaatatcatgcatcctgatgatatctctgcaaacatttaccctcactcttttaaaaccatatcttaagctatcaaacacttatcctattaaacacagcatccatcggtgatcccagtgacaagtaattgaatgttagttctggagtctttcctggggtgatggcctggagaagcctctcttttaaggattagattcagaggtagaggtaaatgagtgttgagcaccaggaagagctgagttcagcattgagttagatctggggtcagattctggccttacctttgttagccgcttgacctcaggcacatcatcaggttcatgtttagtttctacatccatgaagttaatgtatttatatattgagatgtaacattttctctgaagagctgggattgaaaattcctttgagaaaggaattgccttcgtttaggaaaacagtttgataagctagaacagcattttgtcagatagaaatacaatataagctggccgggtatggtggctcatgcctgtaatcccagcactttgggaggctgaggcgggcggatcacaaggtcaggagtttgcgaccagcctggccaatatgtatttgtatactaaaaatacaaaaattagctgggcgtgatggcgggtgcctatagtcccagctactacttgggagactgaagcagaatcacttgaaaccagaaggtggaggttgaagtgagccgagatcacaccattgcgctccagcctgggcaacagagcaaggctctgtctctaaaaaaaaaaaaaaaaaaaaaaaaagaaatacaatataaacaacatacataattttaaatattttagtggtcatatttttaaaaaggtaaaaagaggtaaaattaatttaataatatgttgtatttagcccagcataaccaaaatatatatatataaattcaaatgttacattctttatttcatactgtctggactgtggtatgtattttattattattattattatttttttgagacagagtctcgctctgttgctcaggctggagtggagtggcatgatctcggctcactgcagcctctgcctcccaggttcaagcgattcttgtgcctcagcctcccgagtagctgagactagaggtgtgcaccatcacgcccggctaatttttgtatttttgtagagacacggtttcaccatgttggccaggctggtctcgaactcgtgacctcaagtgatccccccacctcagcctcccaaattgctgggattacaggtgtgagccaccgtgcccagcctgtattttaatttatagcacagctcacttcagagcagccacatttcaagtgttctgtagtattttcctgtatcatcgtattacatccttccagaattctaagaagtaatcatttctcccattttgaaaatgggaaaactgaggcatagagagattaagaaacttgcccaaagtcattcaatgaaggtttgaacccagataatctgtcctcagagccctgctgtgctagtttcttacaaaatcttgggaaaaaaaatttttttggaggatacttggggctttcatttggcgtagactgggtagtttatacctcaaatggagggataatcttgactagactgaacctcgcaacagggttaacaataaaattacatggcagatgcacccccagggcaccattattatacatagcagggcctcagtaaatggtattctttcccttctcttcagacccataaaatcagctttttttaaaaagggactttcttagttttgtttacctctggatccattcctggtacatagaagacgctcagtaaatacttgcggaaggcagagaggatgctttggggtcactggatgtgatgatcactcacagttgttggggcatctgcaaatacagtggtaccattagatggtgggttttataaatacagccctgggtgaagggggcttatgtggagagatgaccagagtgttcagatctggagttctttccctgagccgaggacagtcataaaggccagtttttgtgtcccatgccaatgcttttttttttttccagtacatttttattttatattttatttatttatttttttatgttgttttaagttttgagatacatgtgcagaatgtgcaggtttgttacatagatacacatgtgccatggtggtttcctgcacctgtcgacccgtcatctaggtgttaagccctgcatgcattaggtatttgtcctaatgctctccctcccctagccccgcacccccgcaccccgacaggccctgttgtatgttgttctcctccctgtgtccatgcattctcattgttcaactcccacttgtgagtgagaacaatgcagtgtttggttttctgttcctgtgttagtttgcttttaaatagaagtatagcatattataccagcagcaaagcacagaaagcataagtgtgcagcttggtgaattttcacaaaggtaacatatctgtatcaccagctcccagaacaagaaataggacattaccagtgacccgagtgcacctccccctctcccatcactgccccctgtgtctctaagggtatctgctctcctgatttgtgactccataaattaccttcgtgggcccacacttttgagcaaatcccaatggttggagttatcatggggaccagtatgggggtccagttagtttcagtcctgttttatccccaggcctggggttctaacctggttcccgtgttcatggtacagatgataaactgtgcccacagaggcccacccaactgctgggtctcatggtgagagaatagatcagtgattcagacacagaaattacatgctccaaagcctgcattcttgaccatcctgtatgttttcttctatgacgttttgttctaaaatcccaagattgggatatttaggttgagatctttggactgaatcctatctgggagtggctgctggaaaactgtggaggaggaacccatagctctgcatcccagagcccagatgcagcatgctcctggcccccgggcactgaaggctgcacctcacctaccagaagtgacctggctagcagagcccatcaggtggggctgccggaggtgtcagagtgtgggacaggcaggcttctcattgtcctgtgtttcccgcttccacttcctgctgtcaagcactctcaggcactggtgagggaaacttccaattaaacgaaatcaggcggcttcctcccaccaaagtgaaaatgccctgtgctgccaagtgcgagctaaattcatcggtcacctgctttgcggcatgggacatggctggggctgctgcctgttggttgctgtggattttagcaccagtcactgctcagaggatgcagcaggcatggcgggctggggagggccatctctgctcagcctggagtccccttggcatggttggagatgggcatgtgtgttctggaggagctttgctctctctgtggcacagccctctgcccccatggttccccagtcaagagggacaggtggtggctgtcattctgcagttggccctggccacagagagatttgccaacaattctgggatggagacacccccagcttctttggcccagagactgcagcttgacccataaagctgcaagcaggcagttcccgcagcctgcctttctctccagaatggtgagggtggggtgtgggtagagatacatattattatagcacgagggtcagtgccctggctctgaaatttaattcaaaagccagaataaaattgcccctctggaggcaatggttcttataaaaatgaagccagtaatatttattataatcctagtgagtgagttgttgagcagctaattctttgctggccactgggcctaacctcatagatggagtggtgtatctctggagctagactgcctggggtgaatcctgtatcctctgcttagtcatgtcatcttggacgtttttcaacttcgctgaccttctgtaaaatggggatcacaacagtccctaccttttagagctgtgtgaattattaatccatgtaaagcacttggaatagcatctgacatgtcagtggctccatacacatgtatataatgttggcagagtcagttacagtcctctgactacttttctatggtgggaactttattattccatgtttaacagacaaggaaaccgaggcacagacaggctaagttactggcctgaactttcaaagacagttaagtaccaaggtggaatttgaacccagggggacctgactccacactttccagtgatcgttgggtggaaatagtgtcttgcccaagatttattacctaaaaatgaaatatatttcaaaaaagataccctcaaactctaacatttccagtaaaagcaggacaaatactctattttataatccatttaaaataataaacatagctgcagttcgttgagcaaattgctccgtttcagctgccacgtgttacattgcctttctgtttgggtcacgccctgagacctttgtgaaaaagttgtgaggtcagatcaaagcggcggctgatgtgctcctggaagaggaggtgtcctggggagtgaggacagttgcagtagcctcttagaggagtgaaaacctgaagaccagctttctaccctttgtctgcacagggtttccttgaggtgaggcgtgcctgtggtcctggcctgctgtatccctctaacctcagcatgtcttaggtcctgtccccggattcagtcaggctgtcacaaaggaccgagttagccaggaaagaagaggttttgcgttggacagaggtaggatgcaaaaagcggcctgtggaaataatgtaccattttcttatttaagttccctgagcagaggcaggagaatagaggacaggaggagaagaataaaggaggagggagggaggggaagagagacggaggagggggagagagagggagagagaatacagccgggtggggtggaaggaagaaatatcagggttgggaggtgagaggagaagggatgcagcctcagtgggggaggaggaagaagaggtggaggaaggtgaaaccagtgacttgtacttggcttcttgtgacatggagtgaggagggcagggcaggacccaagtgggaggcagatcctaggcctggtggaaaggaggaggaggaggaaggatgtgaggtagcagacagtgggagggtaaagaatggcatatgaatctgagaaaggatcatacaagttttagtgccagaattggtgatggggtgttttggatgggtaaacagaggcacgttgttggaccctggtcagtggctgtttcccaggttctatggttgtgacatgctatcttcctgggtgggtgaagaggctggaccccaggcagacgagcacgctgagtgccacctgctccatgcttccactcgtcctgtgttgcctgcctgcatctcagcttcccggaaggccccaggagcgacacggccttcagggctttcagccgggggcaggaagtgctccatctgacaccattcagaacagactagacaaataactccacagcatgtctcattaggccaggaacactccagctaatcgaggcgtgcctttgtcgtgcgctgctcgtgccaggggagttaaaaaaagaaataggcctgatcccaagggtgtgggcagggcagagataataaacccaaatacaaagtcaggccacccaggaatgaggtggtgtgctctatcggggccggattcccccagctccagatcatctggccaaatctgcaccctcctcccgggcctcccttttgctggggatggtttgggcagaggtgagtgggcatgctttctggtaaaaggatccgattttaatgtaagaggcttgcttgtgtgttttcccagctagttcacttccatggctttatttatttttttttttgagacagaattttgctcttggcacccaagctggagtgcagtggtgcaatctcggttcactgtaacctccacctcatgggttcaggcaattctcctgcctcagcctcccgagtagctgggattacaggtgtctgccaccacacccagcttatttttttgtgttttcagtagagacagggttttgccatgttggccaggctggtctcgaactcctgacctcaggtcatccacccgcctcagcctcccaaagtgctgggattacaggcatgagccaccgcgcctggccatggctcttttccgtgctccaaattcactcagtttctggctcttcctgccagtgtgctccataagaccagctcccagggagccctacacttagcgtttggtctgtaaattccatgggacttgcttcatagctgtagaaactcaggttcaagggcgtaaaggatgtgtccacagctagtgtgtcgctgggggggtggcggtgttggtggtgatgatggggatggcgatgatgacactggtgatgacgatggatagcagctgctgtgtattttcttaggagccgtgttaaattctttaatggcaaagatcgtgctagtaataataataataataataataataataataataataatagatagcatttactgcgtgtctgctctgtgccatggaaggttctcagcacttctggtacactcaacctgagaatgactctgtgaagtggatgctggcgtgcccatttcacagtgcaaataatgaaggcagtgtcacgtcagagtctgcattcttactgctaagccacgccgccacatggcagtcaagacagcgtgctgtgtgtggagtgaccagcctctgtgggtgggcgagtgactggctgaaaggttgacgtcagagcatgctctattttaggttcttcaactcgaaggaaccccctccatcactcccacctcctgccaccctagttcctcattcctttccccaatattgttttcttttcttttttttttttttttgctgatttagaaatagacttgacttcctggtgctgagactgtttagatcaattaacactaatgaacattgctagttagctatggactttagttcttcaagcctctgaccttaaattttttttttctgaaggtcatcaattaactatttacttcattatggattagtaatcattagttaaatattgccatttgttctgtaggtcaccggtgtggttcatgcagtgaaaaaatcaagtgtttcagtgaaaagttgcagagagaaagaaaaaagagaatgagggaagacagaggagtatgtgtgtgtgtgtgcgtgcacgcttatgtgcaggggaaggaggttggtagtagtggtgtttagattagccttaaaataagaagcttgaaattaagggtaaaggtctggttccagatgctctaaagccatctgttatttacctggacagattttgatacctctcttctgtcctctaatagcatctgtgttctgactttagtcctggtacttacctggatatatggtaatttggccatttccatgtccttccagatggagcacctggcaggctgagtctgtgtcttttgtatcccccttacctgacacagtgctggcacacaatatgtgctcattaaatgcttactgaaatgacctagcacataaaagctttgtaagacaggagctttattttactctgtctgctttgtactctagacaccccaggtattcctattctgatttctgttgctgctatagacctgggtcagccttaaaatgaatataaatatacgttaatttgagctaatgggatgtatggaaaccactgcctatctaattaatttatttgtgccatgaaataaatgttttaaggtgctcctgagtgcagagcattctatcagcaggtggaatacaaagttttaaaagaggctagggatgtgggctgtgtcaccagaccttctgagttcaattctagatcagacactgttctggttatagtgggtcagagcacagattctggatctgggtttgaatccacattagaccacatacaagccttgtgcccttatgcaaatgatttaatctctgtatgcctcagttttccctcctttaaaatgggacaggccgggcacggtggctcacgcctgtaatcctagcactttgggaggccaaggtgaacggatcacctgaggtcaggagttcaagacagcctggtcaacatggggaaaccctgtctgtactaaaaatacaaaaattttacgagtgtgctggtacacacctgtaatcccagctactcaggaggttgaggcaggagaatcgctggaacccgggaggcagaggttgcagtgagccgagattgcgctactgtactccagcctgggcaacagaacgagacggtctcaaacaacaacaacaacaacaacaacaacaacacagacagtcatggggatgttgtggggttagggttgttgtgggaataaaatgagtttgtctgtaaagcacttggtaccatgttgatacctgtcactggtatttgttgttaatgaagatttagtgacttcatgtgtaaaacccaactgtgtcagtacttgtcttcatagaattgtggtgaggactgtatcagtttccgaaggctgccataacaaactggatggctcaaaacaacagaaatgagacaataatgtctcttgattccagagaccagttttgtgttggcagggccatgctctctgaaactgtgtccttcctggcctctgcctagcttctctttggcactctggctggtagatgcgtccctctaagcccctgtcatcactggagctctttctgtgtgtctcatcacatggccatcatgttataaagacaccagtcagactgggttaagggcccacccttctccactatgacctcatcttaactgaattatatctgcaatgaacttgtttccaaataaggtcacattctgagtggggttaggacttcaacacatctttctgggggatacacaattcaactcataactagggtgaaatgcgagactccacatgaagtattgaacccagaacctctaacaaaacagtgccttcaacatcagcggtttctgtttttacttccccatactcctgatgacggccctttgtggggtggctttgggcagttctctgaacatctttgaatttctatttcccatcttttcaccgtgatgtggcacgtcttccagcaacactgaattatgtagttttcctggtctgcattgcctcatctctgaaatggggagaaaggagaaccacctcccagaagggacccccttcccaggatgacatgagggtacacacctatgtgctggtggtctggacatgcgagtgcttcccacggttgctacccctccttttgtgcctggtgttttctcgtcagtgaggacaaatggcttttgtagtacccctgcaaaccactgcacagacccgaggaggctcctcttttccttcccatggaggtgggaagccagaggcgcatccagatgtgaggaggcttcgatttttcagacccctgggttgctttgcagtcagaatggagaatactttttttttccctacttgggagggagctgaacacatttgctacagagaagtctagatatctatggaaacagtcctaattttagccttgccacacttaatgccaactctgagagtgttgttttgggtcagggcctggggagtagggaaggtgagtaggcctgcaggggtcagatcaagcagggagtagccaaccgacagacaagaggaggatgcagtagaaatcttaagtggatccaaaggagctggctccaagggtaagagagggccagaatgatgagcattgatcagaaagttggatttcaaatgaaagggtctcccttcagaaagttggatttcaaatgaaagggtctcccttctttcccccttttgctctccctgtctacattctgctcatttttggagcctcgttcatggcccttctttccacaaccccacgtttggaatcagccagtcctgccctgagtgcctggcatcttagaattctgttgaagtactagtggctgcccatttagttttgccgtgaatccgtgtaccttgcaaccccctttccatttagttttgagcccctcaaggtcagccatggtcattgtcaagtctgtgtgctgtgcctgccatggggtagacatacagtaaatgcatgatgagttgggatttgacatgataggtgatttctggttgaccagaccagggcgtgggcaatcactagaaaggggcatcaaatgaaggagtttttaataagaggcacagaaatgtttttgatgggaggaatctgcctggttaggggagtggaaattgcctgtaatacaattaaggacatgttagggagggccatgggcaagaggaggtcatggtgtggcagatgctggctgggatggtgagggaagtgagggacagtaatggttttaggccacgtggggagcatcacctaacctcatttcagccctgtcctccccaccaggtgaactcctagcaggaatccttgtagatcagatacaggaagacccttagacatcatctcgtctcgaagtgtggtattcaagacaggcatttttacactaaaacttggctcttaattttagtacatgtataaaagccacatagaactagcattccaaacctggcgtttctcaggtgtttctgcttccgacgaggccggctgtggtagttgcctctcagtcccatggattacagggtgctgttcccacacacccatgcacatgtgagacctgtaatgagcacagggcctgttgtcaccatttggaacgaagtcttatgcagatggacgaggttgctggtatgaattcttgcactgaattttcatatgctttgtattcttttcagcaggatgaaatgtaccgtggttgtgggaaaatggagcgggtagtgtgctgcaagagattacagggtaggctgcttggatccggtttggccctctcctcttgaatgaggagggaattgggcaagccgcaggtagaccaggtggccccgatagatagtgaccgaactggtacttgagctgcatctcctcttcttgtctagccatcttggtgttctaggtaggacatgagctaggtcctaccaaagacttgggcactttatttaagttctctcatgtaatcctactaacaacgttgtgaagcatgcactatttttacttactaaacaaaaaaggagcgatcgggactagaggacttgaaataactttctgaggcccagcctgctggtgcgaagtagatccagtgattcaacgtggctccatcccatgacatttagctgtcagggagctgcaaacctatgaaacagagctttcagattttggaaatagaaacgcaggcagcatagtgccacttgctgcctcctgggaaagccccttgtcgtgaataatagaaccagcgctagaaggcacgttgctcaggccggcaggtgagtccgagggctggggaggggttttctgggcagtgggacacctccctcttagggggtttcatttgtccagggccagtgaaaggctgtttggtccctctgctgagtgaacagtcccagcccacaggatgagtcagagcagagtccagaacagaaggcagagggcatgtgtgcaaaggccatgtttatcccaggcatttggatcttaagattcctgttcatgatgattaaggttttatacataacactgtttacagactgctttatgatcatttatgagtgtcacctggcaacagctgagttagccacatccatccaccgtggggtaattaactctgggcccacccagagcccagttcattgcttgtgcattattgagcctcctccccacaccctcattcattcatctatccatccatccattcattcattagagccctttttgtcagatgccacctttgtgggtagctttgtggttggcatttctttttcattgctgagaatacgtaatatgctggacatgttggtgttcctgttagcgtaagcaataatcaacccctttagtgagactgtaagctccatgagggcaaggcctttgttcatttctatgtctctggtgcctagaagaatgcctacccatagtaggtgctctgtgaacatttattgaaaaaaaaagtgaatggactgagtgtctgctatgtttgggcctgtgggaggtgctttctataaaagtctttctaatcctcgcagcaatccaccgtgcaccataagggtgtctgtcgtccattctagggctccatctggtgtgtgtttaccattatcataagcattattgtgagtgcttccagagcagataatccttattatgactgaataatgtagctacattatccccattttacaaatgaggaaatgaggcacagagaggtgaagtaactcacccaaggtcacacagaccctcaagcttcaagctactccttcaccttcatatcagcactgtcttacagaaccttctgcaggatggaactgctctccatctgcaccatccgatgttgtcaccgctagacatgggtagttactgagtacttgaaaggtagctagtgcaactgaggaactgaatttttaattttgtttaattttaattaaatttaaatagccacatgtgggttgtgactcccatactgggcaaaacagccccctatatgctgtctctaaagaacaacaggctgggtacagtggctcatacctataatcccagtgctttaggaggctgaggcagattgctttatgatcatttatgagtgtcatctggcagcagctgagttggccacatccatccaccatggggtagttaactctgggcctacccagagctgaggccggaggctgaggcaggaggattgcttgagcccaggagttggagaccagcctgggcaacatggtgaaaccctatctctactaaaattacaaaaattagctgggcatggtggtgtgcatctgtagtcccagctacttgggaggctgagatgggaggattgcttgagcctgggaggcagaggttgcagtgaactcagatcatgccactggactccagcctggatgacagagcgagaccctgtcaaaaaaaaaaaaaaaaaaaaaaaaaaaaaaaaaaaagaataacagctaacattgaatgcttactatatactgagtattttttaaatgttttacatttaaaatcctgacaaccacaaatgaattaacaagagtcagaagttaaatacctcctttactctcaagattttatggcaagatactagtgtagctggattctccccaaggatgcattctgcctggcccagagttttcaactatcaccctatttttatccttattttccctgcgtacagcaagggatatcaccatggaaaggatctcattgttcataatatttgtcagccccaaacacaatgctacctgccaccctccttggtaaaggggtcaacctatatgcaggcttgcgaactcactgttcccaccaaatgactcatttaggttgaaaacatttatttgcacaaagtggagttgtgtcagtgtcactttgaaaagaaaaagacgccaatattccctaccaggatgttctgtcatgaaaacaaacagatgaaacaaaatctacttcgaggtcagagtgagaagaagagaaggtccggctgaaattatctgcagtcttgctggagggaacaaatggttgcagctcatgggtatagtggcattttacggctcccagctgtgccttcccttcttgaagatgggtgaaggggagtaggttctgggctagacttggggctatggagcaaaagcagagggagcttgtcctgcacagacgtggaagcagaggtcactgaattctgttccacagtagaagtcagcagtactttatgataacagtgcatccaaacgtgttctgtctgctgggctgggcctgacacccacggctgtgactctttcagaaactgcgaaccaacctgtgggtgggccagggatccaggtcaggagcagaagtaggttaaaggtgatcgagagagacatgtgagagagtgagcgagagatagaggcctgcaggataaggccacatcaggagtacagtccaaatataggcagtgattgtgaaacccagggactgtgggctaaaagtgctgtagattctgaaagtaggaagaggaaaaatgtggccacgggcctctggggaaagccctgttctgtgggctttggccacttaaatctatatgtcttctgctgctgtctcaaggcagtgatgcagccctgactatccttctgcccatctatccattcatccatccatcagtccagcatttgagtctctattctatgcatggtactggggatagtgtggtaaacagggcaccatccctaccctcaaggagcttacagtcttgcctggtaaaatgtacagaagcatgcatttttgaaacaagtaaaggaagaagacttaggcgctctccactccaaggccacctgcaccttgcctatgtagctttccccagcaacacgaagccagcattggtttcttaagttcccttcttgtctttatcatgtatgtacttagtatctgtattgtgctttgggctatttatttatatcagcatagcactttattgcatctttattgtaaataaccttcctgaacataggggcctccatgtctttgctgggtcctagctccatggtaggcactgatgggggctccaggattattgaagtaaatgagagccccttaaacctacaaggaaccttaatggtcatcagtggtctgaagggtcttcttgacctttcctgcctcccagcttcctcctgtctctgtcaggtcaagactctacctgcctggtaggttctgtacaaaccattgccaggcaatggaagaagaaaggggagctgcacccctcactggagttggaacttctgtgatgcttgtcatagctccatatgcctcacattcacctggaaacatgggaggcgttagttaggccagattaacagatgtgggatgccatataatgactttgccttcaagtgaaactgcagtccaatgggagcaggccccagacattggcctcctcaaaaccctgggttacttttagtgtcttccagttcaggaaccacagttttcaattttttgaaaataaaagtactcctatctcctttcattttttttttttctgagacagagtctcgctctgtcatccaggctggagtgcaatggcgcaatgtcggctcactgcaacctccgcctcctgggttcaagtgattctcctgcttcagcctcctgagtaactgggattataggcatgcgtcaccacatccagctaatttttgcattttttttttttttttggtagagacgggggtttcaccatgttggtcaggctggtctcgaactcctgaccttgtgatccgcccacctcggcctcccagtgttgggattacaggcatgagccactgggcctggctcctcctttgtatttctaataaagtttacctgaacttacagggtcttctagaaatggggatgggattgaccaggcattgtcagccatcccctggccccatcgtgaggcaggagactgttgggcaagccgagacggcagggaccccaccctcttgactgctaaaggaaataaagacaacagcattattgagtgcttctccatggcaaatgctttgcctcaattacctgatgaggttggattaacctccatttcagaaatgagggaagtgaggcttgcagaggtggcacgcccgagataaaggagtgactgagtggcaaagctgagacttgaaccctaaactgtcggctcccgtgttcctgtgtgccacggtgctgtgtgagaagtgggaacggtgagttccctgctgggctcagtatggaggcaaaccgctttctgcaacacattcctatgctctcggacagcttaattgacttctgtgccttaattttctcatccgtgaaagagtataataataacaacaataataataatagactagaaattggccaggcccttggtgaggactcggtgcgtgctacctctgatagatactaatatgtaggtatagtaggaacatcaatcatcaatattgttttgactcttttgacctctgataaaaaattttgaccatggactgccctttttgtgttaatagatttgttaggtcaatgaaaacacagctctcacaagaagaacttatgttttataacaccaagcccacaaacgaacgtcatggtggcccccgaggacacgtgacagagctgggatttgaacccaggcctatctagcctctgtgtccccacactgtttctcttgggacccaggtgtccggctggccctcagcttcctgcgttcctggtgattcggccctggcggtcacagtgtcaggtacacccactcagagtgggtttatgatacagttaggaaggagcccaggccacagcactggaaaagacgaaattgtagtgttgatcaaggccaggagcctctttgctcagcgactgccgtcaatcctcttccctgagaagatcgcctgtattgttcaagatgttcggatataacctcccccaggaaggcttccctgatgtcacacacacctctgtcgaaggctcccaggtgggccgaacagagtcttcctttgctcccatggcagcttacaggatctttggcagccttttccatgatgttttcttcccaggggtttgtgtagcttgtcttcaccacttgccgtgagctctcgaggacagaggatttgtctgtgttagaaacatctggttcctgccgggcacggtggctcatgcctgtaatcccagcactttgggaaggtgaggcaggtggatcatttgaggtcaggagttcaagaccagcctggccaacatggtgagaccctctgtctactaaatatacaaaaaaatgagccgggcatggtggcgcgtgcctgtaatcccagctactcgggaggctgaggcatgagaattgcttgaacccaggagacagaggttgcagtgagctgagatcatgccactccagcctgggtgacagagtgagaccttgtctcaaaaaaaaaaaaaaaaaaaaagaatgtctgggtcccaaaatccacttttcttctactgaggacataggaatggtcaccttccctgcccttttctagggccatgtggctcattctggccgaagggtggtgagcagaagtgagttgcataatcccagtgaaagcatttatttgcgggtgcaagatctcctggggctggcgcgaagtgctggggggcaggactgaggagtggcaccaaatgctgcgtaggagagttctccagatttgacagtcaaggatcctcatggcagcatggagaggccaggcgtgtctgcgtggccattctgtgggtgaggagcctgaggcttagtgaggttaattgcttgtccaagggatcttgtgcaaattccatggcttgttctatggcaatatgctacattcgctgttatgatttcttgttgttgctgtaaattgtaggctaagggtgtgtgtgtgtgtgtgtgtttgtgtgtgtgtgtaggtgggtgaggagtgggagtgaggaacagctagccgagttgcagtgcttggtccttttgcagaatgggtgttagcaaaggctggcatgcttagcccaggtggtggctgtactcggccaccaagttaacgaagagaaaaacgagttagctgttacctcctctcagatgtcagttttcctttaatgtggagctttggagagaataccaagatagggctgtgcttactgaccttttccttgccgcacagatgggaataaggggggtggaagaaaaggaggaagaagagaggtgttcgaggcagaggctgcctgggcgatgccgcttcgttacccactctcagcctaaggaagcgttgcccaccctgagattcagggttgaaatctctctagcgacagtgcccaggagtgcaggcttcacactccaaggaccttgctgagggtgcatggatgtacgggcaagggtcgtggttgtggtggcagtgcagtaggtcatcagaaaggcctcaggctggctgcgcccacggtgttccccgtgctgactccagcttgcaggcagatgcaccattctagttgttgtgggcagctggagtgggggactggcccaggagggtcagggtagtggcctggtagtttgcacgtgttggtcttgcccccgctttgccctggtgagcgctgaagtcatgtttgtgtgagccaggcattctcctgatcacggttgcacgcccatcctcagaagagccccctctgaggtgctgatcccaccaccaccttcacagctcaggacgctgagtgtcagagaggctgggtcgctttcctcaggccatgcttgctgctgagtagagaatccagtgtggagccaggacactgtgaccctggagttcccaaccactaggattgcccctccaggcccttaacttctctggccacaactttatttcttattccgaaaacaaagacagtgggagaaacaaatatttatttgaacatctatggtatgccaggtgctatgggttagactgtgtacattattttatttaagtcttatttcaagccctggggttaagtatcagcttctcgatttaaaaaaattcaaaaaaggccaggcatcgtggctcacgcctgtaatcctaacactttgggaagctgaagcggtaggatcacttgagtccgggagttcaagagcagtctgggcaacatagtgagaccctgtctgtacaaaaaaatttttttttaatttaaaaaaaaatttaaaattttttaattgtaaaatacacataagattgaccatcttaactatttttgggtggacagttcagtagtgttaagtatcttcacattgtcgtgcagccaatctccagaactgtttggatcttgcagaactgaaattgtgcatcctttgaacaagaactccctattttcccctcctcccagcccctggcaagcagcattctctatgggtttgagtcctccaggtactttatatgagtggaatgatatagtatttgttgttttgtgactggcgtatttcacttagcatgaggtcctcaaagtttacatcacatggtgtagcgtgtcgatgatatttccttctactttatatgtatgccacatagcaccttggtttgcccatttatctgttgctgaacatgtccttgatgaaccatacatgtcataatgggttgcttccagctcttgaccacattttgttgatttcgttaatcattcaagaccaagaaaacatacctggatttaagccccggtctctgtttgatacctgacttctgactgctttttacttccaaggatcctccagctttaggagttgagaagaattttatacaatgtggcctttgttaagcctgaaactgctttgggcctgttgaaaactcccttttattttctgagtccctactcagacaacacttcttccagaagcctggtggggaccaagtttataccgccagaggccacaatgtaaggtgaaggctttttgtttgtatctgttgggtgcccgttgttttcctagtgtcatttctaccttttcccaaagctcgtgcgtttgtttccatattttaaaaatgactatgatgagatgtcgttctgaaattaggaagtacagtaatacaacattattatcatgatacaggtttgcatttataaggtgagctcccttggggctagtcatttttattttttttaattatactttaagttctgggatacatgtgcagaacgtgcagttatgttacataggtatacatgtgccatggtggtttgctgcacccatcaacccgtcatctacattaggtatttgtcctaatgttatccctcccctagcccccgaccccctacaggccccagtgtgtgatgttcccctccctgtgtccatgtgttctcattgttcaactcccacctatgagtgagaagatgcggtgtttggttttctgatcttgtgttagtttgctgagaatgatggtttccagcttaacccatgtccctgcaaaagacatgaactcatccttttttatggctgcatagtattccgtggtgtgtatgtgccacgttttctttatctagcttatcattggcatttggattggttccaagtctttgctattgtgaatagtgctgcaataaacatacgtgtgcatgtgtctttatagtagaataatttataatcctttgggtatgtacccagtaatggtgagagacaggactagctggatttcctaggccaactaagaatccctaagcctagctgggaaggtgaccgcatccacctttaaacagggtgcttgcatcttagctcacacccgaccaatcaggtagtaaagagagctcactaaaatgctaattaggcaaaaacaggaggtaaagaaatagccaatcaactatcacctgagagcacagcgggagggacaatgatcaggatataaacccaggcattcgagccagcaatggctaccctctttgggtcccctccctttgtatgggagctctgttttcactctgttaaatcttgcaaccgcactctcttctggtccgggtttgttatggctggagctgagctttcgcttgctgtccaccattgctgtttgccacagtcacagacctgccgctgacttccatccctctggatccagcaggatgtccactgggctcctgatccagcaaggtgcccattgccgctcccgatcgggctaaaggcttgccgttgttcctgcacagctacgtgcctgggttcatcctaatcgagttgaacactagtcacggggttccacggttctcttccgtgactcgtggcttctaacagaactataacactcaccacatggcccaagattccattccttggaatctgtgaggccaagaaccccaggtcagagaacacgaggcttgccaccatcttggaagcgaccggccgccattttggaagcggcccgccacgatcttgggagttggaactcccggttccaacttgggagcaaggaaccccggtaacaatgggattgctgggtcaaatggtatttctggttctagatccttgaggaatcgccacactgtcttccacaatggttgaactaatttacactcctaccagcagtgtaaaagcattcctatttctccacttcctctccagcatctgttgtttcctggaggctagtcattttttctcaagcccaggtcttaagcagataactgccctgggtgtgcagtaatatggtttatggtgtcaaaggcgagatctcttgtgtgataggctagagattctctctgatgcactcgattatcattttctatttaaaataggcattttgtttatctaggagagcattaattactaattactaacatttaccgataaacaactataagaaatatttaagtaagtgttttgttagtatgtgtccttgaaaacttactgcaagtgaacatgtaatttaacttggcctttttctgattgcatcgtttcttgccgttgcctgtccagtgggagtatttattgaattcttgccctttggggcttcccagctgtctgggtatcaaaagctcccaatggatttttttctcctgcccttgaggggagtctgttccttttggcttccagcttagaataaaagagccactaatctgtctgccccatgaacctttacttaaagatgttcttttaggctgggtgcggtggttcaccgctgtaatcccagcacttctgggaggctgagaagggcggatccctcaaggccaggagttcgagaccagtctggccaacatggcaaaacctcatctctactaaaaatacaaaaattagctgagcctgtaatcccagctactggggagactgaggtacaagaatcacttgaatccagaaggcaagggttgcagtgaactgagatcacgccactgcattccagcctgggcaacagagcgagactctgtctcaaaaaaagaaaaaaaaaagttattttagctttttctgcttgctcttggaaaaacaaaaattagggagcggcggggagacaggagaggataatgacagacaggttcatctgacaactaaccttaaaggggccttgtctatttttcagaacctacattaagaaacgcattcagatgcatcagccgtttgtaaagcacctgtcgtgagccaggtaagatgtgtagcgttttcaaagctgttttattaaatcctcacagaaacctttccaagttgccgtttttcagcagggcgatctgtgctgaagtaagctacctcgcttggctcacacagctaaaagtagacgcaccagcctagggcttggcgttgtccgcctctaagtttagggctgtaatccggttctttcaccaaagaagacacagtggctgcctcacagggacctggaaacagtgtctaattcccagttctggtgggatttcccctgtgtcttactctcttggctgatgatcagtagatctatttatcacttctaggagctgcgccttaagtcttcatttcagcctcttcgtatggacctcactgaggctctgagggggaagtgactgcttagacccaccacccacccacccagcttgttctgtcgggaatggttctgaccctcttccatggagaggcatgtgtttgtctgggtggagaacatttccagaggagcatggccccctgagaactggtccgggtatggccacagttcagcactctggttggattctgcacatgaaacattttgaaatcttttcagtggaagtttggttcttggacagctctcttctgctgtcccctaaaccccctattcctactgagatcagaggccatttgttgtacatagtcatcgcccaggtgccagcgtagggctgggtgcccgggaagcctccagtaagcagcacagaggtgcggggtgcgtctcaggatgccaagacttgatcccgactccatcatttattattcctgttctcttaaccttttaagcttcagtttctttgtcttaataaaaagggggcatgtgaagagatgacagtagtccttcatggttttgctgtaaggactcactgagcaaaaaacgtgtaatgagggcaggtatgggctttattaatttttgtatcctgaggttggtattcactacatattcatcagaatgatgatgaaaaagtaaggaacccccccactctgagtttcatttgctccacttcgaaaactaagatactggtgttaatctgtggttcctgggggcagagggctgctcatcagaaattccttgagggcctttcccagaagcacaggaccaagccccacctctgaaattctgattcctgccatcttggctggaatgtggcatttgggttctgaaacatgggtcctggggattgtaccacacagccctggtgaggcgtgatgggccctccagaccctgaggtctctcgcctgatcctttctgggttgggcaggttgggggcacatggagtggctagcaaatggttagggttctgacagtttcccactccacccctctaccttccacccgttcttcaaggcccactttatttttatttatttattttttttgagacggggtcccgctgtcttgcccaggctggagtgtggtggcgcgatctccgctcactgcaagctccgcctcctgggttcatgccattctcctgcctcagcctcccgagtagctggaactacaggtaccgccaccacacccggctaatttttttgtatttttagtagagacagggtttcaccgtgtttgccaggatggtctcggtctcctgacctcataatccgcccttctcggcctcccaaagtgctgagattacaggcgtgagccaccgtgcccagcctaaggcccactttatatgccaccttctccagaatgactgcccgggcctcctgagctggaaagtgctctctctctctgctgaatgccttgtggtcctgcctctggggttttgtaatgctgcaatcagccataagcttgtgaaggacgcggcctcgcttgatgcaacatggcaccccacagcaccttcgccgggctcttgcatccagttggcatatcattatatatttacatatgtcaccgatacatttatgaataactgtttcaacagctaactctttggctttataaatcacaactgcatctcccaagattccttctgtgtctcttcagaccagtaacacagaatgtctttgttaaattggacctttttttttttaaataaactggagacacttggggagaataaaatgatgtactctgcttttgtaattagctgtgatgattagactatcttcttcataatgtcttatttttacttgctttggaatttatcaagtgctctcttttctatgaaggttacccttcaagtgagtaagggggcttgattagaacactgggggatttaccttgtactttttaaaaataagactcatgatggagaaggctgatgtgagccgatggtgaaaggtcagcctggagctataaaaaggggtctctgagctgagaaactgaaaccgatgctcccagaccaagattttttttttctgccatcaactgctgaagtaattaatagtcacttttattttagaatttgttttatatttaacaaagcagcctgtcatggcttctcttcatgcccagggcaaggtcctttcttttttttttttttttttttttttttccccttaagtgcatttataattacattgatcagctctgagtttgtgatatgccaagtccttgaatgtgatactcatttgctttcacgtttttgatgcaaatggatcttggaatccattctagagtgctttggtagattttttaatccacaataggcaatttatcttgttcagcctctacaaggactgtctggtatggccggtctgggcatctggctggccacgagcctgcccagtagggactcagttgggacctgctgagagcagtttcactttcgcatttgcttcctcttgtccacagctgaactgagaggtgttctcggggatccctagagtattgagaacaaagagcagaaggaagagcttgcatacttctattttccatccattcagtgaatatttagtgcctgccccaaggcaggttttgaggatacagcagacggcacaacaggcagacatatccttgtggacgtgctctggcaccaagctgtttccaactcagcacatgtgggaaaggaactggcacttttttgtatccttgctatcttcggcatatgtgggcatacttatttaagcctcacaactgtctgtgaagtaggtattattaagggttatgtaggccacatgtatctgtgaacatcatactggtgtgtggtgttttgcataatagagctatgaaattatgcagctggggtttgaaaataaaccctgcctttggccatctagatgttgaacaagggacttaaatgctcacagcctcctcctcttcccctgttttgaatgaggctaaaggttggacctctcaggatcatttggtagttaacactttgcaagttggcatggatacacacaggtattgtaaacctgtgtgtgcttgaaaagcagcggctgtttctgcctgtgattctggagttacttctggatttgatcctatacagaatgctcttatatcctgttcattatagggaaggaagcttgtggcagggaatctgcagacccacgttccacctggttctatcatcaaattgtgtggtctcggacaagttcctagacctctctagttctcagttgtcgcatatctgaaatgagacgatggtgctgatttccctttggattaatttctccttggattaatttctctttggtggctttgtttaggcccccccttcatttccatcaagactttctcatgtttcagtttcatatggcggagggcttgcctggctgcctcattgatcactgtgaccctcgcctggcattcccatccctctttaccctgttctgttttttctttattttcatagcacttatcacttttctttctttctttctttctttttttttttttttttttttttggagacggagtctcgctgtcttgcccacgctggagtgcagcggcccaatctccactcactgtaacctccgcctcccaggttcaagcaattctcctgcctcagcctcccaagtagctgggactacaggtgtacgccgccacgcccggcttattttttgtatatatgtttttttagtagagacgggatttcactgtgttgcccaggctggtctcgaactcctgagttcaggcaatctgcccgccttggcctccaaaagtgctaggattacaagtgtgagccaccgtgcccagcctttatcgtacttagcactttctaacagactgtatgtttttttaaatttgttgtgtttatttttatagacaaaaaacacatgttacctttgctggaatgtaacctaattaaggggcgaaatctttatcgatcttgtgcccagaccaccttgaagccatgaagggatgctcaggaggctttgttaaatataaaacaaattctgaaataaaagtgactattaattacttccacagttgatggcaggaaaaaaaaaacttcatctgggagcatcggtttcagtttctcagctcagaggcctctttttgtagctccagggctgacctttcaacgttggctcacatcagccttctccatcatgagtcttatttttaaaaagtacaaagtaaataccacaaacaggtattgtgacttgtggaacaagttgtcgagaaaattacaaagaatagttccttctgctgctatctgcttagagccagcctggctctaatagctggggcctttgtgtgttctcttcttgggcataaagagtttcacagaatacaatatagagtgatggagtcactctatgttggtaatagaacaagacaaaaacaagaccactcaatcatcaacactgagcacagataaaagcaagatcactgcaaggcacaaaaacaaccaaacattccccagtctcagctcacacgaatgtttctttaccgattatggctttagcctcattctgttcctcctgcctcttagataaaaattaggaagctacgtcatcataaaatttctgctctgttgacagcacccaattcagagcaaaactacatttccctgagcctacccctaaatcactgaacacagtccaaattgtataatgagctcctcctgacatcctcttgctgagatctctgaaattctgcctgttgtagtgtccaccttgctgcagtgaaccaatgaacccaactttgtttgaccacaggtatgttcctggtagtctttaactggagccggtggcatagtcgcttggtgaataaaactttgtcctaggcatcactgtagaaatgtgtaggttattttacagctgaatggtattgaatagacatgtacacagtttaattggagagctgagtcacttgataattgtggaaacagagcaggatgtgacagaaggcagaaatgcaaaggttgggtaagtgtgcctcgaagtaagtgacttgagagaaggagaaagcctagaaggctggggcggtagagagaaggtagctagggctggaagacacagtggggtcttgagtaaatcgcttgtttaggagtcaagagacccaaggtcttatcctggatttactgcatatgagctgttaacaagtccaattgttaggtttttcatttgtaaaaaacagggtcagtaatctctcctccttatctcacatggtagttaacttgtgtgaaacaccttgtaaagtgtcttgtgctggaaaagtgtaaggcctggctctaattgtggagagaattaaaaaacatgcagtttcaaggtgtttcacccataagccaggtgccaaatgatccctctctgtcttccaccacccaaactttagaaatgggggttgccataggaaccttgtcattatcattcagcagctatagacttgctcaggtggtgtctttttttttaagaccggttaggttacttatagggtcttgggagcaggagtgtggtgggaggggcataagagagaggcagggatagaattagaatggggagccagcaaaactcttcctccatcagatgaggggcctgggatccagctgctacctttatgccctccgccctatccccctccactctgagtcagacttggttgttcaaggatttaaatgggaaaatgtgttagccagattatccttccaaataaggttataaagtctaccgtattaaagaggggaagatttccttctgtggaatttcagatcttgataatagtaatggtaataataataatacgactgtctgtcatttattaggtgtttgttatatgctggacactggattcagcatttgtgggtgttgcttcctttagtacttgcaataaattcattgttatccttctttgcaaatgaggaggcggaaacctagaggttaaattacccacccacagtcaccagccagctggcctcacagcccagagttgaactaggtccctctgacctcaagtgcggaagacttaagactctgctccctggtttccttgcagataatcctaggatatgagagctattatctagaacactcgtcttttagatgggaaaataggggttagaagaggtgaaatccctgtttgaaggccgtgttattgctgctgctggtggtagggcctgggtgtggcccgagatcttctgatcctcagtccagagagtgaataggacttttctcctgatgggtttaaatatgagtggttgtggtcgctggcagtttctgcaacagaagtatggtcctccttttacttttctgtggaaaaggccctcaagctacagaaccagatcattgcacccccaccccctaccagccatctgaccctgggctccttctttaatctctccatccctttgtatttcctcgtatggaaaattgggataacaactgtacctataccttagtattgtaataagaactaaaggagtccgggcgcagtggctcacgcctgtaatcccagtactttgggaggcagaggcgggaggatcgcctgaggtcaggagtttgagaccagcctggccaacacggtgaaaccccgtctgtagttaaaatacaaaaaagttagctgggcatggtggtgctcatctgtaatcccagcttcttggaaggctgaggcaggagaattgcttgaacctgggaggtagaggttgcagtgagccaagatcgcaccactgcactccagcctggacaacagactgagactctgtctcaaaaaaaaaaaaaaaaaaaaaaaagagaagaaaagaaaaaagaactaaagggattaatatgttgaaaactcatagcctggtgtctagtacccagtaggttatgagtgagtactgcctgttaataatgtatcgcatccctcgtttgaaggatgtagtcctaatttgagtttttttcagtagactggagctcctgccctcaccctatagcattcgtatcctctgagatacatggatactgttgaagttatggtgaagatgatggggtgctgggaggtggagtggaatgggattgattgatgaaaaaacgacattagcttgctaaggacacccaggtggttgagatgttctgcgaagtgggcctgtgtgtctgctggacctggagttgaggggacagctttcttctgaggcagcgtcttatcctggggtgactccgggaggcaaaagcattaactattgatgagactgatgacacactatcattcctagaccagaaatggtgcaagaacagagaggatttatcctgctcttctttctctacacagtccctgtgtcagagaaggtgtctgctgagtggacaggccaagaactgttctctgggacggagtgcagatgaagtagggggtgtaaacccatgaagaacaatgaagcagagcgagtgaagcaggacaggctggggtggaggagaaagaatttgcctttattgtgcaattagccttttcgattctttaaaagctttaggagatagtgaatatgtccctccaatctacagacccgaagaggcatctcgggaaagtgatttgcccagggggacagatcaaggacctgaccccaggtccctctctctgcctcagaggccctctgggatccattaaagggtcttgtcttgagtaattaactgaatactggtttattcagaatgaggggtctttaattgggggataggcatacctttggtaaaaccactggagtttttgggcccagtgtctggcagtgtgcaaggagcgtggggcatctttggcacaacgcggcttcaggaagagccctccttcccttcctgagtaaggcagagtttgagtcaggctggggtgggctcctggtgtggggacaggttattgtgggtgctggagggaatgactttcactctgagtcattcagtggcctgcaggggtgcagggctgggggtggagagagaaatagagggctggccaaagactctcagtgcctgccctttcttacccctagggcccatgagcctggtttaaaaaccgcttatccaccacctcgttttcattctcacacactgagtcctttagacgtaagcctgttggtgaggaagactgttgcagtggctgagatgtgctgggcgaaagattttcaactagtcttttcctaataagcacctacttgtttatattctgagctttcacagcagcattctagaaaaaagaaatacggaggactcaaaaaaaatacgctgcctgatttagttttgattgctcacgtctctggcttctttcatggaactattaattgactatagggagtagctgcttttcgcacaataagctcctagtcatgaagcaaaatggtgacattgatcattttggggtccctcagactctggcaacgttgaaacaggctgtcagttttttttgtaaccaccagttagcatgagtgggggtggcagaaattaccagtttgatttttgatcaggggctatggcttatacttaagctatttggagggaggagaaagcgtgaatgagcgagttaaggcagtagaaagatggagccatgctgggtttttaggcagttgtttcaaaaacaacacaaagtgagaaatggtgaaaaccaggaactgtttggctttttctagtttacaatgagagaagaaagatgtttggggaattttagaagacttgagtctatcgtgtagtacatctggtggagtccttgtacaggtcagttcacagcgtaccactgcttagaagtggactggatttaatggggctggctatttattcagcaacaacttattattcaccttctatgtataaagcactactctgaataaatgtcttctaaattgttagaatctaaactatactcaatattgttaccatgtgaagcatatcttatggaattatgattttttaaaaaactgttactcccatgtcattaaatgaaaagtttcagaacaatggtagttgaatgcagtttgggtaaaactgtgaatatctaatattctatatttgtgtatgcatgaaacattttggaagatggataagacactgtaaaataatcagtctaataaagtcagtgttttaatccatggttgccagcatcacaaaagagaaacaaccagatgtcatgtgcctcttgatggaactttatcggggaacctgccccgatagtcacgtaggttcttttctattttcctaagcgtcggctggcttgagaaataaaggacagagtacaaaagagagaaattttaaagctgggcatccgggggagacatcacatgtcggtaggttccgtgattccccacaagctgcaaaaaccaggaagtttttattagggagtttcaaaaggggagggagtgtacgaatagggtgtgggtcacagacatgaagtacttcacaaggtaatagaatatcacaaggcaagtggaggcagaacgagatcacaagaccacaggacaggggtgaaattaaaattgctaatgaagtttcgggcaccattgtcattgataacatcttatcaggagacagggttttgagagcaaccggtctgaccaaaatttattaggcaggaatttcctcttcctaataagcctgggagcgctatgggagactggagtctatttcacccctacagccttgaccatagaagatgggcacacctagtgggggccgtttatagacctatacccccaggcatgtattctctttccgagggatgttccttgctgagaaaaagaattcagtgatatttctcccatttgcttttgaaagaagagaaatatggctctgttccacctggctcaccgttggtcagagtttaaggttatctctcttattccctgaacaattgctgttatcctgttcttttttcaaggtgcccagatttcatattgttcaaacacacatgctctacaatttgtgcagttaacgcaattatcacatggtcctgaggcgacatacatcctcctcagctgacaggattaagagattaaagtaaagacaggcataagaaatcacaagggtattgattggggaagtgataagtgtccaagaaatcttcacaatttatgtttagagattgcagtaaagacaggcataagaaattataaaagtattaatttggggaactaataaatgtccatgaaatcttcacaatccacattcttctgccatggcttcagccggtccctccgtttggggtccctgacttcccgcaacagaacttggatctgttcaagaccctagatctagctatgaagtcacaggaagtatacagagggcagagatgcaggttaaatgacaaacagagacgctgtcatgaaaattcagacagcggaaaactctgtagaaaaacagctctgttcttcaccaaggaaattgtaaaggggaaaatttgatggcactggtggcttgtggattttagatgaagttaaggaattaatgttcttttcttagtgtggtaatgaaattgagatttaaaaataaagattttgaaaccctcaggaccaagatgatagtatatcgcggatttgcttcaaagtaatcacggggcggggagaaagggagtcatgggaatgagtaggttagagaggaaacaaggctgtaattatcatgacttgataattactgatattgggtcataggtacatagggactctcttgttttaatgtttttaacatttttcataatacaaatgttaagtgaaataatgatttagtctatttcttagccatttcctaaagatatgcattataaggtccattataggccaggcgtggtggctcacacttgtaattccagcactttgggaggctgaggcgggtagatgatctgaggtcaggagttcgagaccagcctgaccaacatggagaaaccccgtctctactaaaaatacaaaattagccgggcatggtgacgcatgcctgtaatctcagctactcaggaggcttaggcaggagaatcgcctgaacccaggaggtagaggttgcggtgagctgagatcgtgccattacactccagcctgggcaacaagagtgaaactctgtctcaaaaactaaaaataaataagtaaataaataagatccattatacatcccatcctggaatttttcaacttgatgtgatgctacaaagatgatctagttccctaatatcattccatgaacttctaggattctgggtttcccaggggctgggggaggtaagggagagagactcaggtaagtgggactttagaatcctgtaaatacacttcaatcacagatgcgtcacctgtgtgttttagatctttgcatttcccggaagattttattggggacaaaaagggggcttgttatttatagaaagaaaagtttgaggccaggcgcggtagctcacgtctgtaatcccagcactttgggaggccgaggcgggtggctcacgaggtcaggagttcaagaccagcctaaccaacatggagaaaccccatctctattaaaaatacaacattagccaggcatggtggtgcgtgcctgtaatctcagccactcaggaggctgaggcaggagaatctcttgagcccgggaggcggaggttgcagtgagccgagattgtgccattgcattccagcctgggcaacaagagccaaactccgtctcaaaaaaaaaaaaaaagtttggaaaccacactcttattttataaacaaggaaaccaaagcacacagaggggaggtgatatacccaagttcgcacggtaggcaagtcgccaatccccagaccccatggcagctgtttttatgctcttcagtcatgccggtccccagtcattacccttcagacctcttgcacaggggccccaaggaagataggtcacctgcattccagcttccagtgctgcctgatcgtcctaagtggaagctgtgctgaaattgaaatcacttcctgtgttcaaagcaccgaaaggagagccccattggagatgcacttactgcatgctcccagctcccagcttgctctttactaaactccctgtgccagggagcattatagcaggaggaatacattgaatttgggaaacaaacagtctcattgggactcttcctgggctagaaagcctgtatgttgaacacttaatcatttttaatgcttgtttcacctgctctcatctttatttgccctcaataaaaccaagaaaccttggacggtctcaagaggtatcctgtctttcagggttagggacactgtggaacacagaatctagggttgcaagtcttgtctgtaaattggaggttttttcttgtcttttttttttttttttgagacggagtttcacttttgtcacccaggctggagtgcagtggcaccatctcggctcactgcaacctccgcctcccgggttcaagcgattctcctgcctcagcctcccaactagctgggattataggttcccaccaccatgcccagctagttttttgtatttttagtagagacggagttttaatgtgttgggcagcctggtctcgaactgctgacttcaggtgatccgcccgccttggcctcttaggaaagaaaggagatgagtaaactagaagtgggaggaagggtgccgggaacagactgtgggaacagagttgcacatatattctcttacggccattttggaccagtggcctttaaacttcttttactgcactcaaacctgcaggataagacttgttttcatcagtaacatttgagtagaggtttggccaggttgtgggtacagggagggcttggggcaggggtgggacctctggagaggatggtggtgggactgctagagggtttgagtgcggtttgaataaacccccatatgcattttggatcttcctgcatccgctactctttccctgtctacctctgttgagacctctttaattttttatttttatttatttatttatttatttatttatttttttgagagggagtcttgctctatccctcaggctagagtgcagtggtgcaatctcgtctcactgcaaactctgtctcctggggtcgggcgattctcctgcctcagcctcccaaagtgctgggattacaggcatgagccactgtgcctggcccaaagtgccaatccttacagccaccctctctgccttccagtctggaagggacatactcccgacccactgcagtatactgaacaaagatgttcacacgcacagggcggtggggaaggagagctgacccattcacaagcagggaagatagaacggaaaatcaaggacagcttcacagaagagataaagcctgggttgggttgtgaggatgaaaaggatgtcttccaggaaggctaggagtatggaaatccagggccacgtgaacaacatagacaggacccccccagaggaacaaaacagatgccctgtttggagaactgtaggtgttgtggtttttttgttttgttttgttttgttttgttttgttttgttttgttttgtttgtgctagaatgggaaatgtgagtgagagagagcaacaggtaaaatgctggagacattctcaagagtaacatcccagctgccctctagatcagtagccattagcggcatgtggctactttaaatgagttgaaatgaaataaaattaaaaatacagttccttagtctcaatagccacctgcagctagtggccaccatattttagagcacagatgtagaaaatatacatcatgactgttgggcagtgctgggctgaatgtttccttatttggctcacatctgtcaagctgcacctggtgtttcgtgacacctgcacgcgtcaggttttggagtggcttgcttcgttttggtagaagagcctgtactggctgctcagggccacagtggatgtgccagagagattgaatgtatagttagaagcaatgtacaattgctcaagatatgaatattagtaactttgttttattttttagcactgctcagatgaatatataaaaatccgaagaaatatgttatttcccctctaagccagcagagctactagttttattaagcagacaatggcaaatctatttttaatttaattttttattaaaaaatgccctactgcttgagattctaatctctagctgaatagtaagtgtcattttcgagttgcgaatcgccagagcaacagcgtgcgtcgaaggcacttaataaataggattcggtgctttacgtccgtgtagagacaaaaatagatcaaaaagcttttcgattttacttttgagtacagtgttctgactttctagatggtaaggaaccatttagaactataaagggatttcgatttcgataacagtaactgtgtttaatgttacaaactttctattttgtaagtggctttctttgaagtcctgttggcagtttgttaaatattttagactgttatttgtgaccaagaggttcagtttggaggactttttgtgattcacccgtgtgctttaaaataatttgccactatttttggagtactcggtcccaggagatttgtgcatgagtcctgattttgtctcttagtagcagtgtgactcagggcaagtcacatagcctgtgctgaggatctcttggctttctgactttgtatttattcaccctgcttagttttcccagggagacccacactcacacccaccctttagcccatggactttggtggagatgatattgtgcagggcttcagggggagacataggactcagattattcctaatactggcttatagtaattggcttagaggtggtttcatgacctagttggagcccacaagatgtgatgaggcttttgttggggctgttgagaggtatgtgtgttctttcccactggccttgaactcagaggttggagctgcggatattgtagctacatccaacctagtagctgtcttgctactgcatggcatctgagtatgaagtccgtgtggatgagagcagagctgaggtggagagggaccaggccatctcctggacccagatcaaaccttgccacagggtagattcacctctggaccttacagattgtgaactattcagtcctttattttgcctgcattagtttgagttggattttctgtcactttcattggaaagctccctcaaaaactctgaaacattttttgtacatttgtaagaggaaaaaaaaatgagagtaacagaacagacgcaccttggcttagcatagattgcatcctgctaaacccatcgtaagttgaaaatatcaagttcaaaatttgcgtttaatacatttaacctacattacagcatagtttagcttagcctgccttaaacatgctcactttcattggcctgtatttgggcaaaatcatgcaacctaagcctaggtatattaaatactgtactgaaaatgaaaaacagaatggttatatgggtactcaagtatagtttctattgaatgcatattgcttttgcatcatcataaagctggaaagtcatccaggtgcagtggctcacgcctgtaatcccagcactttgggaggctgaggcgggtggatcacttgagcccaggagttcgagaccagcctgggcaacgtgacgaaaccttgtctgtataaaaactagaaaaattagatggtcatggtagcatgtgcctggggagtttaggctgcagtgagccgtgatcacgccactgtgctccagcctgggtgactgagcgagaccctttcccagaaaaaaaaaaagctgaaaaatctaagtcgaattatcctaaatcggggactgtctgtacttaccttatatctagggttgctgtaaagatgaaggagggcaatagatccaatagtactttaaaagtggtaaaatactagatatttgcaagaaaagatgctagaacctttcacaccaaattttgactgtgtgagaaataaatcaacaatgtagtttcacagctccaagctaatagagattaaactatattactctcagtattttgccaaagtgagttggtcttcaaaaatagttttaaaagaatgtatgtataaaaagtttttaaagacaggaagtaaaactgcaacaggatttcttattcatttttatgaccatttttgtcttttaaaaactaggtccctttttatgcatggattctattatttttcctagattttacagtgaggggatgtgcattttcttgagggggtgccgatttggtgcagtgctgctttgcatatattattaaatcaaatagttttataattgaatatgaagtagggcaaaatcctaaacctagttagtatgggtgtgcatttcctgcgtattcattttcctgtgttggtttacatagtttcttaccaccttcaattcggaggcattttagaggcattttctctaatgatctggcccatagatcgtttcataagtaaatgggatcagcagggttttatgtctcctacagcagaaggtgcctgggctttagggttgaatgcatctgggtttgaagcctggagcccccacgtttcctgggtccaggtgatcttctctggaacaatgaggggcatagttcattgtagtaggcatgcatgaaagttagatgaggtgacgcaagtcaaagtgcctcatacctggtaggtagttaataatcgcttttcttatttttttatttcatgtaaacgtgtgatttgaaggcagtcagtctgtctctagggaaattaagaattttagcaaagaatcaattggtccccatagcattcatattttaactgttcaggctactaaatcttattctcactagttgttctgtttttgtgatctatacaggctgcggtagaatgagaatgttctctattggcatgctaacatatggtcacttatttgttcagttatttatttgtttgttccaacatatgtgtaaatggggatcttctctgccaggggttgaggaaaacatgcttttttctcgctgatatggtttggatgtttgtctcctccaaatctcatgttgcagtgaaatccacagtgttggagatggggctggtggaaggtaattagatcatggggactgattcctcatgaatgggttagcactgaccccttggtgatgaaacagttcttactcatgagaaatctggttgtttaaaagaatctgagacctcctccctctttcttgctcccacttttgtcatgtgacgtgtctgctcctcttttacctcccaccatgattgtaagtttcctgaggccctctccagaagtgcagaagatgtgggtgctatgcttcttgtacaagcctgcagaaccatgagccagttaaacctcttttctttataagttactcagcctcaggaatttctttctagcgatgcaaaaatgaactaatatcctaaattatttcttgactttttggtgggtctatggactgggctatttctgaagccactgtttaggtaaaagcattggtttctatcagaaattctacattcacttcctctcctggcaaaggtttttctattatgggagtagttcattcctttcatttttttcctccctgatataaacaaaaaacgtggagagccgtcacgggtaagatggattggattaattctgcagacacaatcagggagacccaggagcctttgggggagtgagggagatgaacatcatctcaggaagaacttttaacctctggaactccccaccagtaggacggactgttccagaacgcagtggtgatctactgccaaagatgttttattaggatagaaatcgctaaaggacaattatttatttatttatttattttgctggggacagggtggagtgcagtggcacaatcatagctcacactgcagcctcaaactcttgggctcaagtgatcctcctgcctcagcctcccaagtagctgggactgcaggcatgctcaacaacatccagctaatctttaaactttttgtagagatggggtcttgccctgttgctcaggctggtctcaaactcttggcctaaaggaatcttcccatcttggcctcccaaagtgctgggaatacaggcatgagccactacacctgtccaattttttaaaacacattttttgagatcctagtggctgtatgagtcactgaagattgaatagacgagatttcagcagccatagtccccacatagaatgtcagaagcttgaagttccatgttactagagattgtgtaggggtaatgattgagagcaagagtctgcattctgtgggccagtctgtcttcctttagcccatgagctaagaatggcttttacatgtttaaagtgtccaaaaaaatcaaaacaagagtactgttctgtagcacgtgaaaattaaatttcactgtccataaattaagttttcttggcacacaaccatgcctgtttcctcttatctgtggttgctttcctactacagtgattgcgagttgccagagagaaagtatggcatgcagagcttacgtgatttactatctcaccttacacataaaaattttgctggcccgtgttctaaagtagaatatcctcaactttcccaccctgaaactttgtggaaaatgataatgtttgttcagtgtactgggataagtggaagatatcttgctggcctggggctgaaggcaccaccttagcacacctgaggctcatttggggcagagcctcttgaagttctcattgagagccggctctggccataggcttcagccctacctgcagctgtttgatacgaacacactcacctgggtcagctcttcttccgaggcatcctgaagatgcctcatggactcagatgatcatagtcatctatgtagctgactctcacaagggttttcacagtttacaaatgcttttcacttaggctgcttgctttttctctgttttcaatggttacgtttgtctctcacaatccttttggtcctggtctctctccacttgaattagcctttcttgaagatgttagggcatgcatgaaagtgtttgttgttaaaaaattcgtaatgttgcagggggagacaggacaggatatatatacatacacacatgtatatataaacacatatatgtatactatatatgtgtgtgtgtatatatcctgttcgtatccatatgtacacatatgtatgtatgtataggtgtgtgtgtgtgtgtgtgtgtgtatatgtaatactctctactccatatatatatatatggagtggcatgtgaaaattaaatttcactgcccataaattaaaagtattgcaaaatccctgtgcctttggcatttcaatcacaatcatggatgtagcagtgggacaagaggctggagaaagcagggccagatcttatagagttagctggaggcgaagctcactctcccacatggaggtcccgtgtgctgcctgggttctagccacattcttctatattgcttggttgtactacagttactattctgggattcatgcacgacccatctcccttttcgttctcagtatgttcatggtaaactgctattatctgaactggcttattgagtctctgtttcttgtgatcaggtcataatggtagttggtacttacagtgttccaggtcttggcctcacactttacatggattaattctttttttttttttccagtaaggtagataatgatggccatccctattttacagataaaaaatctgaatcacagaagggttaagttactggtctaggtcaccagctaggaaatgagaggactgaggcttgaacccaggtggcttgttgctgaagctcattctttttctaccttgggctgccactcgaagccatggaatgcagctgagatgcctgggtgtggaacttggtgggaacagagggaacattgaaccttaaatgggtcacaaacctagataagtgagatcgggcctggtctggtacagcagttgtagaagttgcagggttcttggtgtgcaggaagcaaatggacaaaaaaatatgacaaggctggtccttggtcctgctggcctgagggaaccttccagttttctggcagggactgtgaatggggagactaacacagttgacaccattgtgtgccaggcatttgttactgtatttaatcctcctaataactctgcaactggtggtcttgcttccattttcccatattacataggagctaccatgctcagagaggtagagagctcccctaggatcaactagtgaatgggggccagagccagaatttaaactttggaaccatctgcctccactgtctttcctttccatcacaccagctctgtaggaagcaggctgaactggactgcactctagtcactgtcaacctttcctggtcacggatccctttgacagtctcttgaaatgtggcctcttccccagaagtgcttgtttgtgtacatgtatgcacacagaattttgaatgcaaaatctggagctttacagaatcccatttatgggttcagagctgtttctgactttgtaaagtcaagctaaaccggagctaatacagttgggaggaagaggaatggagtgattgctataactactggcttcatctggatctttttcctgattagcagtgactttgctcattctggtagttaacgcctaatgtgtgttaggttccagacccagacctcacatgctcgattttatttcaggactgctttaaccgtatgcctcaatttcccctattttaaagatgataaaaggaagcttggaatttggacatttatccatgccaggtgagctggagaacctggcttctaacttagctcttcgttataacgactttccaaataggccgcagttagtgccagcaagtctttagcatgaataagtgagtgcttgaggatattgccaggctctcaaatgtcatttctcacctgtctctgttaggcagctcagatccaccagcctggggaatgctgctgaatttcggtttttatcctgaatgccatccgatgcattaattaacatgactgtgaaagcacctcacactcttggagggttatagaactaggaagtccttgcagcctctattgcaggcagcagtgcagttaatccctgctgagacagtgccaagctgtccagggagttgaaaatcacaggaggtttgcaaagacttgcctgcctttacagactccaaagtgtagaattgtaaatgacaggacacttaaaaatgccacatattgtgtgaatgcttctctagcagtaaaatattataccaccataaagcccttatgaacatgtaataataatttctgcataagcaccagcaataaagtgaaattcagctccatccagttttgcaagaattttccctggtggagagtgctagccattgtgtgaattctcatctgggtgaagagaaacaaaatccatttctctgaacatggttattctttggaaatagctttggcctcaaactttagagcaaaaattatcctgcatgggaaatgctaactgtatcatttctaaagctgtagctttgtcgctgaggcatattaacatgatagaaacttttccttggggctcatgacttgcctctgcctgatttttttcataaacttaaagaccagtgaatggagtgagcagtgctctcttgaaaattcacttttaccatttggcttttttaaaagaaaattttgttcatcttaaatgtttatagtaaaaactatagaatgggatgataaagaaaacttgctcatattcctaccaccctccagttattgccgaaggtactttcactcgcgtccgtgtgaagagaccaccaaacaggctttgcgtgagcaataaagctttttaatcacctgggtgcaggcgggctgagtccgaaaagagagtcagcgaagggagatggggtggggctgttttataggatttgggtaggtagtggaaaattacaatcaaagggggttgttctctagctggcaggggtgggggacacaaggtgctcactgggggagcttttgagccaggatgagccaggagaaggagtttcacaaggtaatgtcatcagttaaggcaggaacctgccattttcacttcttttgtgattcttcagttacttcaggccatttggatgtatacgtgcaggtcacaggggatatgatggcttagcttgggctcagaggcctgacaggtacatattttatattttcttgattatgattatttttgctccctatttgtctgaaagctctactagagaagaaattttgtccgttttggctgctgtagtatccttagcccttaaaaagaccttatcacataatagatgctaaacaaatattagttgagtaagtattatattcttggtgatagaaggagtcaggctttattaccttgaatcccagctttcccactcggtggctgagtggctccagtaagttattcagcttccccgaattccagtgttctgctaaaatgacaataattgagctgggcatggtggctcattgcacgtaatcccagtactttgggaggctgagatgggtggataacctgaggtcaggagttcgagaccagccggaccaacatagtgaaacctcgtctctactaaatacaaaaaattagccaggcgtggtggcgcatgcctgtaaccccagctacttgggaggctgaggcaggagaatcgtttgaacccaggaggcagaggttgcagtgagctgagatcacgccattgcactccagcctgggcaacaagagtgaagctccatctgcaaaaacaaaaataaaaataaataaataaaaatgacaataattgtgcacaaagactgacctcacctagtgtgttagtttgctagccctatcgtaacaaggtaccacagactgggtggcttaaatgataaaaatatattctatcacagttctgcaggctagaagtccaagatgaagttgttagcaaggttggcttcttccagggcctctctccttggcttgtggaaggctgtcttcctgtgccttcatatggtttcccctctgtgttgtatccttatctcctcttcttataaggacactggtcattctggattagggcccactcatacattcccatcttaccctaataacttctttaaagatcctgtcttcaaatacaatcatattcttaggtactgatggttagaactttaacatatgcattttaggggaggcacagttaagcctgtaaccgagggtcactggtttgattagactttataattggtaatccgccattcagatgtttcagtattacattagtttcaaatctaattgaggagataatgtaataaaaggtaaacataaataaaagtcagctacctctacaggctgagacatcatctgcttggtgagcacagtgctcttggggttctggagttgactgccacccctgcactggggcatcctgcagttctcccgaaggatgaaggcacaggtgcctctgagacttactgaatcactgtggcctgtgtttacccacctgagggcagtcaccacacctcagaccagatgggcccgtagtgcctgccaggccatgtctggcccagtccaacaacagtcgtctaataacatttagcacttattgagtgcttactgtatactggacatagatcctgggcctcagtccagagttccagttaactgcatgtgccagaccacacagcatgtgccagagtcagtgtcaggctctgtgctctcttgcctgctgagctggaccggttcccagggaagatatctttttgctggcagctgggagccccagccagtagcaagtctggggctgcagcttaaacagcctatgcacagtgggtacagtcagctgattccgagccctctggggttgccgcatcttaatcgacccttcctgacttccatgctgttgaggcctgtattggagggtccaagccacagcttgcgtgaagcctgggggctctgggtccaggctcccttggtcactgacagcactgacagcactgtcccttaacactgacagtgtgttaaggctcgagtttgtcccatgggccctccagttgtgttttggacctctgtacctccattccctctcagttctgttcctgatctgtcttgttctttagacagagctcacagggtacctcgggcttgggctttgctgtctgggacttttcaccgatgagaatgggactccatacatgagagaggaagatggctgtgtgctgtcttctggttctggagctcgagctaagtgagctctgcatgtttgagcttcctaggaatctggtcattatgactgataggtgccaggactcatgctgaaggtactccagtaagaaaagcacggtattatgggagcccaggaaaggggccactgactagaggcttccagggagatgtttgattcctgaatcttgaaagctgagttggtgttagctgggtgaaaggaagaagggagggctttgcagccagtgggaactgcaggaacagaaaggtgagaaacgtttgaggtgtgaaagagagcattattctagggctgttactacccatgtccagaagcttacgacttggaaaggtggagtggttgcctcgggattacgcctgggccaggctgggaggggctttgtgtgctaggccaagcagcttgaacgttatcctctttggaggctcaagtctgtgtatgtgtatgtgtgtgtgtgtgtgtgtgtgtgtgtgtgtgtgtacatgcatgtgtgtgtgttgtgttaggacctgaccctgtagcttccactgtttgctagtggtatgtctatgtctgagtttgcaaactgcaagttcttgtccagttatctttttttaaaaacttaggaatacttttccaatccaatcgctggttttgggaagccactgtgagtggcttgagagtgctcctctggccccaggggccacttagggacctgggcaggcatcggtcctagggcaagaggagaagaggcagcttccgatgagcctcccactccgtcctcacggcagggctccccgccctctcacctgacatcttccagctctccaggccctggcttcctgtcttcagagtgttctggaggaacaggaaggcaaagcagagggggggtgcatgtatgcacgcacatgcaagatcagaagggactttttacgaattctttccttgacactcctttttttgtgtcgcaactttgcctgtgaacccttagaatctctgctaatgagccggtcgcagtggctcatgcctgtaatcccagcactttgggaggcagaggcgggtggatcacctgaggccaggaaccgagatcgtgccactgcactccaggctaggcgacagagcgagactccgtctcaaaaaaaaaaaaaaagaaaaaagaaaaaaataatatctgctaatatgtgagcagtatcatcgtcatcaccaccattgtcgtctacattgctgtggaccaaatgtttgtgcccctgcaaaatccataggaaacctaactttcaaggtgatggtttaggcctttaggtgacacttaggtcatgaaggcagagccctcatgaatgagattaatgcttttatataaagagacctcagagagctccctcacctcttcttctacgtgagggcacagcaagaagactgctgtctgtgaagcagcaagggtgccctcaccagacactgaatctgctgcttcctgatcttaagcttctcagcctccagaattgtgagaaattgtttataagccacccagtctatggtattcagttaaagtagcctgagtgggccaagagaacaaccaccaccgccattgtcatcatttccagtctctataagcttgcttgtatcagctttgcttgaggtgtgtttaattctcacagtaaccgtaggagttagatacttgttgcatcctcatttcacccttgaggaaactgaggcagggaaatgttcaataaattgtccaaggtcacacagctgataagtagcagagctggagttcaaaggcaggccatctggcacaagagtcagctttgaaccatttcctcctgcctctcgtggaggaaatgtgtccctgacaattccttcacctgtgagctggaaggaaggaagaactcgacagcagccagctccctttgcctcggcatctgcatggtgttggtttcttcttcactgtagagctcccctaagttttatgttataatcaaatgtggtcagcatttgcttatggaatttgatttagctggacagtgtctctctgtaaattttacagatggagtgtctcttgaagacagagtggccatgggtctcaggccttgggtgtcacggtgggagcacacacggttgctttaataaatgagcagagagcatggttggcacccggcccaaaggaccttgttgactggtgggcacatggtatgttacatctgtcattgtgagagaattcctcatcttcccacagacattatcttgccaaagcacttttgcttccatctcatcctttccttggacaagtcatctataatctctcaagcaggggcctggtctgcctcctgccttcacccttgtagggaatggtggtttcttcttaggatgactgggagctccttggctcagaatgggttaactccaacccgggctgcctcctgaggacctgtccccctggatcactgttggttttaatcttcattatcttgaatggcaatgctgttagcacccaggaggggtccttgaacagccagatggtggctggatttttctgccagtcatcagttttcatctgattgcagtgcaggtgcagggaggaggaggggttttagtagtccccatgccttccagtgttcaagcacattcctccaggaaccattaaaggaactattaaggctgggagaatttttgagaggtaatatagtggattcattcacttaataaatatttattgagcacctactgtgtgccaggaactgtactaagcaccggggatacaggaatgagcgaagcaaagccctgtcccagtggatcttatagtaaacaaacaaataggtatgaaatacgtcaggtggcatggagtggtgagaaggggaaatatggcagtttaatggtagtggggtcagaggctctctgggccatgcgtgaagggtgggatgatgctgttttagaaaaagagactacaagaccgggtgcggtggctcacacctgtaatcccagccctttgggagactgaggtgggcggatcacttgaggtcaggagttcgagaccagcctggacaacatggcgaaaccccgtctctattaaaaatacaaaaattagccaggcacggtggcacgtgcctgtaatcccagctactagggaggctgaggcaggagaatcggttgaacgtgggaggagttggttgcagtgagccgagatcacgccactgcactccagcctgggcaacagagcaagactctctcaaaaaaaaaaaaaaaaaaaaaagaaaaagagacttcacaaagcatctctgagaaagtagcatttgatctagcactgaatgaagtgagaaagcgagcctctgagataattgaggaagaacattccagcgagagggaatagcaagtacacggaccttgattagcaaggaggctgtggtggctgagtaaagctagggaatgctatacaccaaatttatgcacaaagaacttttttccttctcttcttgtagcattattatgttttctcattcatccgtttatgcatgcattcatttagtaattctttactgaagctaacattggtgttgggcacaacgttagggactgggactttagacttcagtgtgttcctttggggaaaccacaggggtgctgggtgctggcatggaaggtaccctcagagttgtctttctcaacgtcgcttacttctcactcctccttcatcactaggcttcaaagaagagcctgtggctaaagttttcactttcttagctttgccacccaaacctggcttccttcccacaagctgctgctgtgtgctgttgatgacctagttgtcagatctaagcacctttcttctatcctcatcttttctgaactctgcagtggcacttcatgccattgaccatctccttccttgtttagaagcctttctgtctgccttccttgaagaggactctctcaggatgccctggattctttaagaactcccatccaatcacctgtgtcagcgtctctcttcctgcccttcaaaggcaggtcacctgcaggttctgtggcttcttctcatggatcaacttactcccttggtatgtgaattaccccatctgtcctactggcacctttaaacttagcatcttcagtgcagagctcatcttctcccctcctgagaattcttcctttacactgcgtctcttctggtgaatacacctttgtccccttccgccatctcatttcttctcatctgcccaaatcttagcaatttctgtaatactctctgatatcatctcttttattctagttcttctgctccctgggctaagtcttccataggacaatggctttcaaactgtgcttctcagccctgcagtatgcatcacctgggaacttgttggaaatccaaattatccaatcccaccctcgatctctataatccgaaactctaggggaggaggtgttgaggggagggcagcaatctgtttgaacaaagctctccaggtgacagtgatgttcctaaagtttgggaaccgctgaagtagacagtggaagtagcttccttccccagtctccgtgacgggcccacttggctctacaccacgatgtcagctttttcttcgaaaagaacagccctgatgtgatgcctcttctcatcacacgccctctgtggctcccgcattggccacgatgggacagatgtgagttcgtattgtccaggagtgaattcaggccagaacttttgcacttatttccacttttcggggctaacccagaattgctttttaaatgtacattatatccctttgtaaagatgtgtctcattttttgcagtccatgtgccaaaagtttatgtgtatttttttggcggggggacagaggggcgaggagggtaataggaccttcttttcagtaaactcttttttttgagaccgggtcttgctctgtcacccaggctggagtacagtagtgcgatctcggctcactgcaagctccgcctcccgggttcacgccattctcctgccttggcctcccgagtagctgggattacaggtgcctgccatcatgcccagctaattttttttttttttgtatttttaatagagacggggtttcaccgtgttagctaggatggtctcgatctcctgaccttatgatctgcccgcctcggcctcccaaagtgctgggattacaggagtgagccaccgtgcccggtccagtgagctcttttaaatgtcttaggagaaagcattgataaaagtagcttttgtttgataggctgcatcttctgggtaatccggggtgaattgcctccatcccagacccttttcaggtggaggaggctggggttaactgatttctaaggctatttccagcttggatattctagggtgagatgggtgttgactctcatttatctgttttaaagggttaaatttttttttattgtttttttaaaaaatgagttaagatgagaactattgtaggccaatgataacaggctccaattcctgaaacctgtagctgttccctgatttggaaataggaaaagaccctttgtggatgtggttaagttaaggatcctgagatgagagaagcatggattgtccaggtgggtactaaaggcaatcacatgtctccttataagagggaggcaaggccgggttgatggctctcgcctgtaatctcagcatttggggaggccgaggcgggcggatcacaacgtcaggagtttgagaccagcctggccaagatggtgaaattctatctctactaaaaatacaaaaattagccgggtgcggtggtggatgcctgtaatcccagctactcaggaggctgaggtaggagaactgcttgaacccaggaggcggaggttgcagcgagccgagattgcgccattgtgctccagcctgtgcgacagagcgagactccatcttaaaaaaaaaaaaaaaaggtatgcaaagggagattgaacacataggagaaggcagtgtgaccctgagggtagagactgcagtcatgcagccacaggtcaaggaatgctggcacttatcagaagctgcaagagtcgagtaatagatgtgttttccctggagtccctggagggagcacagccctgcagcaccttgattttggacttctggcttccaaacttgtgagagagttatgtttctgttgttttaagccaccgtttgtgctatagcagacgtggaattttaccactatattaaaaaaagacagaagtgaacactcctgtgttgaaatgtgatctggacagcgggtctctctgtccttggcattgaggttcctggcaggatgtatgtcttcagcactgccctccccagctctgtgctcttactcaagagtggcagtttctgtctcccagccttgtccctccattataacgccttcccacatccacacctgctgttttgttttattaattgcagctggggaatgtagcagcttccagtctctgttggagtcaggattgatgggtagtgggaaaaagccacagtgggcttcgttccctctctctgtcaccatctgatatggttttgctgtggccccacccaaatctcaccttgaattgtagttcgtgtaatcgccagtgtcatgggagggacacagtgggaggtaattgaatcaagggagcagttacccgtatgctgttgtccttgtgttagtggtgacagtgagtgagttctcacgagatctgatagttttagaaggggctttccctccttttggtcagcgtttctccttgctgccaccatgtgaagaaggacatgtttgcttccccttccatcatgatcgtaagtttcctgaggcctccccagccaccctgaactatgagtcaattaaacctctttcctttataattacccagtctcgggtatgtctttattagcaattacccagtctcgggtatgtcttttattataatttataaattacccagtctcgggtatgtctttattagcagtgtgagaacagactaataccccatcccatatttggggactggataaatatccgtattctgaaatgaacaaactgttctctggaacattcctttacaaaggatttccttcataatgcaaagtcatttggggctcctccatagtgctttgtagtagaagccagcattctctgcagagcaaactgggggaattgtctgagaagctcagtctttaagttgctcatcgactgatcaactgctggaatgacaaatcatagcattttaagactggtccctggagatgaccaaattcacttccctcatcttgcaaataagaaaacaaagacccaaagtgttcctgggatgagctgtagtagaacatagcattatacttggcccttgctgaccacctgtgtctgtcccttcttccccaaaactgtgcaaaaatatgttgctggacaatagctgttattatattcagtgttataaactgacatttattgaagccatatcgtgtaccagtacttctcttgacacttttcttgtattaagtcatttcattttcattatagtcctatgagttacatgctactattattagaaaatgtttggactttataattggtcatatttttaaattctggagtcaccattttgtggttaaatataaacctcgtgtgtagagtgggggtcatgtggttccagcacaggtcctcaatgaatgtctacaggtgaaaggaataacatgaatgagtgtgtaagtgatatggtttggctctgtgtccccacccaaatctcttgtcaaattgtaatccccatgtgttggaggaggggcttggagggaggtgattgaatcatgggggtggacttcccccttgctgttctcgtgataatgaatgagttctcacaagatctgattgtttaaaagtgtatagcatttccccttttgctctctctttctccttccaccatgtgaaggcatgcttgcttcccctttgccttctgccatgattgtaagtttcctgaggcttcccagccatgcttcctgtacagcttgcagaactgagagtcagttaaacctcttctgcttataaattacccagtctcaggtagttcttaatagcagtgtgagactggactaatatagtaaatcatggacttggggaaatacatataatgaagaaatgttggtcaataaaatgttagcaaaactcaatcgggcatgtggcatcaaccttttgggtctatcattttctcatctgtaaaatgaggataatgatatcagccttaaaggattgttctaaggatgtgatgggataataatataagtacttaccatgatggcttgaagttactgagcactcagctaatggcaataattactattaactggtagacacttaacagggcaaatgaggaatgaaccatcactgggctgtggggtggtgctctcgggtaactgtgaagccctgtatcgagacgtgccctttaaacaggacagcatggaggaatgaactgcagatgactcagttcgaacaaagatatcctgaccccaaagggcagcagaaagagctctctccataaatgggcctagctggaaaattcctcactatctatggggaaggcacaatgggcaggagaagtcattggctgtgtgcagatgcatctgtctacagtcacactgtgtatagggatgagtcattgctgtgtcctcagatgcggagggcaaggacagggacaaatcatgtcgtcggacctatctgaggggtgcgtgaggctgtgttctggaagtgtggctggacctcatttccttttccagttacaagttccatgtaaacttagataagctattgtaattattttttacttcctgatagatagcaagatggttaactgagatgaatatttattgacctctactctgtaccaggcactgtatcagattctgggaagacaggatgaaaacataaggcttctgtccttgggcagcttattacacaggcaaggaagccagcattaacaggtgtaccatgatgctgtgaaagcatttatacatgtgtacatacacacacacagacacacagcctttgggcagccaaggtatgtgctatggtctgtgttgaagctcatgaatttttctcatgggaagacctctagactgttgagtcatgacttgttattcttttttaatacatcatttatatttgtcaggatggattaggttgtgctatttatatggacaaccccgatatctctgtgtggttgaaataacaaagatttatttcttgtgcaacacattcatctgtggtaggtgtataggtggggtgttttattcttccccaggtaacttataccctgggatgctggtgtttccactagctggagtgtcatagatcactgtggccagaggaaattggaacttgggggatcatgttctacttctggcttttgcttacagttcattggccaaagcaagttacatggccactgctcacttccaggcgctgaggaagatcattcctacgtgtgactggaaggatagaaaccagaggatttctgatagccttaacgacttcccctttgttctgaccagctttttacatttacatttctttcttttaattcatattacttttttgagatggagccttattctgtcacccaggctggaatgcagtggcgtgatctcggctcactgcaacctccgcctcctgggctcaagtcattctcttgcctcagcctcccgagtagctgggattacagacgtctgccaccaccccggctaatggttgtatttttagtagagatggggcttcaccatgttggccaggctggtctcgaactcctgacctcaggttatcttcctgcctcagcttcccaaagtactgggattacaggtatgagccactgcactttgcatttctaagctcttactgtgcctgggctacatttgcatttctaagctatgggagatcagcacaacagtgcatttgaaaggggaacttcagatgccggccagaaacctgagcaagaagtgacaatctgacctctaagagaagtataggaaagccctgcctaccagctataagaactcaaactggggcagaatggaaccatggcatagggtagggctgattgtccagacatgtttgtagctcccaagggcacacatagtgctgttggcagcttagtgagatttaatgctacatagtgcctataccaggcatcaggccaaggttgggaatacataattaaccgggatcattaagaaaaatttagaatatatttattatagattacaagatcagggaagtatcttttcacttagttaaaactaaatatacccgcaatagaaacagctctttaaaaaaaaaaaaaaaaaacctaaaaaagtcacttaaacggaacctgagtgattgggacatcactgtttatagttttccatttccttcacatgaagtttttaatgcacttgggcaggcttttcagtctaattcctctgttcctatttttttcttatccatcataatgattgttgaagatttccaataatgtattgaaaattgaactcctttgatagcatatacacacatgtatgtatacatgcacacacctttctgctgggaaaaatatggacttcagtggtcaaagggagtcattgattggggctaaggagggtacaagtcatcattggagcagacttgcctgttacctccactctgttccccttctcggcatgctcttagacgctctttacgcaggctggtggagagaaatctttctaaatacctttggctcactttcttggacatccttaccatctcattagtcagacaaacatttgtcagacgtggtttatatctgtaaggcatggtggggaaagaatgagaagtgtaagtcatggcctctgcactctaggagtttatcatttcaggatggggaggtaaactagtgtttgcttgctgtgtgtcaggcactgttccaagctttttttttggctgcaccatctcctttgaccctacagtagccctcagtagctgccatttttttctaacttcgtaacgatgaagacatcgagacttggagaagataaccaacatcgtctgtgcttaggaagtgacagcatttgtgggtgaagctgggattctcctaatgccctctctgcctttgtcacaacatctgccagccatgaagcaattagagattcttaaactggaggagaatcttgggaggacagagatatttgtttgttctcttcaccactgtatccctggtgactaaagagaagtctgcaatagatacggtggtgattaaggaagattcctgccctcaaggagcttgcagtccagggttgtgaaactgacgagtaaatgtattgtgttggtgcagggtgtcagctaccctggaacagagagccatgtgggaggcagaagagggggtggtgcacttagcccaggaggagcctctggaggttggttagacagcatgtgtctcctgagcagcagcagggacaaggactagaagaaaagggcaagtgtggatatagcaagcctggttcaggtgccacgatgaatgagaaggtggtgaatcaaatggtagcattggggtagagaggaagtatagggcctggcaatataattgctgtgtgattaatatttttcttctttattttatcctatagtatttagctccaacactttaaaatgagaggctgtggatggtggctcaagcctataatcctagcacttcgggaggctgaggcgggaggattgcttgaggccagaagttctagaccactttgggcagcaccacgagacccccatctcatctctacttaaaataaaaaattagccgggcatggtggcatgcgcttgtagtcccaggtactcaggaggctaaggtgggaggatctgttgagcccccgagtttgaggctatagcgagctaggattgtgccactaccctccagcctgggtgacaaagtgagaccctgtctctaaaaaaattaataaacataaaatgagaatagaagttatggcaatatgctatgggagaaaataaagggaagaaaaattaaaaacatctattgtcaggccttatgtcagatcttatatggggggttttgcaaattttcattatttaatcagcataactattcctttaggcaggaagaatggtacattagttaaagcaggctgaatggacccccaaattcataatgacccgggatgtttattttgcactcacagaatgagtaactatgtggggtgagtgaaagcaggggaggtgtctctgctccacacagtgaccctggcctaaggaaacaccctggaccatccacatgcaagctctagacactgatgtccagccagcagagggcattacctgcgggtagggcccacatcacgctgcacatgtcctactggctaggacttggtcacatggtcacacctcactgtatagaggctaggaagtgtctcatcctgtgcccaggctttggtgaacagctagctgtccacaaatggcccagagtataggagaagaaactgagtttcttagaaacacacaaatttccttagggttacagagattttttatggagtaggcaaggttcagattcagggcagtctttcaccccatgggaaagtggaaagggtggttgaggaggtggggattaaatgaggtggatttagtgggattaggtaattaataaaggtaacttaattatttgaagtcaaggcagttgacttcaacccttagatgatgtcaagggctggagctggtgctaaggaggctcggtggggaggtttgttggtatcagggaaattaaggatttggtgaaacagcctgtggatggatagccacaggcctgctggagttgccctggatggtgacgtagttggcaaggggagaaaaacctgagattgttagaggacagcagagggatagagcttgtgaccagaaggtctgaactttaaaaatgtcatccagagcattcatatgtgtggaatagctcatttttcagctctgccatgaactttgtagaatattagcgcaatgaagagctttgtactcacacaccactgggagaagacataatgagatatgatgatgggactgacaaaagttggctgttgtgatccatacttttggatcccaaagcccccaggagcccgtgtgaactctgaagtggtttgacatctgggactgggctgctggtgacgtcactccatccagtcctcctcaaactggtggcctttgaagttgtttttgagcatgatgataaatcagccatcagttggtatttattgagcacataccatgtgcccaagtaattaggcacccgtttctgggatggtgctgggaaataggaatgcggtgtagcctgcagccctaatcagaatctagttgtggagagactaatagaactttcagcccacccaagggagaccacagtgtacagacttcctgaaggtgggggaagtcctggactcttgccctgctgagttcttaccctgccaatttgcctcgaaaaagccactgggctccctggtccttgggtgtctaaagtgtttaacaaccaacaaaaatcacaggcaaatctgctttgttttcattgttcggtaggtatttgctgtgtatcatttcttctggtccatgaagcacagcagggcaggatacagagaggctgccctcaagaagcagaaggaacaattttaatttattcaggagggaaaagttaggcttttacaggctatcaacaaatactgattgggaacctccctttttctagggctcttctcagggccacagtcccccttctttctctcaggtcagttacaagctggtgcagctgctgaatgaacttcctcccctcctcttttctccctcttattcttccttccttcccctgtcctatatttattcagaaaatattcattgaacacctacaatttatcaggctctggaaagacatccctgagtgagttgatagggttcctgtccttgtagagtgtatgttctccttgcagcgacagactacaaacaaactataagcaaatacgatgatttcggattttaacccatgccctgaatcaactgaagacagcagggtttggtaagtgacttgagggggcacagctggatgggaaggtgtgagtctcaagaagccctatgagaaggagctaccatgtggctggaggaccagtgcctaatccaagggtggagacatgaaccatccccatttttacaggagagaaactaaagcatagaacctgtccaaggttaaattagttgtggatctggggtctgaacctaggtcatctgcctgtaaaggcccttcctccacagtgtgaagctgcctgcaccaccatgctaccctgttcttccttcctctcctccccctttcctccctctcctccccctttcctccctccttcagcttctccatctatcatgagtggataatgattttgtcctaccttaccgctgacccccttgataatattgacctagcggggaagttgtaaggcataactaataaaaatgacaatgaagcatttgccaacagaaggtgtactactgaatgctaatatcggtgagagcctgtctgtgatgctagggcagatttattagacagctgtttagccagcatgagtttccctgcccccaacttcaccaggcagctgagtccagttcgagcagctctgtgctctagacttttgctgttacctctctgtggtcccttcttatctggatgtgcaacaacccaaacactcttttctgcagtggattgggcttggctgtcaggagaacaatggatagcgtgctgggtatgcagccatgaaggttgtggggtctgccccacgggtcccctgcgaaagagagagagagagaaacacaaacgagtgatctgtctatggctgtaaaatggggtggcagtactgactccctcatagagctatttcaagcattaaatgaatttatatatatgcaaagggcttagaaagtatctaatagacaagtgctttaaatacctctaagtggaggtgtcagtacctgcaagtctactgatatttgactttgaaaatgtgtgccttcaaaggggctagatgggagacaaggctgttggcaagcaccaggttgtgaagaaacttgtgtgcctggcagaggcgaaccatagggaaactgccgagcctccagtgtatatatttgattgtatgtatatgtgtatgcatgtatgtatgtctatatacgtatacacatgtgtgtatgtatagaaacacatatatacacatataaatgtatatgtgtgtgtttgtatatacatgcacccctccaccccgacttcccagggtcttagctgtaggggcagattgtggtgggtgaggtcaggttgaggagaatgacttgagtgagagaggcacttagaggaggttggcagtgcgttagactcacttttcctggagagcatcctggaatttgaaatgattgagaatgaacactgcgttgtgaaaaggatattaattttggtggccagatatgcctgaatttgaatcttggccccaaaaacattgtctgtctgtatctgtctttctgtatctgtctgtctgtctgtctgtctgtctgtctgtctgtctgtctgtctatctatctatctatccatccatccgtgcatccgtctgtctgtatgtccacccgccctcccgcctgcctgcctgctatggtctgaatgtttacaccccctcagaatttgtatgctgaaatctaacctgctgtgtgagggtattaggagctgggcctttgagcagtgaggtcttgagggtggagcctacatgagtgggattagtgcccttaaaaatagacacaagggagcctttcaccatgtgaggacgtagcaagaagacggccatctgtgaacagaaagcagactctcaccagacactgaatctgctgttgtcttgaccttggacttcccagcctctagaactataagaaataaatgcctgttgtttataagctacctagtcggtggcattttgttttaacaacttgaacaaattaagagtctgcctacctacctggaagccagactgcttatggaggatgaaaccaagcatgaaaatccagatgctgtcctgccctgttcatggatgaatttttgctcttcatttcttcgcccgcagcccacagaggttgctcgctgagtcaggcctggagttcccatcactcttagaccttttttatttgtaaaaacagtgtgggcatcagaacaccaggccatgtctttgtttgcttatttaatgacaacattgaatgcgaaagaggaaaagtttggagataattggactcaggagggttgcctgtgtttttggaggtgatgaacagttgatagtctcataagtagtacttatgatgatctgcaaatggttcagcagctgaatctcttacttccacggcacctctcctcgtgattttactctccccacaaaccctttctggttctctgcagatgcatgagactgcacactcacagggctctgctgagccgtctgcatggatgtgaatacatacatgccttccggtgtggttcacagaaagacagagttcagatccttgctacaattctctgctgagaactcatggccaggcagtctcttccctgaagtggcaagcccaggtgtgtgagtccctgggctgggttgatagacagatgtttgcactttgcacactatcagattactaagaatggttcttggctgaagagtcctttctggttgtagaagccaccatcaaaagccagtccctcaaccacttattttaaaacagatgaaggcaacccagtgctttttctctgatggcacattctccccgcatgaggaaaggaacataattggaaaatgggcaatattcacagaacaattactgtgcctcttaatgaggtttgcatgaaggcttccagtgaattaatgaagagcaatgattttgccattcacgttgaacagctggacaacaatgataagggtgcagactgtgaggtctctggcttagacgaggtgatgaggaccggaggaagttctagcttctgcccttcttcagttctcctttggtctcactactgtcctgggagaaactgaacgtgctaggctgccagactgtgccgccccaacaaaaagtgagaagaaccagtttggctgggctgtgggcttgcatcttccttggactgtttttctagatatattcagtggcagatcattaaatctcctcctttactgggctattcttattaggaattatggtgacttttggagggcagtgtgtcttgcggaaagcagcataccatgttgagttgaagatatgagtctaaattatggccttgtcgtttaatgtctgtgtgttccttgcacatgttgtttcgctgcaggcagggagctgcagtttcttcacttgaacaaaaggcgatcatacttacataggtgacctgttgtgagtatcaaatagcctgtatgaaattacattatgcatatgttagtatcagtcagggttctccagagaaatgacccaataggatggtgtagttgtataaacacacacacacacacacacacacacatataccttgattttaaggaattagcttatgtgatcgtagggctaagtccaaagttgtgggtaggttacactggcaggctggactcttgggcagaaaatgaagctgtggtcctgaggcagaggcagaatttctcttccaggaaaactcagtttttcctcttaaggccttcagctgattagatgaggcccatcaatacaattgaggatagactcttttacttaaagtcaactgattgtagatattaaccacatctacaaaataactaccagagcacctggacagtgtttgattaagtaactggggaccatagcctagccaagttgaaacataaaactaaccatcacagtcattattattgttactgatatgtcaggaaccaaagtatttgaccctgttgggccctattggggactgttggaaaagcatcatttgcttgcctgacatgtgctcagtgtcttagctttagggatagattttcaggggcgaggtcaggttgaagagaatgatttgagtgatagaggcacttagaagaggttgacagtccatctgactagcctttcttggagagcattctggaatttgaaatggtcgaacaagagtgaatactatgtcatggaaaggatattaattttggagacgagatatgatttacactcttggcctcagcatgtctttcttcccccatcgagatacgtaagttaacttcagtgatgctttttaaagttttttctctaaacaggaaaaattaatatttacgttttaggcttgttgcaagagtgtggagtatctctggcatgatttaaacactcagtaaataattgtttccctccttgcatgtttgttcagtgttcattgagttgttctaatgtgacgtttgttcttatgtggagattttcctataaggtatttaaggctgaagttgggagcatcgtagaatgcaagagtttgggaaaaactggagataccagtcaagatggagaaaaggatggagttcaagggtacctgggcttcctgtcttcactgtgaagatggatttcaccatgagatctttactaggcagaaaagatggaacatcctgcagtagtgttttgtcatcgagcccacagccgaggccgaacagaagctgtatgttgttcctcaatggttgtgtccaaatgggaatgagtaagacttcaacatttctgaagatggatggtcaccattctcaattctgttttatgtatctggtgggccgttgagcagaagagatcccagatgtcagacacatctgtcctccaccaagatgtgtgtgtgggacattgctggaactatgttttgtttctggtcttgtggcatttgactatcggagatgaacaaaagagcatacaatcctgatttatttccacaagcttctcaggactagggcttgacagtcttgcctggggaagcttgttgattcttagagtggcactaatttttttttttttttttcttgagacggagttttgctcttgttgcccaggctggagtgatggcacgatcttgtatctttactagagacgggattttgccatgttggccaggctagtctcgagctcctgacctcagatgatccacctgccttgacctcccaaaggagttgggattacaggggtgagccactgcgcccggcctagagtggcacttcttaatgcagtagatgtacttcataccaccatttaaaccaatactaagagaatagtctgtattcatatgccaatttggtaccacctaataggagaaaaccagaaagcaaacagtgctagttgcattaattatctctgttttatttgtcttttaatatctttgtctccttgaggaggctatggacttcttgaaggacagacagttttcatctctgtgcttcattgtctagcacagggcctggcgtgttgtcagggcatagtacctgtgtgttgaatgagcaaataaactgtgaagaaacttcttgatctttgttggcctggacagctgttgaggcttgactgtgcttatggaatgaaatatccacacaaagggaaacttggtaatagcccagaaccccaaggggatcattgcagagggactgatagatggacaggatggcctggtgaggcctgcgccatctgtgccttcaacccggcggatcaaagatgaatgtgtgattgagtgaggcctcactgatgacaatgcaccctggctggaaaatgcacagcaggaggctctggtttgaatctcagttttcctaggagacctgaatgaagagaaaaggcaccgcagtatgcaaagagagagtcatcacttgtgcatgtgtctgggggaagtaacgaatagaagacattacatgtcaaaaagagcctcgtccaaaatgaagccaagtgactgtcacaagttctgggcaggtgagatgctgtgtcagaaccgtgagaaggcaggggaggccaggcacaattcccaatatgttttagagcatacctggagcttagcatagccctaacttcatggtccagccctttggggcatgtgctcctggaaccttagctattaagtgcccttgagtgggaaaataaatgagtttttaatgtctgtgtgtacatgttgttaatcgttttctgcatttgccacctgggttgaacctgtcaaattagtttccagtagtcccttttaatgcattgttatatacccaaggtggaaatctcagtcatccttagagactttctgtagccaatttcccctttccttgttcctctcttacttaggtcatgcaattgagcgctaagcccgggtcagcccatttcctgtgttctggtctttttctttccatttgtcacagttctgggctgggctcccattatccctggcctgaagtatttcactagctgatgctccggcctcctccttcctgtgtctcctaatccatcattcttatactgccagaatgacttttctaaggctcagagcagctcatgacattccctgctagagcctctttgattacttcttcttgcctctagaaaaagtttgaacaatttaccgtgacgtaataaagctgttcccagttgggctctggccttctttcctggtcttgggccccacctctatataccaaatcatgattttaccacttcctaaatacagcatgctcttccacgttgcgaatatttgggaaatctttttttccttggaaagctgttaactttttctccctgtcagactcctagtaatccttcaagactcaggttttgttggttgaactgaagctcatgcaaatgatcacttaagaggtgctgagattggcatacttctccagagtgcctggctttagtgtagtggaaattctcttcagccacgagcgtcccacaagggagcctagtttgttcatgtctttacttgctctgctaaattatgttttattaatgtgtgtgcttgtactgttgctcaggctactgtgctaatgactgataattgccttaatgagctatttgtaagaaatacagtaataccagtagggatgaaaccagaccccaccacagctggtggtctaatagccttttgactgactttatggaggagcagactgcagggttattgcagttaacataagcaagagctcagaatcacccacttttccctgaacacccaatttacccatcttccactcacgcattaatcatgtttatatgagtcgggggcaggttaggttatgctgcagtaacaaatctcgcatagaacaaaaaaatcactttgggaagccgaggcgggtagatcacaaggtcaggagatcgagatcatcctggccaacatggtgaaaccccgtctgtactaaaaatacaaaaattagctaggcacggtggcgcacacctgtagtcccagctacttgggagactgaggcagggaaattgcttgaacccgggaggcggaagttgcagtgatccaagatcgcaccattgcagtccagcctgggcaacagagcaagactccatctcaaaaaaaaaaaaaagaaattcatccctcaccctgtactacaagtccatcacaggctactcatggcactgctgcatgctgtcttcactctgggatcctgatagtgaggcagtctctatcagtactcttgctagtccttaagatagagagaaaagggcgcataatggttcttaaagcttgcagtgagttgcatgcattcgtatttcattggccagagtaggtcccatggctgttctggggcagagaagttctaccttgatgtgctcagagctgaagagctgatatttgtgaacaatatgagaaccaccacaccatggtagaatcttggattcatgtgccttatgtaatttgcttctggggagtcaagagggagattttgttgccttcagcggaggtccagagagtactgtgggaccaagagtatcgggctatggctttgggttcagccagtccttggttcagatcctgaccagcacttgctagctatatgatcttggtcagtgtaaactctctcaaccaatttctttacctgcaaacgtgaaaacagcaatacctattttataggattgttacatattccatgagataatgggttgaaaagttttataattttgtcataataaatgttagttctcttcccatcccccatgctgtgtcttgttcagagtgagagatctggtgtctgttgcatgcagactactgtagttttttttctgtgctctcctgggtggtagcaacacccgcctataactacaagtgcttgaaatgtggctagtaccactgaggaactgaactgcaaattgtaaaatctttattacatctaaaaagtgaagcagtgtaaagtttttttgtttttttttttaacacaagcttctggttttggaggtactatttcacttcagtcattgaaaatttagcaccccaattgagatgtacttaagtgtaaaatatgcatctgatcttgaatatttagtatggaaaactataaaatatctcattggttatttttatattgatgatatgttgaaataatattttcatacattggaggaaataaggtatattatttaaattagtttcacctgttagctctttttaaaatgtggctgctagaaaatgaaaaactatacatgtggctaactagcattatataatatttccattggaaagtgctggtttagacatgcagaatgtgaggcccacacctctctggaaattcagactattcatccatctgtccttgcatctaataatacatatttattgacaacttcctatgtgctatgcacaggtgttgtgctaagcttttgggaaccagtgctggtcaaaacaggcatattctctgagctcactgcttattgagggcatggaacatatagttgtgtatgttcataagtataaatggtagctccatctagaaaagtgcaggaggctagggaaatacatcacacaggacctgatttttttttttttgagatggagtctcactctgtcaccaggctggtgtgcagtggcgcaatctcggctcaccgcagcctctgcctcctgggttcaagcagttctcttgcctgagcctcctgagtagctgggattacaggcacccactaccacgcccagctaatttttgtacttttagtagagatggggtttctccatgttggccaggctggtcttgaactcctgacctcgggtgatccgcccaccttggcctcccaaagtgctgggattacaggtgtgagccactgtgcctggcaggacctgagctttttaatacatggggtgggtgggcggggttagggaaggatgtactgagtttctgaataaggagagaagaatggatgaagatgggtctgggatttgagacccaccagacagtgttaagagcttgtgcccaggttctgaggctgagggggaaataggtttaatggtgctactgggtctgtcttcaactactgctttggaagttcacaaacagttcatgggaaaatgcgaagaggatagactttgcatgaaacactggttccttttgctacatcctcaaagaagtgcaactccagtgtactcgtcactgtgaaattgatccggctcacatgtggggtggtgagcattgtcagggcaggggaatacggggctttattcttctttacgatcccagcgtcgtgcagggtgccttgtgctttgtaaacattccataaatactgtttgatttcatttgcatattactggagaagacttactatctggatttcccccaacctatttgtgccaagcaccttggtggtaggggcagggaggggctgcttttgtgttcttgctgagtctcagcactctggcaaggcttcatctttcttttctccccataaggagttggatgaacataacaagaagagaacagcctaatttaaaaagtggatcaaagactttaacagatacctccccaaagaaaatatgcagatggcagataagcacatgaaaagatgctccatgtcgtttgtcatcagggaaatgcaaataaaacaacagtgacgtactgctacacacttattagaatggccaaaacctggaacactggcaccaccaaatgctgatgaggatgtggagcaacaggaactctcatttgttgctgtcagaatgcaaaatggtatagccactttggaagacagtttggcaatttcatatgcaactaaacatacttttaccatacaacccagaatctcacaacttggtatttacccaaaggagctgaaaacttacgtccacacagaaaccttcacataggtgtttaaagcaactttattcatgattgccaaaacttggaagcagctaaggtgtccttaagtaggtgaatggataaataaaccatagcacatccaggcaatggaatattattcagcgccgaaaagaaatgagccatcaagccatgaaaagacatggaagaaatttaaatacatatgactaaatgaaagaagccaatttgaaaaggctacttactgttttccaactgtgacattctagaaaaggcaaaactctggagatagtaaaaagatcagtggttgccaggggttgggaagaggaaaggatgaatcagcagagctcagactatttttagcgcagtaaaactactctgtatgatatgtgtaattacatattcctcaaaaccaataagatatttatcaaaaatgaactgtcatgtaaacagtggactttaggcgataatgatgtatcaatgtaggctcaccagttgtaagaaacttaccactctgatggggtatgttgagattgggggaagctgtgcataggtgggagcaggaggtatatgggaaatctctctataccttcctatcttgctgtgatcctaaaaaataaagtctatttttaaaaaactaaagacctggttacgaaagtgaatgcttattgaacacctactacatgctggttcctaataattaatcgtgtagattaatttatttaatcccaaacagtcctgtgaggcgggtaacatgactgtcctcctgattgtgcagataatgaaactgagcacagagaagttaagaaattaactcagggtcacatagcttggaggtgggagagctgggatttgcatacagacacactgtctctagggctttgcttttaatgacttgttgccttacctgctgcaaacaaactgcctatccagctgtctttgtggaagttgcatggtttgaaattgcaaggaagaggatttttttttttgagacggagtctcactgtgtcgcccggctggagtgcaatggtgagatctcagctcgctgcaacctccgcctaccaggttcaagcgattctcctgcctcagcctccagagcagctgggactacaggcacgtgacaccatgcccagctaatttttgtatttttactagagatgggttttcaccttgttggccaggatggtctcgatctcttgacctcgtgatccgcctgcctcggcctcccaaagcgctgagattacaggcatgagccatcacgcccggccaaggaagaggatttgaagtcagctctgagtcttattatcttcctccgagtagcacagctggcatcattgcatcactgagagccttctaagccctggacacggctctgggtacccagattcaaagatggattagctcttgccccgttttcaaggagcttatagttgaggagatgtcacattgcaggtaatttcaatgtaatgatacagccatgttctcagaaagtgttcaaggaactgtttgtcctcttgatgtatgtgattatgtcaagagttgttcctgcagaagatcctgtaaacactggggctggaaaatgtgccaggcttattggtgagactctaggctgccctggaggccagacttttggactgcagcttgctcacgtgtgtccctagctccatttgcttcagctacccacttctggttttggtttcggtatctgatgctcccaacacctcacatgaagcttgcaaaactgttgccataaacttaatttctagcaaagggcagagaaagaagtcagatacaagagatcacatattgtttgatcccattcataagatatatccagagtgggtaaatttatggagacagaacatatattggttattaccaggggctgggagggagggagaaagggcagaagctgcctgatgggtgtggggttttgttttggagttcatggaaaagttttggaattagattgaggtggtggttgcacagcattgtgaatgcactaaataaatgcctctgggttgtttaaaatagctcattttattttatgtgaatgtcagcttaataaatttcaaaaaataataatcataaaatgtagcaaggggagaggcattagacaaagttcatagtgacagtgaacattgtttgaatggaagaaaacaattggaagagaagaaataggacatgttaggtataatgatggttgttattttatttatttatttatttatttattcatttatttacttatttatttattttttgagacagagtcttgctctgtcgcccaggctggagtgcagtggtgtgatctgggctcatggcaacctctgcctcccgggttcaaggaattctcctgcctcagcctccccagtagctgggattacagacacctgccatcatgcccagctaattttttgtatttttgcagagatagggtttcaccatgttggccaggctggtctcaaactcctgacctcaggtgatccgcccgcctgagtctcccaaagtgctgggattacaggcgtgagccaccgtgcccgaccagggttgagtctttactctgaatgaagttgggagccattggagtggttggggcagaggaaagagattccttggcttgcttttctaaaagatctctttggttactgacttgagcagagcttgcagacaaggatagaggaagggagatcagttaggaaactaggacagttgtttcattcaagcaggagatgctggtggcttagaccaagtgtagtggccaaagtgttgggatatagtccaaatccaggtgtgtctttaaggtatattcagcaggattttctgagatattggatatgagactaacagaggaagaagagtcaagggtgtgtctagttttttatttgagcacctaaaggaacgaagttggtggagttcgggagctgtccatatattctaactgggaagattgcaagagaaacaagcttgggagagaacattaggagttcagtttcagtcttattgaatgagtggtgctttttcgatatatccaagtgaatatattgggccagacagtgggatatgagccaggagttctggaacaaggttagggtgggagatacagattggaggttgctggcctttgcaggccattgaaagccgtgaacctgactgggatcagctagaaaatgcatgatggtagagaagaggaggctgaacttgactgcactctctgcatgctctggaaaaataaaacctgggttgcactggggacattgggggctagttcagtcattttttagagctggggttttgttgttgtttttgtttaagccaggcactttagtcttaactttcagggaaaatcaaagtaggttgttcaaggtacccaaaacacacagatatgcagctggctttctgcaaagtgttcatgtgaagaggtgccaggtgtgtgcctggtaagtgtgtgttttactgagcagcagggagctgaactgtggatctcttgcagcctcccttttgatatgtgcgtctcaagcagtcaacctgcaaattgctttgtattcagaaggtgccaaatacatgttcatggaatgaatggataaatggtccttgccctttgtgcctgaagaccatggtagaaaggtgcagtttattattttattgttgacttctggtttgaaccaaagaggtttttgcatatacgttggctattagagatcaagtctgcgttcaatgttggagatttattatattttggatagatagagggctctaaaggcaattcccagagaaatccaaaactattgtcaacaaaggcagcattagtggaatcactgactaacttcccaaaaagttatgttaagcaggcctttctaaggatggcagtcaggattgctatgttctcttctgtatagggaggagagtacaggatggcagccaggattgctgtgttaattctcttctgtataaacaagagagtacagaagacagttaacataacaatcctgactgccatccttcaacaggcctgcttacgaggttggctttggctggcatctggggacttggattttaggagggttcccatcattctcagacccgataagactgggtcactgtgcttaaactgttgatgcaaacaatatagtttattctgaacatctgttttccttctgggagtctacaattttggatgcctgcctaaccagtcctgggtgaaaaccctaggcacggaacctctaatgagcttccctcgtaaacatgttttcacacgtgtggtcacagctcattgctggaggaattaagtgtgtcctgtgtgactctactgggagagaactcttgaagcttgagcctggttccctccagactttgcctcatagaccttcttcctttgctggttctactctatgtccttttgctgtgatgagtcatagccatgagatgctgtaagtcatagccacatctacatgctgagtctggcgagtcctcctagtgaattgttgaacctcacctcctctgcatttttggttgttggtgttgttaaacagccagtcatatcatcttacggagctatgaattccattagcatttactggattccagctatgtacaacatacttgtaaaactccagtttgccttagaaactgagtcaaaccaccaaatgtgtccaggagtaactcgttcccaagacatttccagatatcaggcaatatggaagctacagagatgaagtctctgaagctcaattgagataggaaatgtaagttgtatagaagttgtatagaagcagaacccctagaacattgagggaaatgagtgctctaccaattccataatgtaatagtagcttttattaagaggagggtcatgaatgctgtcttgggggagttagagaagtgactttaaggcattggtggactttgctggtgttgagaaagaatattttgatcttccttggtatccgtcgtcatcttttagctttcatttgtgtgttgatctatccacccatcttcctgtccatccaattgtctgtctacccactcacccacccatctatctgtccagccttgccaggcagcttgttacattcatgagctttgattatgtgttaggctgtgttcaaggcactgaagtactggggtgaattgagtagggtccctgccctcttgtgcaaaggaaggatttggttgggtgggagatgactaatgaatccgtaccctggtggtattgtttagggagagggagatagacctgggaataaatatttattcctagatagaagtgcacaattctttctagggatacacaggtacacatgcccaattcaccttggtgggttgagtggggagaggggcagggtgacaaataagagttacttgtcaccttacctactgtatatctaagcatattgtccatacaaagagatcagtgcaggagatgtcctgtgtccctgtcttcataaccagaacggggaagaaaacctcctcctgtgagttccccgaaggttaatttaaaatattcttttcatttggctttaagattactcagagccatctttaatacacaattagggacataaccattcctaaaggtaggtggcagctgccttcattcacctgccagtgataatcaaaggaagactcccagcctgtctagtctggaacattcagcagggcctaagagctcttctctaagtgatgatgggactgaagccatctctgtagtgcttcccttgctgttctgagccatttgcagtgggaataagtgcttatggagtcagcagctgtgagttgggggaggcaaattattacttttatttttggctctgcctggggtcagaatttcttttgtttctgatttaccttttatttgagaaacttggcatgatacctgtgttcagaggattcattagtcatctccctctcaaccaaatcattcctttgcacatgtgattgttaacccctcttttttttttttctccagagttagttatcaggcattttttcagaggactttcataaggtagtctgaacaaatgaagatattattttcattagtaaaaatagtaacagcaaacactaggggtgtcagacagtgttttaagtgcgtatatagctttactcttttgatacaacttatgaagtagatgccataattatcttccctgtgttacatatgaggaaactagtcactggggaagcggggggtatcaggtaatttgtccaggtacctcttctgatcttggattttaaaaggagttggaacaccaaaagcacaattcgtaaaacaaaatggatgaactggaattaatcacagtttaaaatgtggctttgtaggagaatctgttaagagggtgaaaagagacgccactgactgggagaaatgtgtgtaaatgacacatttgacagaggactcgtatcctgaatatataaaaatctctccagactcaacattaaaaaccaaacaatccaattagaaaatgggcaaaagacttagacatgtcaccaaggaaaatacacagatgggaaataagcgcatgaaaagatgctcaacaacatcagggaaatataaattaagaccataattagctaccattacacacctattagaatgaatacgataaaatttgctgacaatatcagatgctggtgaggttgcagagaaactgtgtctttggtgggaatgtaatatggtatgaccatctgtcaatttcttaaaaagttaaatatataccatatgtattagtacattttcatgcggctgataaagacatacctgagactgggaagaaaaagagttttaattggacttacagtaccacatgtctggggaggccccagaatcatggtgcgaggcaaaaggcacttcttacatggcggcggcaagagagaaatgaggaagaagcaaaagcggaaacccctgataaacacttcagatcttgtgagacttactcactatcatgagaatagcatgggaaagactggcccccatgactcatttacctcccccgggtccctcccacaacacatgggaattctgggagataaaattcaagttgagatttgggtggggacacagccaaaccatatcaccgtatgatccagaagtcacacttccagaaaaatggaaacttgtgtttatagaaatacctatacacaaatctttttaagagttttatttgtaatagctcaaaacttataaactaccccaaagtccttaacaggtgaatgaatgaacaaaatgtatatccttgcagttgaacactactcagcgagaaaaaggaatgaacttgatgcgtgcaataactgagatggggctaaaggctattacgttgagtgcaaaaagccagtctcaaaaggttagagactatatggttctgtttgtacaaccttctcccaatgacagaattatagagcataggaaaagatcagtggttgccagggactagggtggggtgtgagtataatggggtagcataatggagtttcttcaggatgatagaacagttctgtatcttgattgtgatggtggttgcacaaatctgtacatgtgataatatttcatagaactacacacaaatacaaaaaagcctgaatgtatgcaagaactaataaaatctgaataaggtctgtggtctaattaattgtatcttgctgatgttactttcatgattttgataattatagttatataaattatcaccattgggaggaaactggatgaagggtacacaggacctctctgtactatttttgcaacttcttgagagtctataatttcaaaatgaaaataactgtaaagttaaaaaacacacagggaggtaggtatttagcagtcagagcttttgatataatccttgcctgcaaggggcttactatttgattggcagggtttggtgtactcacattaaacttttggaacggaatgagtcaggggatagcaaaaagcttagcttcatgtcttaaatgaagcttagcttagatgtcttaaaaattaaagcaagccataagtgcgtgggacagcgaggatcttcttcttccctatttcctggctaaatagagcccaccacatgcacatgtgagcacacatggtctcagcaaattctagttcctacttcagatcctagctcttctatgaccttatctatggagaggtctgtattttcattctcccctgaaccaactatgtccccataccaatacacaaagtcttcttcctccatattaccaaactctccgttttcagtcactcttgcttttgtttgtgagaatgttccttattgaccgggcacggtggctcacttctgtaatcccagcactttgggaggccgaggcgggcagattgccgaggttggaagttcgagaccagcctgaccaacatggagaaaccccgtctctacttaaaattagccgggcgtggtggtgcatgcctgtaatcccagctacctgggcagctgaggcaggagaatcgcttgaacccaggagggggaggttgtggtgagccaagattgcaccactgccctccagcctgtgcaacaagagcaaaacaacttctcaaaaaaaaaagaagtttcttatctgtatatgtttacaaaaacagccatccctttttgttaaggagttagttgtagatttgtttgtccccaccacatggattatggctttgttttctcagcagcagtgcctggtcatagcccggctccagaaatgctgcttaactgatcaaacagtgggcagtggtatgcccgtctccagatgcttagtctaacttcacgtggataggctcgcatcctacccacgggattgcaggtgtttctttggcgtgatactccaccactgagaacattttgcaaggtaccaggcatatctctggctctccatccatgcatggatcaagctgctatcagtaacttcctggagaaaaagaaactccaggaatctggaggaataatactagataaaattgtccaaattatccatgcacaccagaagctcaaattgaatactgtagatggccagggtccacagtgttgttgtttttaatgggatgcagtagtgttgggtggaaagctgaaatgcctgacttttaaggttccttccaattcagaatttttatggttttgctgtaggatgtatgtgctcgtgctccattttagagcagcacggaaagccctcctggaggattcctccggatgaaagatttagggtggggtcatggtgtctgcatttgcagcctgtgtcatggacccaatgaagctagtgaggtgccagtttttctttgtgcatattcttccagtgtgtcaaggagcttggggtgcagggacctgaatgattacaccatcctcttcagatcatatctttgaaaaacgtgtcaaggtcctatgtccggggtttggagcagcagtgccagcgtggaacactcctgttgcgaaaaagccatgtgtgttggtaaagatggagaaaagcaggatgtggtcatccagtgagcactccagtggttgctccttctgtcagctctccctttcaagccgtcgggatcccagaagctttcactgtgttcctttttaacttgtacatttcatcatgtaatatacatgtttatttgtagagggaaatgcagagtatgtgcatgtgtgtaatacctatactcactatttcagacattgctaggtactttaatatctaggtacttcatttgattgattgattgattgattgattgagagacagagtttcgctcttgtctcccaggctggagtgtaacggccagatctcggctcactgcaccctctgcctcccaggttcaagcaattctcctgcctcagcctctgagtagctgggcttacaggtgcctgccatcacgcccggctaaattttgtatttttagtagagacggctatttcagtagagacgggttttcgccatgttggccaggctggtctcaaactcttgacctcaggtgatccacccaccgtggcctccctaagtgctaggattacaggtgtaagccactgcacccggccaatgtctaggtactttaatgtgtaggtacgatagcatttattgctttacgtaattcatgcaacacctctgtgcattaggattatgatcctcattttataggtgagccacatgggagtgaggcgaggagggatggttaggttacggttgtaaatggcaaagctgagataagactcaaaatcagtttatcttcagaaccattttgcaagtaagggaggatcccagatctcaaagtgcctgtatcagttaggatgcctttgtgcctttggttgtgagaagcagactctacaaactggcttatgcaggtgagggaatatactggaagtttgccataactgagaactccagaggcagaaccagcttaggggagattggtcagggctgtcacttgtctcctgcggtttcctaggctctgtcctcttccatgtgcttctcctctgcctccaaccaccgttggctcctccatcattggagtaactctggctcatgcccattggaatcagtcactatggcaagggagctttgattgtactggttgtgtaggttaacacgatggttttacacaaccatctgtaaaatttgggatggtgggatacctccccagacccagacttctggacaccctagatcgttttgggaagaagaaagaggagaaaatacctgtcaacaatgcccaaaggcagagaaaggtggagctaagggcttggtgaaggggagctgagaagggaggaggtgcaggctagggaaggcgaatgaactggctggaggggtgcccccttcttgtctttttcctctgcttgcttctgtgccaacttacatacctagccattcacgggtccatcaccctcttctgtccctgatgttctttgccaagctcccactctctttaattaacaactttggagatgcttttagaagagcccaagtctggccaggcatggtggctcacgcctgtgatcctagcactttgggaggctgaggcaggcggatcacttgaggtcaggagttcaagaccagcctggcaaacttggtgaaccttgtctctactaacaatgcaaaaattagccaagtgtggtggtgtgcccctgtaatcccagctactcgggaggctagggtaggagaattgcttgaaccagggaggcggaggctgcagtgagctgagatctccagcctaggagacggagcgacatcccatctcaggggaaaaaaaaaaaaaaaaaaaaaagcccaagtcttactgtgtcacctttaaggtaaaaatctcccctcctcctccacctggctctgtttctttgcattttccaaggtcttccacaagagggactttgctgttttctttctgcagtttctttaatggtgtgttggtatggtgcttttggtgggataattttacttggaaaataatgtttctgacccatgtccttctttgattgattttttaaagatttatattttgcttttcttacgagtcttctggattattttgggtgtttctctcttttttgttttccctgggaatttgagtctagcgggggctcaaaagaggttcatttcgctagtggctttgcctggtgtcctcccagtcagaagtcggcgacgctggtcagtggtgcagccttctctccaaactctgtctgccttcctcttttctgatattctgaatccctagctgcgtattctccacttctcgttgaaaccaactcttagaaaaagggctgatgacatgttaaattagctactttgagtatgtatgtgtatggatgtatacccgagtaatactcaaactcttaatttgttttaattattatgccttgattaggttatttaaacttcagaactcctgtgaggtacatacaaatgccacattttacacatgaagaaactgaggcccagagatgtcaattgacttgcatcaagtcagtttagaaatagcaaaggtgggatttgaacccaggtagtctctggctccacagcctatgttcttttttttttttttaatactttaagttttagggtacatgtgcacaatatgcaggtttgttacatatgtatacatgtgccattttggtgtgctgcacccgttaactcgtcacttacattaggtatatctcctaatgctatctctcccacctccccccaccccacgacagaccccagtgtgtgatgttccccaccctgtgtccaagtgttcttattgttcaattcccacctatgagtgagaatgtacagtgtttggttttctgtccttgcaatagtttgctgagaatgatggtttctagcttcatccacgtccctgaacgcatccttttttagggctgcatagtattccatggtgtatgtgtgctacattttcttaatccagtctatcattgatggacatttgggttggttccaagtctttgctattgtgaatagtgccgcagtaaacatacgtgcgcatgtgtctttatagcagcatgatttatagtcctttgggtatatactcagtaatgggatggtccacagcctatattcttaaccactatgtctagtgtgtttctctctttgtctctctctctccctctccctcctaaaacttcttatacatagatccgttaatgtgtatatatagtcatggttgctgcaaggatcaagttatttgcgtctgtgtaaacctacatataagtaagtagtggtagtaattattatggctgttaatgaaatacttactgtataccagcaattatgctaagtgttaagtacttaaattctcccatgctgagctttcagcagccctacaacttgttactgtatttatcctactcctactttttagatgaaattgggttttaggattaatttataccagattacacagtttacaaagacggagactgaattcaaacctctttaaagactagttctcttaaaataggatcagcaacaactcttaccattcattgagtcctatgacatgctgaaggtaaaggaaaacaatgctgacgcagtctcacttcaagcatcctctgagggagtttggcctcattttatatgaatagtgttcctttttactcttgaaattgtcccattttaaggccgggcacggtgactcacgatggtaatcccagcactttgggaggcggaggcagacggatcacctgagatcaggagttcaagatcagcctggccaatatagtgaaaccctatttctactaaaaatataaaaatcagctgggtgtggtggcacgtacctgtaatcccagctactcgggaggctgagtcaggagaattgcttgaacccgggagcggaggttgcagtgagccgagatcgtgccactgtgctccagcctgggcgacagagcgagactccatctcaaaaagaaaagaaagaaattttcccactttgaggaaatgagtctgtggtttctggatggataagaaaactgagtttagagaatttgtgccacttgtccaaggccacacagcagtaaaaggatagactggggttggaactctggtctgtctgaagaggccaggctcttcaccctgacagttgcctggcttctggtatttgctgccttcttgctcctcttcgagagcagttctggctttaaaaacaagttctgtgggcagaggtactccatgccccagcctgagcccttggggcccacctgggattggtggtgtctgggcgatctcagggttcccttctttcttccctccctcctgagaagaatcagactcagacaccatcttttgtggtctagtgtttgggaaaagacggctgcacagtctccaccagcatttgcaaattattcacaaattatatgcacagacacatggggcccaactacatacgtcgcagacttgaatgtgggtcctgggaagcttctggatatgtgagtttgggggttgggcatcccatctagcataaacttaccatcttcatgcttgcagccttgcaatatacaggccctgttttcccctcaacattaataaactttattttccctgcagttgtaggagacagaggctctatagaaaacttacaaatgaaaacatattcttttggaaaaaaaaattatggttatcaattccttctttattagttttcttttatttttagatccatttgcatgaaagcaagagattctcacaccaccccctctttgtatgattatgacagagaggcaataagaggacagattcttatgaaaaaaaaaaagttggggggtgcttgccttatttgagaaaacagagatctgcagtgatgaagctacacataccacatagcttaagagaggagctggaaaaagttctatttagggagaaggatttttcctgtgttcttgcgggaggtaggagggactctggaagtgacagtagctatccgtattctggaataaaagctgttctcctgagaaaagaagcaatattcctcacttctcacagcctgtgccgggtttcaggtttgggagtgggaattggacatttgaacctttcatttcctaaatggatttgcaataaataaaactagagttaaggcctcatttcagtaaacatgggggagctgttggaagctgctgctccctgtttcagacgattatctcccactcagtcctggtgggcattatgtatgccaggtgggagcggagactgattttgtccttcctcattgaagcctggaaaagtctagtatcttttatcagatgtggggtggttggctgtttccttttctcctccagccatgatatttttaaaattgacagccccgttgtgatccagggtgatgagagagagactgacattttaaagtttcagaacatgtttttcagctcttctttggattgctaatgtgaataataatgccacattgaacacttatcctgtgcgatgctgtaggagtgtggtaaacatctcataaatcttcatggcactgctcgctgcagcatggccagtcgtggaactccctgcctccgtctcctcctctgggcacgctcagcagctttcgctgtttgggtggaaagctgtttgtggatattaaaggagatggtacttggtctagaagaggtgctcaatgtcagtgtcttctttagcccctcccctggccccaccttctcctttctttttcccgtggctggggttttggggaagtccctgaacacagtgagaaaggggtctgttttctcctgagtaatttgaaaatcttggctaagaatgggggagagaaaggagggtgtggatgctactaggtgagggcttgggaactcctacatttcctatggaggaagagtttcaaaacttgtgtttttttgcttctgtgctttgtttttttttgttttgaatatgtgacttgattattctggtttgtaacgttgtctttaggaaatgaaagatgcctcattattttctgattccccaatatcctgccctcttaggggtttcctagtaacagattttcctggttagaccttgccctcctgtgttagttcattctcatgctgctaataaagacataccccagactgtgcagtttataaaggaaagaggtttaattgattcacagttcagcatcactggggaggcctcaggaaacttacagtcatggtggaaggggaagcaagcacatccttcttcacatggcgggagcaaggagaagtaccagcagggaaaatgccagacacttataaaaccatcagaactcctgagacacactcattatcacgagaatagcatgggggtaaccaccccttgtgatttgattacgtcctaacaggtccctcccatgacatgtggggattatgggaactacagttcaagatgagatttgggtggggacacagccaaagcatatcacctcctaacaagtataatcctaggttgtctgtggccatagtgcgttctgttttaccgaattgacgtctctgagtctgaacactggttctgctgctaagtgctcctggactctgaggctctgcatttaggctctctgggcatctatttctcacatagaaaagggaacagataataaaaaagcctaccctgtggggctgttgtgagtagtaaacgaggtaatgttatcaagtgcctgtcttagcatgcagtatgcacttcacaaataagacacataaaaatttctttttcccttggacacaagacttagagtatttttcctaggatgatggtggtagttgtgagtagtaatatgagtagcaatggcactagtgctggcagtaatagtggtagcactagtgctggtggtcatagaagtagtaagcctttggcttggcttccataatgaaagtctataatgatttctatataataatctctgctctttagcagcatttttccaacagaaatttatccataaagtgcccaataacctaatgataaggcattgttagcagtgagatattccatacaaatgaattttcagatgaagtggcacttttccctttaggcagcaacatttctaaacacaaaatgaaaccaaagaggcataatgattttgtggaaaatgttctaagctagtatttttcttcctttgcaaacagaaaagactgaaaataattaaatttttttgtaatatgactcagttcccctttgtgccatattataatccatggaaattactgagttgtgcagaagagtttactcctagggtatacggccccaaaggatcatgcttttttaattcttgagactgctctttgttcttcttttttaatttttttggccagccataaggatactacgcagacatgctcaccattcctaaacttcctggggaaagtttaaaggtggctacagcctttccagtgtacagcacaaagacattttaattttaatgatttatctcgctcatgagcttttctcatttacttatagaataaagttttcattcttcatttagaaggcttttctttataactagtacaagttataaaacagaccatctatcctttatattctcttaagaaatttgtgtttgtggtaggtaaaatgaaaagttactgccgttgtttttggtagaatttacctggtgttcaccttgaaaggatatgtgcttgtgggccttttaaagcaaaaacaaaataaaaaaaggattgaaacttctgaagttatctaaataaatattcttggtatgtattgctgtgaaaacaaaattcaacagagcttttagatgtacatgtcagttatatcttatattttgtagaacttgagaagttggcatgtcagattagtagatgctctggatgcggagtttttcaatctttgtgacaggtaggatacatttaaactttggtcagcttccggagaggcatagcctggtctttcatcatatatctgaaggcaaaaagatagatggaaatctctaagcagtatgaattgtaagtatttctgttgagttataaatacctcaaggaaaagaaccatcttagttttcttttattcacttaacaaatatatattggcttttgaagtggttgagtgtagagttctagagttaaaaatattttggacttaaagaaaaaaaaattggtttaaattcctgctgtatccttggatgattcagtgtaggccagtttcccttcacaatagttattgaggggctactgggtgtcagttgctatgccaggtgtattagcatgttctcacgctgctaataaagacatactggacagtgggtaatttataaaggaaaaaggtttaatggactcacagttcacatggctgggcaggcctcacaatcatggcagaaggtgaatgaacagcaaagtcatgtcttacatggtggcaggaaagagaggttgtgcaggggaactcccatttgtaaaattctcagatctcataagacttattcactaccatgaaaacagtatgagggaaacccccatgattcagttatctccacctagtgccgcccttgatgtgtggggattattacaattcaaggggagttttggggacacagccaaaccatatcattctgccctcagcccctcccaaatctcgtgttctctcatttcaaaaccaattatgccttcccaacagtcccccaaagtctcaactcatttcagcattaactcaaaagtccacagtccaaagtctcatctgagacaaggctagtctcttccacctataagcctgtaaaatcaaaagcaagttagttacttcctagatacaatgggagtacagggcttgggtaaaaattcccattccaaattggagacattggccaaaatgaaggaactacaggccctgtgtatgtccgaaatcatatggggcagttaaatcttaaagctccgaagtgatttcctttgattccatgtctcacatcctctaggtcatgctgatgcaagaggtgggctcccatggagttgggtagctctacccctgtgactttgcagggtacagcccccatcctggctgctttcacaggctggtgttgagtgcctgaggcttggtgcaagctgttgctggatctaccattctagggtctaaaggacagtggccctcttctcacagctccactaggcagtgccccagtgggcactctgtgtgggggatccaaccccacatttccattccacactgtcctagcagaggttctctatgaaggctctgcccctgtagcagacatctgcctggacatccaggcatttccatacatcctgtgaaatccaggcaggggttcccaaatctcaattattgacttctctttacccccaggcccaacagcatgtggaagccaccaaggcttcagccttgcaccctccgaagcaatggcctgagctctatgttggctccttttagccacggctgggacacagggcaccaagtcctgagacagcagaaagcagcaaggccctgggcctgacccacgaaaccattttttcctcctaggcctccaagcctgtgatgtgaggggctgctgtgaagacctctgacttgccctggagacattttcctcattgtcttggcaattaacatttggctcctcattacttaggcaaatttctgcagcaggcttgaatttcttatcagaaaaagggtttttcttttctattgcattatcaggctgcagattttcaaaacttttatgctttgcttctcttgtaaacataaattccaattccaaaccatatctttgtgaatacttaaaactgaatgcttttaacagcacccaagtcacctcttgaacgctttgctgtttagaaatttcttctgccagatgccctaaatcatctctctcaatcttctctctcaagttcaagtttctacaaatctctagggcaggggcaaaatgtcaccagtctttttgctaaaacctagcaagagtcacctttattccagttcccaacaagtttcttatctccatctgagaccaccttaacctggacttcattgtccatatcactgtcagcatttcggtccaagccattgaacaagtttctaggaagttcaaaacttcccacatcttcctgtcctcttctgagccctccaaactgttccaacctctgcctgttactcagttccaaagttccttccacattttttgggtatctttattgcagcaccccacttctgataccaattaactgtattcatctgttctcacactgctaataaagatacacccaagactgggtaatttataagggaaataagtttaatggactcacagttccacatggctgggaaggcaaaggagaagcaaaggcacgtcttacatggcagcaggcaagaaagcttgtgcaggggaatgcccttttttataaaaccatcggatctcatgaaacttattcactaccacgagcacagtatggggaaaaccgaccccatgattcacttatctccacctggccctgcccatgacatgtggggattattacaattcaaggtaagatttggttgaggacacagccaacaaataataccaagtatggtggacatagctgagaaccagctggatgcttggtctctggcctcctggactttactgggcagggtttcatgaactctgtcatcctcatatccctttatagtgtttggccacatcttcttaagaccttgttatttacttaaatacattaaagatattaagaagtttatgtcattctctataaatagcagggaaccacaggaactaaaccatgttcaagtctggctagatgctgctactagccaaaagctatctgaatggaaactctcagttccttcttaccaagtgttgaagggctgtaaggacacactaacagtgtattgaggcttgcctggaatgcattagaagaattgtcaagggagggggtaactttctcactaagttcttttgaactgagagatgaagatttttaaggctgatgtaaatatttgatttttctcattctgattgagctgagtgcaacatgttgggaacggcttcatgcagaaagcctgtggtgaatggggtctggaagaagactttggagttgacttggaaggaagatagtttggaggcaggactggtcataaaatcacctttatttgcttttgaaatattattttatatcaggtgtcaaatgtagaaatctgaaattctggaaattaaaagctgtttcagaacaatattgagatatcacccatgaagatcctgtcttggtaggaggagcgtagggaaaatgtcctgatcagtgcactcacttattgccagggacaataacatcaccactgagaataaggtcaccagtctaactagtgccccatattctgtaaaacttgcctctccagtgcttttccagaggtttaggttaaccagcaaatcagaagtctcaaagatcttttctagttcctgcttgaaattgggtagaagataataccagctgttacgtggaagtatagcatgccattcacttaacgtggaatgaagcaaaacattctgagagggaagacctattacagtgcatgtgtaccattatcttactttttctttctttttttttttttttttgaaatggagtctcactctgtcacccaggctggagtgcagtggcacaatttcgcctcacttcaacctctgcttcccgggttccagtgattctcctgcctcagcctcctgagtagctgggtctacaggcaggcgccaccacgcctggctaatttttgtattttttagtagagacggagtttcactatattggccaggctggtctcgaactcctgacctggtgatccgcccaccttggcctcccaaagtgctgggattacaggcgtgagccactgcgcccagcctatcttactgttaagctgtaatggtgttataggcaggacaggtatttggtactgaggaaggctcttcaaggatgtgagaattaagctgagtgagacctgagggaaatgccaggggaccccctcaggaggggaggctctgaagggaggagaattctcggagaccctctggagggagtagggagagagagaggtccccaacctccttctgaggcacctctttataaggttggaatattttgtactgtttcctatctcttggagagaagagtccaccctttcccaggtaacctgtctcagctttggagaggctgagatggaattccagggaccaaatctaattaattcctcaaaagagaagtgccttttgggagtagcaatattgaatctcactttgatagctcctggtggagcaatttggagagaatatattggggatgcttttttccaattaatatgcttgaataagaactttggtgctcctttgcagtataaaatgaatgtatagtaaaaataagagcctttttcttctaagaagggccttattagaacttggaaagccaccttccctgtcttcccagcacctgaatactgtgccctacttatgcccaaaagacaatgtacttcttgaggaatttttgtaatttagaagcatgtttttgctacctacaggattaaaaaaataaaaataataaagatgctgtcagacttggcctccaggcaatttagtgctgcctgtggcttctggtactgtgcattttaaacagtcctgcctcttctcctttttatttttttaccaccctgccctggttatggcaacttaatacagcatgtctaaatatctaccccttgtttgcacagaaatagtgcacaaattagataaaatggcatttcctttctctcttgacagcttggaatttttttttaagtggctttgacaagattcagggccaaattatgaaatcaccaggtgaccctttccgttcatcagctgctaatgaacttagaaaattgagatctcatctggcagacaaactcattttgtttgacaagcagcttaaaagtatttgtaaatgaacaaattatgttttttttcccctccagttggccctgtgatcactacacatgggttttacagttttgtttgtttcttttttaaacttgtcagaggtctgtagaaaccaggcactgggtttcttcctgtcttgattcctttcatgttgtgcattgttagcctagggtaggtgattcacactagccactctggtagtaatcggttagggtattagaaagagtgctggatgtgaaacaggcaggcctggggtgagatactgttcacccgttactcatcgagtgactttatgagttgtgtaacatctgaatacttcagttttctaattcataaaatggatggctaatttaagtggggtgtgtgtgtatatatatacacatatatacgtatatatacacatatgcacatatacacatgcatatatacacatatgtatgtatacacatatatgtatatacacatatgtatgtatacacatatatgtatatacacatatgtatgtatacacatatatgtatatacacatatgtatgtatacacatatatgcatatacacatatgtatgtatacacatgtatatacacatatgtatgtatacacatatatctatatacacatgtatgtatacacatatatgtatatacacatatgtatgtatacacatatatgtatatacacgtacacatatgtatgtatacacatgtatatacccatgtacacatgtatacacgtgtatatacatatatgtatatacacacacatataatatacagtatatatactgtacaaatatagtataaatacgtacaaatataaactgtctatgtgtgtatattatacatatatgtgtatatacatatgtgtatgtgtgtatgtatactatatggtatacatactgtatgaatatatggtatatatattgtttatgtacaaatataaactctgtatgtgtgtatataaataaaataaagattcattttgtgcatattagtacctgtgactgtctcctgaaagcagaacagacttctttgagggtagaatgccacttttattctaacttttcaatacattattgatcttgcaccggagcacctaaactctgaactggtttaaaaagtgaattagggcactagaaatccttaccttccatttttgttccctcaaatttaagcgagaagttagtagttctttagttaacttccaggagctcccacgctatacacaggccatatggtgacaaatagacattctggagtcagattgctgggtttatatttttgttccatcatttactggcttgtgacttcgagcaaattgctttatttcctcttctatacattggggatagtattaactaatttacagggttggattttagtaagacaacgtatgtgaagcactcatgtatgtagagcttggcattgcagaaagatactgctcagtatatgatagaaaatactactgcaagtcgtaatgttattggtttattcattagcagaaagcaattgttgcagttgttaaacaaaacgaaacgaaaagccattctaattaagcagagtctagtgagagctcagaggagtctgagttggttttaccaaagaggaggtctctgaaggatggattggaggtaatcttggatctgccatgcactaaaaggggaaaaagaaaaaagaaagagagagattgtcttagtgatttggaactgattggccttaccaacttggaagctccttttaaacacataggtcctttttagagcccattgaggaaagaccactctaatctccctctaccgcccactacttccactacttccagtagagcctggtggtcaataaccaccagggaagttagagcccgttctgcagcagtgattgtcagaatcatgcagtggcaccagcactgccattctcttatcctgcgaccatatccttggctgggttgcaagcaatttctcatatgtagtaggccacaatggatacttgtttgattaaatcaacaacaacaacaataacaacaaaacactgctcttctgtctggagagtacttttagtagacacctcttcttcctttcatgataactctccatacaaatttgtgttttttgagatggagtttcgctctgttgcccaggctggagtgaaatggcatgatctcagctcactgcaacctccgcctcccaggttcaagcgattctcctgccacagcctcccaagtagctgggattacaggcacccgccaccatgcccagctaatttttgcatttttagtagagatggggttttgccatgttggccaggctgttctcgaactcctgacctcaggtgatccaccgcctcagcctcccaaacaaatttttaaatatctcagccttctagtcccttttcccatgatttggctataatctcaaactgctcttgcaaattttttttttttctgaagaaacatagtgctcaaagagactctcatcactctgatgagagagaaacagatccagtggattaacgtgttttgctaagtgctgtgataggagacctagaaaacaagcttttggccctttatatgatcttgagggaatctcctgaccttttggatacttagtcttttcgtctgtaaattgagtaccatagcatttgtgtcacagcattacaatgccaattaaatcaggccgaagcactgtagtgtatggcctgacacgctacggtctggaaatttctcaggaaaaataagggtgtgatgagtggaagtggaacactccctctctctctctctttttttttttttttaaacttgattttgtttttttggagacagagtctcactctgttgccaggctggagtgcagtggcgtgatgttggctcactgcaacctccacctcccgggttcaagtgattcttctgcctcagcctcccgagtagctgggattacaggcacgcaccaccacgcccagctaatttttgtatttttagtagagacggggtttcaccatgttggccaggatggtcttgatctcctgacctcgtgatgcgcccgcctcggcctcccaaagtgctgggattgcatgcatgagccaccgcgcccagcccaatttgattctttattttggtagtagctaatctatgtgatgaagccctgactcttcattgttctcgtgtcactgatgtaaaacaacaacacatttaaatgtgtgtttaaaatgtacaattcatataatgtacaatttagtggtttttagtattttcacaaggttgtgtgattgtcacaacgaattccagaacattttcctcactcccaaaagaaaccccatatgcattatcagtcactgccactctcctcttattctagctcctgataaccatgttctgtctctgtggatttggactgggagagacataaaggataggggctactctccctcccgtcttaaatgcgtctcagtcatgaaccttgccatattttagtgctttaaacatttttaaaaatagttgatttgaggaggaggaggataaaacaaacagcagaacccaaaaagaagaactcggactccagacttaattctatcctttgccctctggctaactttggatatgccaattctttgtctgagcctcattttccccatgcagataatttacattgtattagagaactacctcctccccaagctctctttcaggcttaaattcagtgatcttgagtctgtgtgtgtgtatatatatatatgtatatacacacacacacattgattttcttttaccatgtgctggttctttcagtctcttgctgctttctgttatccacggagctggcattgctttctatttttatcagtgtactatttaaatatagaaataaatatcttatgtatatctatttgtgtgtgtgcataaagcagtggaatttatggactaatgcggtcacttacgtaaattacttagcacggggtttggcacatactaagtgctagataagtattatttgctaggtgagtgatgggtcaccctggggtagaccagttgacatttgctcatatggaacttgttcagtgaattgtcctaagtgatcacagctggaagctgccttggtctttggatggggcttctgctgtctgcattctttcctctttgctttcactagtttctggaacacgtcagtgtgaatttttttttaaggcagagtctcgttctgttgcccaggctggaatgcagtggtgcaatcttggctcactgcaacctccacctcccaggttcaggtgattctcctgcctcagcctcccgagtagctgggattacaggcacccaccaccatgcctggctaatttttgtatttttagtagagatggggtttcacctcatgttggccaggctggtcttgaactcctgacctcaggtgatctacccatcttggcctcccaaagtgctgggattacaggtgtgagccacagcacctggccgtcagtgtgaaattatagatttggaaaaacaaatcctgtgagaagagcaatttaccgtaccctgctctcttcaagtgacgtgggaaatgaaaaacgtccaaactaagacaaatttattggataccaaaaccaccaggctattgattcttaaagccagacaacaaggttatgaattgggtgataaaaatggaaagcatttagcttgacttctaaggcggggcagctttgtgcgctatcgcagttattgggttctactgacagccccacaactaatgacctagcacttattaaccagagtgtttactctatgtgctacatctgtctaatgtgttgtgtgagtgagatatatctgaacaatttgattttgtattgaggccggggtgcctgagacttactctgtaactttgaaggctgcaagaacattagctaaaagttcttagctgcagcaaggaaagcaagaaattgttctaagccctaaatagttttgcactgctgcagaggagggatttatgtctcctgatgggttttggaatggataagcagatgttgtgtgttagatgttagagatcagttattgaacccacagttattttaatttggatgctgaaattcagagaggctgtgttcatcagggtcatagtcagttgctgactgagatttcctaaagcttggcttcatgctccttctttcacaccattcagactgttgaggcctgtggcagctgtcaagaccgtgctgtccatcctccagctgcctggagtgagccccactgctcttcgacaggggctgctggggactgggtatcactgaccccgtggaactgaaatgcctctttttgactctgtctcacagtggtttacttgtgtcttttactcgatggtgcaggtaactgttatgggttgaattctgtctccagaattcatatgttgaagttccaagcctcagtgcctcagaatgtgaccttatttggaaatggggttgttgcagatgcaattagttgaggtcatcctgaagccacttgggtccttaatccattacaaccagcgtccttgtaacgggaagtttggacacagacgtgcacacaggcacaatgtcgcgtgaaggttggagttgtgttgccacaagctaaggtcctaccaggagctaggagagaggccaggaacagatctttccccagcgccttgagagtgagcgtgccctgttcacaccatgatcttgaacttctagcccacagaactgtgagacaagtttctgctgtttaagccacccaatttgtagcactgttgttatagcagccctggcaaactgacacaatagcccagtgagcattctataccatgaaagtagaattaggagaggaagatacagtagactgtaccctcttaccaccccctagttcttctttttttaatttttttttaatttttttgaaacaagagttttgctcttgttgcccaggccagactgcagttgcgcgatcttggctcactgcaacctccgcctcccgggttcaagtgattctgctgcctcagcctcccaagtaactgggattacagcacacgccaccacacctccacatctggcaatttttgtattttgagtagagatggggtttcactatgttggacaggctggtctccaactcttgacctctggtgatccacccacctccgcctcccagtgtcctgagattacaggcatgagctaccacgcctggccttttgttttaaaatgatcaaactgtcgctaggaacttgattacttctcactgtagagctgctgggtgccagattacaagctaggtacttcctggttccactctgtactattgtgtgtaatgtatggcatattatttaacctaccctgagctgtggttgtctgatgtgtacaataatgggtggaataatgatagacaaatattaggagtttggggtggattaagcacccaccatagagccagacatatataatgaaataaccaccgttccttgtgtggttctagaaccttatgtgctaaattctagaaatttaggatcattaataataacaaagataaatcccatgtatgcagagcgaagagatttaggtaaacttaagaaaaggcattcatctcaaacaagtacttacgcgcaaatgtttgtagcaaaactattcacggtggcccaaagtaaaagcatgccaaatataacatcacctgatgaatggataaacaaaatgtggcctctccgtgcaatggactattaatcagctgtaaaacaggatgctaggctgggtgcggtggctcacgctggtaatcccagcactttgggaggccaaggcgggtggatcacctgaggtcgagagttcgagaccagcctggccaacatggggaaaccctatctctactaaaaatacaaaaatcagctgggtatggtggcaggcgcctgtaatcccagctactggggaggctgaggcaggagaattgcttgaactcaggaggcggagggtgcagtgagccgagattgcgccactgcactccagtctgggcgacagagcgagactctttctccaaaaaaaaaaggatactgcgctgacatgtgctgcaacatggataaaccttgggtacatggtgctgagtgagaggaaccagacccaaaaggccatgtgttgaatgatcccacatacatggaatatacagagctgctaactctgtagaggcagaaagcagatgttggttgccagggacgaggagtaagggaaaatgggaggtgactggttttctttcagattgatggaaatgttttagaattagataaaggagtggttgctcaacatcgtgaatgtactaaatgccatgaattgtacttgttaaagtggttaatgttatgttatgtgtattttgctgcaataaaaagaaaaagcccgtctcactacaaggatatttatgtggctcaaatcagggggtatcttgaaacaagggttaaagggcattgctgttggaaaccatcacacggggtacagttcaaggttcttggaatcaagagtccctgtgctttatccttatagagactttttctgtgacctgaggaaactcatgtttccatctgtctaaaagaatttctttcctgactcttttcctcctgtggtggctttggtgaccctttgatgacttctcctttcattgcacctcataactaagactgtgtcacaggtcatccctgaaccaattctgggcaaaggagatgttgctctaaagcatgagaccagtcatggtttatcccctgcagctacaggccccactcctcagcatagtgttaccctgtgtgactgaatctgcaatgtgttaacaaggaaagccccccaaaacaggggcatgactgttgggagggcccccagcagggcatcccagaagaaagtttcacattggcctttgggcctccacctaaacaagccgttcttgtgctcggcctcaaggtcattagtccttccttcctccctcccttcacctgccttcccttcacctgccttcccttcccctgccttcccttccccttctccttctccttccccttcccctccccctccccctcccccttcccctccctccctctctgttgcccagactggagtgcagtggtaccatcatggctcactgcagccttgacctcctgggctcaagagatccttccaccttggcctctcaagtagctgggactgcaggcatgtggcaccacacctggctaatttaaaaaatgctttttttgtagagatgaggtctcatgttgtagcccaggctggtcttgaactcctaggctcaagggatcatccaatctcagcctcccgaagtgctgggattacagatgtgagccacgacgcctggccattgattgtcttaagcacagatcccatcattcctgctcggaaatctcgagtggctccctagggactgtggaaggaagttcagattctccttcactgagcattcaagtcctgtcccagtcccattatctgagtgttctctgtaccttttcttctggaaggagcggttggttgccacactgtgtggttccagcctttcattttttctaatggttctttctgccaggaatgacttctctctccttctcactcttttgaaattgtgccatcttctggctcagctcattttttcctgagaatcatgtgtccctggctcccaacttatgttcatgtttgtggtgtttgtgtctgcctgactatcctgtacactctcttgaggcccctcaagagcaggggcccatgtgctgaccatctctgcatccccattctccagccctggacctggcctagcatgtaccccagtcagtaggtgccttgtggactgtagtgaatggcaaagcgtagagaaaaggtaaagcaatagctgtcttccctgtatcatttggcaccagagatatttgtatgaaatctccctaggccttggaacttggaagaacaatacactgcacgttagacaagtcaggacccttcaacactaagggatgccagagtgcatttcccagtattggtccttgtgaaatgcttatgtgtatttgcttaagcagaatgaaaatgtgaggcctgcctgcttacgtcgtccgtttccagaatgaaaatcggaagaacaaagatcgaaatactccaaggcagggcttcataggtagtcccatggatgtgattaagggctgatttaacattcagaagaaaaacataaaaaccagccttcttgaagctgtagtctgaccttgggaagaatgtatatcctcaggaaagataaatttgcgttaaagacctctttggcaatgcattgttgaaagaggttaatattgtaagtggaaaattttgattacttctcgattctttcctcccatttgcttctgtacctgtgtcaccccagagagatctctatgctagaagtaatgtccacaccacctgcctgcctgtggctcaattaaacttgagttcctgcccttttaaagtacaatccagattgtgtgcaacaatacaaagggtggaaattaagaaaactcattgggatgcagatcagtgcacttcacttccccaagccaagggagatgactctggaggaaaagataaagatgaccacagtgaatttgcaggtcatcttttgtgcatgtgcttggttgaaacatccttggaacctttcagtgagggaaaggtcctctctgaagaagtgcttgccttaaaccaggttttctcagtctcagccttattgtcatttggggcataatccttctttgttgtgggactgtcctgtgccttgtaagatgtttattagcattcctgaccttgacccacccgatgctggtagcatcccaccctcctgagtctttttttttttttttttaagacagtgacttgttctgtcacccaggctggagtgcagtggcgcgatctcggctccctgcaacctccacctcctgggttcaagtgattctcctgcctgagcctccccagtaactgggattacaggcatgcaccaccataccagctaatttttgtattttttagtagagatggggtttcaccatgttggccaggctggtctcgaactcctgacctcaggtgatccacccacttcagcctcccaaagtgctgggattacaggcatgagccactgagccccgccaaccccccagtcttaataatcaaaattgtcttcacattgccaaatgtcccctggggtaaattaccccctattgagaaccactgacttagaggctccccatggggaaaagcagagttggtgtgggaaagtctagcagttaaaagaggcagcaggtggaaaggcagagaagtgtgaggccgcatagcagctttgcccatgtggtgttcctggattagaaggtgtgatttggaccatgccagggtatgaagctggaaaggtcaggtcgacagggatccgattttggaggcctttgctaccaaattgagagaagcacattcaatttgaagctggaaatcttggggttattcccagtgcctctcttacagctgtgggacctaagccacttaacctctttgaacctcagtgcccttctctgttaagtggagtcgcacagatggattgtaaaagttgagtgaattaaggccgtgtgaaagtgtcagtatggtacctgggtatcctagttgcccaataaatgttttcttctttcctaagcactgtcacatccagttaaatccggttctctatagttctgctgccactaactcctgctgctatttatccagcctgtattacggcaaagcttcctgggctgtctgcctcaactccattctcagtctgatgtaaaggtttagaaaatactgaaacctgcacagtccagcacggtggccactagcccatgtggctcttaagcacctgaagcgtggctacttcaaactgagatgtgctgtcaatgataagatgcactctgtatttgaagaccaagatgagaaaaagaactaaagcgcctcattagtaatgctttatattgattacatgttaacatgctaatatattaagcatactaggttaaataaaatattaagattaatgtctggctgggcatagtggctgacacctgtaatcccagcactttgggaggccaagggggacggatcacctgaggtcaggagttcgagaccagcctggccaacatggtgaaacccccatctctactaaaaatacaaaaattagctgggtgtggtggcacgtgcctgtaatcccagctactcgggaggctgagtcaggagaattgcttcaacccgggaggtggggctttcagtgaaccgagatcgtgccactgcactccagcctgggccacagagcaagactccgtctcaaaaaaagaaagaaagaaagaaaaaaaaagattaacgtctcctattttttttaaccctttttttaagtcaactgtggagaataaggtaagttttgtaagagtggccattgtcttatccaaggaagcctattgattcttcatgagagaatcattttctggtgctaaattttgagacataatttgtttcataggggtagtctcttttgaaaaatggatatggtcccttcaagaagagcagtagcatattgaataatgtgtttggaggagtttttttccatccgcccctccacccccaccccacccttctggtagatgtaagagtattctttcctttttcaatagttcttccttttccaagatacacagccttgaggcagaatcagagcacatcttccccacctcacacatgatttgtggttatcaaagcaaacaaacagtagtgtctgtactgtccttagattttgattggtcgaacagctatagtcaatcaatttattttagtcctattaatactacatagcatctcatattgttgtttgataatcgtattttggatttcatttgatctcttgcaatccttgcaacaaccacgagtgcctgatattgccatgggctttcccagaaaaatgacgggaggctccaggataacaaatcagttgccaggctcctgcagcttgtatctgcagagctgatgcttgaggccaggtttcctgactcccagagctttgtaaatgctgtgaggcccatgtgaaatgcagactgtgccttggagtttgcttgttatataacagagacaagatgggcacaattcgggtgacaactaatgtgtcttgactgcagagctgtatgaaaatgggtggttgaggactgtgttggatgcctcagggggccactgccccgatctgtgacaccacagtggttctgaaggcaaatgtacatgtttctctgcagccagagaatttgacttcgcagcaggatcaagacaaactgagttggcaggagtggacccttgtggtcctttcaacatagtgaactcgaaattttcaatgtttgtttgagagcatattgcgtgcggcttttaaattagagttcacatgatgaatctttaatagtgcctccaaggccaagtgccattaggaagtgccagtttgacaggccagaggatcaccttcagggaggaaattccacagagatgctcgcgtggccccagacccggagggaggcaccagttgcttcctgtgtggtcattcccatggagcagggagaaggagagaaagttaccaaagtgaactttgcaaatgacctcacgtgcacgagagggtgtctgaggggcagtaccccattgcctcagggacctgtgtgggatgctgtgtggattccatttctcatgttacagatgttgtacagtcagacagctagttgctggacctttgttttaaaagggtttattggagcagtatgagagtgactgcaggccgcctgatgatggcacattcgttcattcattcattcattcattcattcattcagcagatactcactgaatgcttcccatgcgtctggatataccttgaatataaagtagtcatggtttatgcccaagtagagattaaaatctagtgggcgcagcagcgattaagcaagtaatcaatcaaataattgtttaatttagaaatttgatgagtactatgaagaaaatgaccgcagcacggtgatagacaaagttggggagggggctactgaggcataggattgtctgggaagagttctctgagttgacagcattcaagatccagtctagagggataaggatgcagtccagcaaagagcccaacataagcatttcaggcacagggagcacacttgcaaagaccctgaggcatgttccagaagtgaaggggtcagtgtggctggagtagagcagagagagtggccagagacaaggtcggagagatcgaggtcaagtcaggtgcttctaggtggagcaaagagtttggatttaagagttgatgagagacactgagtaatctccttttttttttgaggcagagtctcgctctgttgcccaggctggagtgtagtggcgtgatctcggctcactacaggctctgcctcctgcgttcacaccattctcctgcctcagcttcccgagtagctgggactacaggtgcccgccaccacacctggctaattttttgtatttttagtagagacggggtttcactgtgttagccaggatgatatcggtctcccgacctcgtgatccacctgccttggcctcccaaagtgctgggattacaggtgtgagccgccgcgcctggccaacactgagtaatttcaagtggagtttgaatgaggctgctaatgcagaagccacgggcatggggcgatggtagcttcgattcgtatagtggcaggagaaatggagagaggacgatgtatgcgaggcatggaatagcagaaatttgcctgaattggagattgcgtggattgcccaagatgagctgtttgagtgaggaactgagaatggctcccataatatgtggcttgagcaatggagtaaatgatgttgccctttctggagcaggtttggaggaggaaatcaggagttgaggtctgagatgcatgtgggtttatccagtgggtatataggaagaaggtcattgtacacatggacctggagctaagaagagaggccagagctacagggaggaatatgggagtcatcagccgggagattgttttgcaagctgttggcatgggggttttcacctagggagagaaagaaagtgtggatcccacattgaatcctggaatacccctaaaatttatcattcaggaaggaagaggtttgagaaaaaaaatgtatgaaataagtatctcagaggttggagaagtgagtttactagagaaaggcagtagcatttctgagcagttgagtgcccatttgaaatcagaaatgattaactgaaacatatctgccagcctgagagtgtgatttcctaccccatttggcttcacacataaagctgtgaagagcaaggagggttgcattcatctgaagcgttggattttcccaggctactgcagtctgaaacaaaaagggccaagggaggggcgagtacttacagaaggggattatagtaacaaaccgtggcagcatctacgctgaacaagagagaatacaaaaaaaaaaaaaagcaaaaaaatagacctggatagagagtatgataaagaagggcagtggattggggatcatgatgacagtaaagaatctatgcaattgtagccttggagggctggcaacgggattgtgggagattgtgtgggggactgtgggggatattgacattttaaaccatgcaggttgtgctgctttgggtgatgacaaggcctagaatgtgaacctggttaatgtgaagtggcagatattttggatgggcattttcatcatggaagtaagtggagaggaggaagaatgtgagaatggtcacgcggagattacagttatcaagaatgggaggagtaaatgacctcccatttggattatgggcagtttcttggtgtgatgtgggggattgtatgtacacacacatgcacacacatacacataaaatttttttttaatctgcagtagcaatataggatattgcctttcaccttttttgcttttttattttctattttttagagatagggtctcactctgttgcccaggctggagtgcagtggtgtgatttttagttcactgcagcctcaaaccctttgctcaagtgatcatcctccctcagcctccggagtagctgtgactacaggcagatgccaccatgcccagctaaagtctttacatttttttagagttggtaggtctctctatgttgcccaggctggtcttgaactcctggcctcaagcaattcttccccctttgccctcccaaatgttgggattataggcatgagccactgcacctggcatgtctttcaccttttaagttcagggaacagtttctcctggctacacatacgttatcagtgcaatgctttatgaagctttagaaatgagctgatgactttcataaataatgaaatataaacatgacattattttagtatcttcaaacaaatgatctgaggatgagttacacattttaatatcaacactaacttgtaatttgtacatttgcattggctatacatgcaaaaagattattagctacaatgaaatggattccttaatatctatgacattctaccttgctaatgctatagaataacttgcactttaaagtacatttgcacactttgcatattatgttctatgattgcttctgggttttccatacagattatttttgttgatattaaatggaaatcgtagggctgaaatatgctgttcttatgtgaagtaaattactataacctgttggcctaaaaaaaagaatgagagctgtgaccagtagttgccaaggacagggaggacgatagtgagccacagtggaacaggggtcttcattagagagagtggcaggaggatccaggagagacagctggaagccagaaggacagaggcccatttcttttcccttagttgggtacatgctttgcaagagggtaacagatctttcttttaggggaagcagtgatttaggggacagctccactttcacataaaagcaagaggcagaatgacgtgagaggaaggaggttgaacataaagaggagttttctgatctcatagtgtaagttccacagcattccatagatggacttggaggggaagggtgggctgaggggtatcgtgtgattggagtagtttgtatgataatgaatatccagtgagactgctgccgtgatggagatagtcattgatccattcaataaatatttattgattagcttcttgtctatatgctagatactgtgctagtaatgaacaaggcagcagtgggcaaaatgaacaagtccctgcccttgtgacactgatggtctgataggggagatagaccgtaaaggaaacaatacgagaatttgcgtgccaggatttccaaccactaagtcagtgtctttagcctctcttagtctcagttttccatttggtaaggtgggtgtaatgaagtgggtggtgctggtgctcttcagtcagtattcacttgtgggggaagtttttgatgaaaagtcgggcacatcatcagagccaaccctagtccgtagatgtttttgtttagttagaaaaaggcacgtgttgagaaactctgctttcatctcttagaaagctgttgtaacaaatttgcaatcaaggaagtctaggatgtgaacagtttgccctactgcactggcggattcctgccctggtgaagtgaggagcagagaggagaaggggtggccagctctgtttattaaccagttatttactaggtgctttagtacaggcttctcaaacattcgtgtatatatgaatcacctgagatcttgttaaaatgccagttctgattcagtggggctagggtgaggcctgagattctgcatatctgaaaagatcagctgatgctaatggctgttggttcaaggaccaccctttgagtagaggtgggttggtgtaaacattccttggtcttagatgctggtctcagggagaggcttaaaactaaccctggaagacctagatcctttgcccagaaggggttttagtcgaatgaagagagatcaagtaatgcacaggaaatgattagaagataattaagtgattaggagtgtgctgctgactcctgttggtgttgagaagcaaaaagggagagcctccgggactagacttgacagagaagtcctatagaagcagtgaagacttgattctattgaggtcccagagaggaggaaagacatctaggatacagtaggcagggcgggagactgtgtgtgtgtgtgtgtgtgtgtgtgtgtgagcgcgcgcgttggattgtggcttgggtaaaggtgtgcagtaggaaaataataatgacagtaatataaataatgataataaagctaacatctttcaatggtccatctgccataggacttggtttttttttctttggagtgggacggagtctcgctctgtcgcccaggcggcacaatctctgctcactgcaagctccgcctcctgggttcacgccattctcttgcctcagcctcctgagtagctgggattacagacacctgccaccacgcctggctaagtttttgtatttttggttggtatggggtttcactgtgttagccaggatggtctcaatctcctgacctcatgattcgcctgcctcggcctcccaaagtgttgggattacaggcgtcagccaccacgcccggcctataggacctgttttataacaaaacctcggtgatgtccagctctttctcttcaggtgctgggacagcaccttgtaagaaaggttcactgaagacgagtgacaatgtgtgagtggcaggattcaggcaatcttctagttagaatcagtggtccaaatcctcccactgttatatgcacctaggatcagtttgggatcctaagcaattctgaagggtttgagccattttgtttccccatatatgtgtgtgtttgtgtgtatgtgtgtgtatatatttttttcttagatttttattccttcttcatgtgcagtgtttctagacaatccacacatcctgaacacccatgaaaaattatttctaacatccatgatgctaattaaaagacagcctctggtgctgatgagagatagctggcgcacacgcttggaatgtaggcttctgactggagtctctcaaatggtaactagccacccctggagggtgtattcccaattaggacacgagagatgttaactcactgcactgagcttgtaaattaaagcttatatatataatatatatgtatatatattaaagcttatatatatacatatatatacatgcatatatatgcatatatattttatactgtctgtgctgaggtattttgaattgcaagcaatataattaagacatagagatcaaaacttttaaataacatttatttatgagatggagtcttgctctgtcgcccaggctggagtgcagtggcgagatctcagctgattgtaacctccgcctccccggttcaagcaattctcctgcctcagcctctccagtagctgggattacaggcatgcaccaccacgtccagctgattttttttatttatattttttagtagagacaggatttcaccatattgcccaggctggtcttgaacgcctgatgtcaggtgatccacctgcctcggcctcccaaagtgctgagattacaggtgtgagccactgtgcctggccaatttttaaataacttttaaattgtaaaagcaatgcaggctccttgtataaaatttcaggaagtatatatatatatatatatatatatatatatatatatatatatatatatatatatgtatatgtttaaattagtcatattctataccaaaagataatttacaacatttaagcctttttttcttatataggtatataggttatttgtacacgtatataaaatttattgctttggactgaaggatacttgtgatcacattatataatacatttagctttgaatcctgtgtttgtagcttaacagatcagccaggcatggtggctcatgcttgtaatcccagcactttgggaggccgaggcaggtggatcacctgaggtcaggagtttgagaccagcctggctaacatggtgaaaccctgtctctactaaaaatacaaaaaatagctggacgtggtgcctggcacctgtaatcccagctattcgggaggctgaggcaggagaatgcgtgaacccgggaggcggaggttgcagtgagccaagatcacgacattgcactccagcctgtgccacaagagagaaaccgtgtctcaaacaaaaacaaacagatcatggtgatttttttgggttcatacaatgttcttcataaatgtaaatttcattggttaagacagatgggagacgacagatggagtacatgtttaggaggaggagttgaccagcttggccgaagagttggatcttggagttgagggagaggtgtttagggatgactcttagacacctgggttaacaggtggggaggcctccctcacaccagggagcagtagggagacagcagattagaggctggttttcccagttaattcgccaacatttgcacatgttcgtgatgtaatttccagcccacctcctgtttcttccttccgttcttcttgtgttgatttctgtgttgacttcctggagtaacttctgatatagattgagatttttcttaaaaatgtgtttttagtacacagaggtgtcatttaaaagtgaaattcatgaaggaatattttttacctgctgggtttaatttcagatgcctgtgttatcataaaaggggaaccaccatagattctgttttaaaactttctacaaattgtatgtgttgatattaacttctgcagatggagagaggaaaagaggaaagtaagtatcttattaaagagtttttttcccagtgttatttgaatattattaatgccaaatgagttcagttcctatcctcctcccttcctttaaaagtttaaatttgtctataacttttttttttttttttttttttgtgagatggagttttgctcttgttgcccaggctggagtgcaatggcatgatctttgctcactgcaacctctgcctcccagtttcaaacgattctcctgcctcagcctcccaagtagctgggattacaggcgcccaccaccatgcccagctaattttttgtatttttagtagagaccgggtttcactatgttggctaggcgggttttgaactcctgacctcaggtgatccgcccgcctcagcctgccaaagtgctgggattacaggtgtgagccactgcacccagcccttgtctatagctttttaatgcctttctattgtacttttttctggaatgagagttaacagttatgatatatttcaccctgggaaagaaataatcataatattcaatatgaaggatttaggttaaagtaaaaggaaaaacaccctctggcaagagttcttaggatcaattgctgagggagagcagagcctgaggtgtttttgcctcttactagtagtgtataatccttggccagttaattaatctctctaggccttaattttctcatccgtacagtggggactggaaatagtgtttatctcgtaggttattttgagaattacataagcagctatatgcaaaaaaatatagaaaagtgcttgacatataagtgctacttactgctagttgccttgacttattgctgtaagtaaactgtgaaaacaaaaattgtgattttaatgttgtgatacagtcagcccttcatatctgagggttccacattcacagattcaaccaactgtgattgaaagtcttcaggaaaaaaaacggatggttgcaactgtactgaacacgtgcagacttttttgtcgttctctaaacaatacggtataactatttatgtagcattcacattgccttcggtattttttggttaagtttttaaaaaatttattattaccattttgagatggagtcttgctgtgttgcccaggctggagtgcggtggcacaatcttgctcactgtaacctccgcctcccgggttccagtgattttcctgcctcagactcccaagtagctgggattataggcacatggcaccacacccagctaattcttgtatttttagtagagacagggtttcgtcatgttggccaggctggtctcaaactcctgacctcaggtgatctgcccacctcggcctcccaaagtgctgggattacaggcatgagccacctgtaatacccggcctgcattaggtattataagtaatctagagatgattttgagtaaagtatataggaggataggtgtaggttatatgcaaatactatgcccatttgtatgagggacttgagccatctgtggattttggtatctgtggggggtcctgaaccaggccctcacagatccctagggagaacggtaactctggaaggagaattgagtaggtggatccttcaggtttaaatcacctatctggcatattgggcaatacttgtttgttggaatctgttttctacccaatcctgtgggggaaatgtgggagtagagagagatgaaaacctcattaagggtcaggtgcggtggctcacgcctgtaatccccgcactttgggaggccgaggtgggtggatcacaaggtcgagagattgagaccatcttggccaagatggtgaaaccccatctctactgaaaatacaaaaactagctggacgtggtggcgtgtgcctgtaatcccagctactcgggaggctgaggcaggagaatcccttgaacatgggaggcggaggttgcagtgagctgagatcacaccactatactctagcctggtgacagagtgagtctctgtctcaaaaaaaaaaaaaaaaaaaaaaaaaaaaaagcaaactaattaaggctgcttttctgccctccaggaaggaaggattgcccctgaaatgtacttaaaatatctttggtaagcacttcattaaaggctctctcatttgagcctcaaagcaaccctccaagataaagggtatcatcttaatttatagatgaataaggaagcttatccagagacaggggacttggtcaaggtcacagccagtcaagtgcagcatctgggcttgaacccacatctctctaactgcacagccctctttttctgcacttcctgctcctaagagattcacgggacttggtggttcttattctctgtgactggtggaatgtgtacgtagggtttgttttccatgctttagactgaacattccctagaggggactttttttcaagtcaacattctctgttcaaaaggattttgcttttttcagttttactttctagtctacaccctctagccccgtggtctttcatctgttccaaaagaattccatttagaaaatcgtgtcagattggttgcagaagcaggctcagcattgacagttgtgatcggctccattaggtgtttattattggcaactcactgaacataaactcctgaagcttgagagggtggcctttggatagaatctgattccatgtattcatttaacagacagttatcaggcacctgcagctgacaggcaatatgctaagttttaaagaatgcaaggtggatctgatggggtgggtatctgccttctggaaatgctaaggctggtggggaaaggagtcagtccaaccagaccaccttcatggcggtataagggttacccaagagggaaggatgcatttgggaatatggaaggggagaaccaagccagctgttttatagacatctgttccttgggaatctgaagctttttatagctgtgtgcagtgggtgagttccgctctgttagggaagcaccatgtgggtttatctttctttccacctatagtcagcgtgacacctatgtcaggaggtgggtagagatgaggtcttagggtccattggttttttaactcctttgtaggtttcatgattccctggtcaaataatcaggtgaaagatcatgggccatccactttgtctgcaccaacctgctccctcttccgttgacacatcacggccagtcttctgccgtggtctgaggatatgccctccccaggctgtccgtttgttcttatcccttctctgcatgttttgatggtttctgtgattctctggacctcttcttccatattgagggtggaagctatgaagatagtccctagtgagtgtgtttaggctttcagttgtgactagggtacagtcccatgcacatggaggtggtggcctctcccatctccttgccttggcatgtgctctttagtcgataccattgcctttctcagtctcctctgcccagaatgctggaactgttctgccatcctgaccacgcacagggcagtcagcacctttatctgcccttccagagtggtccatgcacatctcagcttggggttgttatagatcttttctgttggtctctttcattagactacactttttgaatccatcctctggtctagtcttttttttttttttttttttttttttttgagatagaatctcgctctgtctccctggctggagtgcagtggcgccatctcagctcactgcaacctccgcctcccaggttcaagttattctcatgcctcagcctcccatgtagctgggattgcaggcgtgccaccataccctgctaatttttgtgcttttagtacagacggggtttcaccatgttggccagctggtcttcaactcctgatctcaagttatccactcgtctcggcctcccaaaatgctgagattacaggcgtgagccactgcgcccagcctattctagtcttcttttgaaacacagcacgtggttcatacgtggtacataacaggtgctaactaaatgctcctttaagtatgttagttcaggtctcgaagttaacctatactataaattgtgcgtgtgtatgtgtgtgtgcgtgtttgtgtgtgtgtgtgagagagcgagcttacagtttttgttatttacttatttatttattgtctcagttttgaagactgcgagacggcagcatcatctcttgggatgaaaggttagcaggaagcctagatcagttgaacccctttcaggatctatgagatatttctcttccataacttacacccatctccagtgctaagaactcaggccttcctctttgctcttcctttcagagagtattatgagggaggccgaggacttcatgctccggacagagaaacggcgctgggattagggattgccacttctgagaggatgctgggaatctgcagggggagacggaaattcttggctgcctcgttgagtcttctctgcatcccagccatcacctggatttacctgttttctgggagcttcgaaggtaagaatggaagccaaagtgagagggaaggagggaagaaagggaacattagctgtcatagaaccctagaaaagaaactcaaagccatctaataggaatatgtatttccagtcatgggaagtgacttgtctagaatcacacaggtagttggcagcagtcaacagtgtgaggagaaaaagggaaaaacaagcaaaataaggcataccttgatgtagtgggagtgtggtgggtacagaaatgtcaaatcaagtcaattactttgtcgataatgggagaaaaggttgggccctggagaaattactgagctattcatggagccatatgtttcaagagttggtccatcttttcattcatttattcacccattcaacatcgtggtggtggtggtggtggtggtggtgttttttgtttgtttgtctggtttttttgttttgttttggtttggtttttttgagacggagtctcgctctgttaccaggctggagtgcagtggcgcgattgtggctcactgcaacccctgcctcccgagttcaagtgattctcctgcctcaacctcccaagtagctaggactacaggtgcccgccaccacactcagctaattcttctatttttcgtagagatggggtttcaccatgttggccaggatggtctccatctcttgaccttgtgatctgcccaccttggcctccaaaagtgctgggattacaagtgtgagccactgcgcctggctgtgttgttgttattattggatgcctgcactaaacttggtgctgagaatatggagataacagatctggagattcacaggatagcggaggagacagataggctaagaaatgatcgcggcacgttgcgatgcgcgttgtgatggaggaaggcagggtgctgtgggagaggtttgttggagctgtcagacctgggctggggatgaaagatgatcagttacatgaggggccgagcgcagggaggcaacaaaggatttgctctccccaaacaaataaaaacaaatgatgatccctgctactttccagaaatcagtgggaacagcaagactcaccatttttctagccagccgtttcaaatacagtgcaatgttttgcctgtgaagatggttttctaggcttcagagagagagggaacggcagtggtgaagagctgactttatttttatttacccccacacttgaatttcagaaggaagatctcaaatgaaaatctgtctcaaggaagtcacaactgtgtttttaaacgtttcctttatgcataattttattggcagctcaaggctaccttttaattaggatctccacttcactttctgagatttgccttgagttagctagactgaatataaacaaggtgaaactgtgtgcctgtctagcagggagggctcaggatgctcagcccagtgccgaggccaagtgacacacccctgtccctgttcccaccctttaggtgcatccctggaacagtcagaaccttcatctaagcaggtagatagagccaattatgccatggcagtggatgggaagtttttggaaaagggactagagagaggaaggggaggtgatgttggtcttgatgtaaggaaacattctcccagagatcatggaaaagccctttttataaaagaagttagaggtaccacccgtgctagtataggtttaataagtagaacattgacttttaactaagctggtaataataataatggtataacaaggacagtgatgacagacactgtgattctgtcatcacagtgatgacgacagtacaaacaactagtattttgagtatttctacaggccaggtattgttataaggacttctacatatgtttactctttcttcacaatgattctttgtgccaggtgcgtttaatacacctgttttacagatgggggggatgaggcagataagcttcagtgatctgcccatggtcccagaggtggtcaagatggagcctggattggactcaagagcttgagttgttaactgtaataccatgctatagattggggcctcaatgagtgattgaactttggtcagggatttgacagggtgtcacacaatctgggtgaggaaagttgtagaattttgatttgcactctttggcagaaagccaacccaaattgatttttggtgaaaagggaatttgatagttaataggatttgtaagttcagaggtagggcaggcttcaggcagagttggatccaggggcttgtagctaggtctccctctatccctttgttctatttttctctgccttggtttttctcagggtgactttatctacatagaggaagtttcaggcttgcatcctgtcctcaccaaccccagtagaaagaggattttttccttttgctaattcactaatattgcctctgattgaattgcctgtggtaactcctcctgaaaccagtcactgcggttatgggaggggagtgagggaggctggtacttttttgttaactttaagccctgtgcctatttctggtcacaggatgatggagagttgcttaaaacacgctgggtgagattgggtgactgggatggccaccaaaggcaaatggcatggtttcccaaaaggaagagattagaagttgatctggattatggagaattcataactgtctgtgtttatggttagatgtgttgatggtcaatttgaaggcagcttagaaccatcgtggccggtggagtgaatgtgatcactaactttgagcaatttcaccagactggcagatagattatgggaaactggaaagatcatgaaaatactttgaggcaacatgacagactgggtgtaggtgctgtatctatcaacatgatcctttagaatgaaccccacacttgggaccaaatcacgagctgcatttagtaggggctgggtgatgtgggcatgttaacacagtattttagctaggatgacagaggcaacagatttctgttactgagtgtcagttagtgtgcattcgggctgccgcatttgtatttgtggactctatgctgtaaggacaatctagatgaggcagcatgcttaggaaaatccaggtgagtgacagtgcccgttcaaatctggttatgtaagaaatggtgggaagaattgaggatgtttaccttggagaagcagaggctcagggtgtacatgctcagcttcagcaaacagacaaagggctgtcccctgaaagaaagattgggattgctctggtggccccaaacctatggagggacgtggcaaggagccagatgtcaagctcctcataatgaggatcatgctgaccagagctggaatgagctgcccaggaggtggtgaaatacctggcatgaaagatgcagaaacacaagtccagtatcgtgggagggagctgagcgagacaggcagttacgcaaggtgacccatctgaccctgcctgacccagagatcctgaggctctgggaaagtctgagtatttatcagaacacaaaggcaatgcctccatgaagctccctgctggttgctacagacaacagtgcatttcccaaagggcccgcagagacgttattttctttgtaattaaacatcacaacaacgttacaatccatttattgacacccttgagtttttggtttcgtggcaggtgaagccataaataaggggcagagttgctgcctgtattcatggaaatactattcatactttatgtgggtttatttattttttgactctgtttaatatcaatggacctcctgagagcagagccaagaactccctctgagatgtggctgctctcagcatagggttttggagttggattacacgccgcagcatgatatattgagagagccctggagggggtcagctgtctcaggatctcaaatcacctcagccagaggagctggatgatctggggcacacttgctcttcatggtaggccttcgtttcttccgacgtgaaatgaagttgtcgagtgcacttagcagggtgccgacattctacctacaagcttctgattctaacgtctgatgtaagtgaactgaaaatgaccagaatcttccccgattaaggggaattatgacactaagagggagtcggcttaggcttactgtgatttgctcctgagcatggaagcaggatcaatgcataaatgttatggggaggcaggcattgtctccctgtaagaaagaacacctgtttcagcgactcagttgtcaggcatggagttcaccatctgggaaagagatgagattcccattccttgagacaccttttgaaggcccagtgacctctggtgaaggacgctcatcaggtggtgtttttgttagtgcgttaaccccttagttcttaaacccaactccttgctttatttctttcccagtccacctttctttctctaacatctcagtcagcattcccagctctacgccgttcaggccctaaacttgggagtaatccttgtctcccttcattcactccgtgtctcggttgccacctcctgttgagtctaagctcggccttgtagctgcgtcagttgtttcccatctttcaccactgctgtcgccctggctctgccactcctcctttgtgatcaggactaagcacaacagcccactttcttgcaggtctgcttcgttcttcagactcctcagggctgaatcagagcaccgctctgctccttgtcagcccctctggcccatcccctaatccccaccatactgcctcgcattatctggcatcctctacccagccacgccagattcttttaagtcctggtgtacatcgccctctgtgggctctgctcttcccacctgttctttcttctccctgacaccctctattgctcttacttccttcctcttctttgtctggctgcctagatccttgggtctcagctgaaacacaattaattgctcctgacccttaactagcaggcttccttggctccctatttacctaactccttgtatgtacccttaatactcagggctctttatttttcttgtttttataatcttttgttttcacagcagatttacaagctttgggaatggagaaagcgggtctctttagctcgcccttccacctctagcacctactgtagtgccgggagaagatttggtccccaaatgtttgttcaatgaatgagtgaacgaacacatgtgccctcctccgactttgagtactgacaggtctcatcattgcctcctggatccactgtggactccttaccatgactctggggtcttccacaattgttttttccccaacctatactgtctgtcttcagggtataataccctgttgaactacctgaggaaactatttctctgattcttaattttcactcttgcggtcttactgcccactattcagttcttttttctgtaaccctccctcccagccaacaccttcaatgcccatattcaatgtcattttcccctaatgccagatcccatgtggaaacatctatgaccagcagtcatcaagagatattttgcttgtttgatgtctttctaaccacttacctatgagtttcttgagagaaggaagtgttttattcgtcgttacactcccagtgtctaactgagcactcgctcctaatgtgtccttagtgaatgttccctgggtaggactgtggtattgagggacacaggaaccgctggtagggaagggctcttggtgctgtgagcatctgtgatttttgagacctgaggacgtggctcctttcatttggtcgtgatgttaattccgggactggagtgaatctgctcaactatagccccatttgaatttagagcatacctgttattttctatcagaatcaccttttctcagagcccagtgggttttattgtgggatgtggttcttcttttctgtccatcaaggagatgtgttcggctattagagacttatcagcatgtggaaaaagggtgcttttcagccgttcagaaaactcttcacacatgctgccctctgataattcataaccagctcggtgcaaaggtttcccattgtcagggaggcagtccgggacaatgtgggtgttatttaaaagcaaatgtcttcagaggatgtgaagtcctgaacacttaaaaccagtgtcatgaaaaggcagaggatcttcacttctgaactgatatcagcctgcacccctgttttgtcattcctaaagcctgagttccctgttgcttccatttttatcaacatgaaccccctctgaaatgaatgtttttgagtgttgtcacagtaaatttcaacagaaaaaaatacggttccgatactgggctattttgaagactggcagtgagagtgaaagaattgtaagttaaagctttttctttgccttattattatgggggaatcccagggcacttgtgtggtggaataggcgggatgggggtggtgcattttatccaaggagggtttgtccagacatgactgattccccagccctgtgtctgctcccccatccctcagcccctcatcccagagagtgtgctggaaggtctgggaagtcagattgtacatggtattggtgaataatctgctggagctttcagtatcccccaagtctaggctatgcagcagctttagcaggaaagcctatttttgctgtcctgccagtggtccaaatgtatcatttagtaaggatattatggagtataagaacataggatgccgaatgcaaaatgaaatgggacttataatacaaaagttgtgtttttaaaaaattggatcaaaaatgaagagctggccgggcacggtggctcacgcctgtaatcccagcactttgggaggctgaggcgggcagatcacaaggtcaggagatcgaaaccatcctggcgaatacggtgaaaccccgtctctactaaaaatacaaaaaaattagccgggcgtggtggtgggcgcctgtagtcccagctacttgggaggctggggcaggtgaatggcatgaacctggggggcggagcttgcagtgagccgagatggcgccctgcactccagcctgcgtgacagagcaagactccgtctcaaaaaaaaaaaaaagaactttttcagccaatgtttaataagtgttagtgctgagcttgagcaaaatcttgcaacaaatgaaaatgtgagcatgcaagtgggctgctctgaatagtgcccaggtgacacatgcatcccaaagaatgcccagtgcatgtgtctgtagttcttaccttgggactgttaagagtctctttaaggtcttggcatctgagagggcagtaaagtctatcccaattatttgcttgtgagatggttacaaagatgacctctactttccttttacttttttttaagatggagtcttgctctattgcccaggatggagtgcagtggcgcaatctcagctcattgcaacctccgcctcccaggttcaagcaattctcctgtctcagcctcctgagtagctgggattacaggtgcccacccccatgcccagttattttttttgtttttttagtaaagatagggtttcaccatgttggccaggctggtcttgaactcctgacctcaggtgacccgcccaccttggcctcccaaagtactgggattacaggtatgagccactgcacctgacctgacctctacttttcttatacgtagcctttggtcttaaaataatattggctatcctgctagggtggaacaaataatcctgctgcatccattggctgcatctcctttaagaggtcatggcaagaggcctggaccaggaatcaagaaatgtggttgccgtgagtcccaacatgcaacttgtatgagtttcctgtggctgctgtaacaaaccaccacaaacttagtggcttaaaaaaaaaccatacatttattatcttacagttccagaggtcagaagctcaaaatcattctcactgggctaaagtcaaggtgttggcaaggctggttccttctgtaggctccagtaaagaatccatctcctggtctttttaagcttcttgaggctgcccgctttccttggcttgtgacgccttcctccatccccaaggccagcagtgtggcatcttcaaatctttctctctgatgctaacctctacttctgttgttatatctccttctctgactgtgactctcctacccccctcttattaggactattattattattattactatttttttgtgatggagtcttgctctatcaccaggctagagtgcagtggtgtgatctcagttcactgcaacctccgactccctggttcaagtgattctcctgcctcagcctcctgagtagctgggattacaggcacgtgccaccacgcccaggtaatttttgtattttttgtaaagacaggttttcatcatgttggccaggatggtctcaatctcctgacctcgtgatccacccgccttggcctcccaaagtactgggattacaggcgtgagctgccccacctggccagacccttgtaattatattgagcctacccagaaaatccaagataacaaccctgtctgaaaatccttaatttaatggtactggcgaagccctgttggccatggaagatgacatattcattggccatggggattaggatgtggacatcttttggggggtcatttttccgccttccataccactttcccacagtcccatgctcccacattctctccatcctcttcttgtcctttatggacagagcagagatggtgtgccatgcacttttcatatggacatctcatccttcccttggagttttgggttcttgcatttgaatttgacatatatgtatccaacatttcatttacagctcatgagaaaggcactgtatttagatgtattggtctgaattgtctgaatgatttaagaccataatacttcatctatgataggtgtttaatcagtaactgatgatgcgttaaggttttctgaaaagataagttcagaatgtctgctctttgttgcaggtttcctggttttaagtcaattttattttattttttgattttggataccaatttaacaaaaggagggaggattttattcagagggtccttttgatgtttgaataggtctcttaattttaagtaaaagatagccatttatataactactttggaaaacttacccaaagtattaccaagcaaagccaagcataccccatgatcccttagctctacccctagcaatacacccaagagaaatgcatgtaggtggaaacaaaagactagtactagagtgctcacatcagcgttatttataatagcaccagacaggaaactatgaaatgttcatgaacactaaaatgagaatagtggggctgggtgtggtggctcacgcctgtaatcccagcactttgggaggccaaggcaggcagattacttgaggccaggagctcaagaccagcctggccaatgtggcgaacccccatctctactaaaaatacaaaatagctgggcttggtagtaattaggtagtaattagcatgcttgtagccccacctactagggaggctgaggtaggaggatcgcttgaaccctggaggcgaatgttccagtgagccaagatcatgccactgcactccagactgggcaacagagcaagactctgtcttaaaaaaaaaaaaagaatagtggcacgtttatatagtgaagtactatagagtgatgaaaatgaaattactctcagtattgagcaaaagaagacatacacaaaataatacatactataggattccaattataccaagttcaaaaacaggcaaaaattaatgtaggctcttaccaattcagatggtggttaactctggtagggagggtagaacagagactggggcaggccccaaggaagactttgggatgctgctaataatttaattttaatttttgtttgtttgtttttgtttttttttttttgagatggagtctcaatctgtctcccaggctggagcgcagtggcacaatctttgctcactgaaacctctgctccatccccaggttcaagcgattctcctgcctcagcctcccaagtagctgggattacaggcgtgtgccaccacacccagctaatttttgtatttttagtagagatggggtttcgccatgttggccaggctggtctcgaactcctgacctcaggtgatctgccctcctcggcctcccaaagtgccaggattacaggtgtgagccaccacgcccagccttaattttaattttaacctgtgtgatgactatatagctgggctcactttatgataattcactaagtatttcacttaggacttgttcatttttctgaatatgttattttagttttcaaaaaactatgcaaatcttgatggtagcagaatttgaagtgattttgtaggttttgcattgtttttagatgagaggaattttcttaacctttgggatatgtgaatctatgtcattgttgggctttgaagttcaaatgctttttaagaatgaaacttttctttagagatcattgtttaacacttctatgtaatgacattggcttttttcctttctgatataccatttggacagatattcaccctatgagagtggatcacagcactgatttcaagatctgaaatttactcataaaaaccctaatctgtatgagtgttttcatcagttggaaacaagaccagtattcttaccagctcttgcaatgacacggctctaattaatactaaaacaatattactgcttgatattgaccccaagccacattagataatattctcctttgtgttattcaacaaacatgcattttcataaaatccttattcctggaaatggaaaaaaaaaaaaccttttattattgtattgtggaagatatagaaacacaagaaggaaatgtactatttaaactataacaataatggaaactgtagcaatcgtttctatttatcgcatgttaaaccaagattggctgcatctggcttgcacttgtgttgggtttggcccgcctactgcttttaccatttttgaatttgttgctaatggttaaatattgggagattgcacataagaagtcatgatttttggctttccctaaaaaaagtgaaaagatctgcaaaaccagaccctcatttcatcatagtagctactggctggagctgagtactggctgtccatgtgcacagtgctcggatgatccattttgtcacgatctccatccttccttgttgatccttgtgtcatccctgcactgtcgtttacatagaacagaattgagagggaagagcttctggtatctgcgtatggcagtggttgactctgtctggctcatttagactttgagtttccaccttttggcctggtgctgggctaggaattttacacatattatctcatttattcccccaaacaacttcatccttgtcccattttatagatgaggaaactaaggctcagggacgttgtaccgtttgagcaaggccaccaagatagcaagggagcctgtccttgtctaaaaaggtcctttattctgcagtcactgaagaacttgcagatatagaaacaactggtagatgacatttcaaagtcgatatgctcaagctttagacaaggacgagacaaaccctgagacaagtgaaaatggggtatcttggacaacagagaagacatgcgaacttctgtggctagcaggattcttataagccagtataacgaaaaaattcagttaatcctttaatgcagtttgcattttgtttctgtcatagactcatataatcaagagaaggaacggacatcaggagtcatctaggctggcttacagcctaaacagataaaacttttgaaaattacagaaggactttttatagggcaaatgttgatggttgggggaacatagcccccaaggacaagtggatgggagtttgaattttagtagacatcatttaaatcacagagtgaaatagacaagttactcaacatcattgcaggtcagtttcttctccataaaaaggagagcacagggctgggcgctgtggctcacagctgtaatcctagcactttgggaggctgaggagggcgggtacctgaggtcgggagttcgagaccagcctgaccaacatggagaaaccccatctctactgaaaatacaaaattatccaggcgtggtggcacatgcctgtaatcccagctactctggagggtgagacaggagaatcgcttgaacccaggaggcggaggttgcggtgagccgagattgtgccattgcactccagcctgggcaacaagagcgaaactccatctcaaaaaaaagaggagagcacaacctgtagcttacaccgctgttataaagactaaatgacctgttacatccgacagtggtcatttaacaaatctttgtttttcctttcattctcatatttttctagaatcctggaaagtctcctgggagggatgcaaaaacgtcacccacctggtccagagagacccttgttttacaactgaggaactgaaacctagagaactgtgatataacgaagctcacagcctcagcagccttcttcaggcattagaaaggggcagggagagacttcctaacatactgcagctgtggtcataaatgcactggcacttccttgtgaatgcattggccatgtttggagaaaattaaattatttcatcaaaatgacctgtagtgagaactttaaagaacaaagaggaaagggccatcctctgatgcagagtttaatcactttcctaacagatatgttggatggggctgtctaagtcccagtcctccttttaaatgctgtgtgtccacattgagtcacttaacctctcttaccgcaaattgactctgcgtaaattgggggtgctgttgagggtttttgcaagatgaaaacgagtccatggtgcctagcatgaattaggtttgcagagtcattttgtctcagcagctgctttggatatgttgactgtacttctggaagcaacaggtcgctcaaggagtcaacagagttgaatatttaaagctacgggatgggaggtggaagtggagatgggtgcatcacgaggtctggagattgagaccatcctggccaacatggtgaaaccccgtctctactaaaatacaaaaaattaggcaggcgtgatggcgggcacctgtaatcccagctactcgggaggctgaggcaggggaatcgcttgaacccgggaggtggagattgcagtgagccgagatcatgccactgcacctcagcctggcgacagactgagactctgtctaaaaaaaaaaaaaaaacaaacctgcattgataggaagaaccctggccatgccaagattccttctttctggggtggagccttagataatggatagttggcttttttttttttttttttttttttttttgctccagcagagggcacacagtgccccatttctggcacacagccagtgatggatgcttgaggtggtgtcccagctgggaaccctctccattgcacctgttgataacaattatgattcatttgcttggccctcttggacatgagctttcttgatacagtgaaataatccccccataacctaattagggaagaagggtttaccatttcagatgaggtcactgagcgccagtgccattgggtggatcaccaaggttattcattcattccgcacacacagtcaggcactgtctagggcactgggcatagagccctgagccacatgggcaagtcccctcttctcatggagcttagttttcctagtggatggagagagatgatgatcgaacaacatcatgctctgctgagtgttgataagtgcaacaaagaaaaataaagcaaagtgagatgatagtgccagggcaatgggcttggtgaggagtggggaaagggaaatgctgtgttaatagggtgatctgggcaggcctctcttactggtgacattaagcagagccaggtggtgaggggaaggaaaagagtttcaggcagggagaagagcaagagatggagagtgcttggtgcttttgtaggatgccaaggaggagtctgggtggctggagagaaagagaagagaggagaagcaacatggtggatgaggtcaggaggagaagcaacatggtggatgaggtcaggaagggtaggcagggacctgtcacacaggcctgcaaagtggatcttggcaccttggcctctggcttctcattccttgctctcctctcctcgggaagcttagtcctttcaatctggacttgcctttagctgctaatcaaagttcagaggaacctgagagagtatttcctcttcttgcctataaggaggtcacctagatctctggttccagcatttgctagatgataagaatcacctggggcatttgtttaatatatagacttccagtccaccccggggcacttaatgaacaagacagcccagaatcctgccctagatctactaaatggggttcctcaggggaggtgcccaggtgtctgtattttgaacaagtgcctctcttctggcccacttgagaagtttgacctggattaagtgcagcctctgggttcctggtctcagcgccccctcctcctctcctgggctccaggacttggatttaataataaccagcatggtaacaacatcgctgatggagtgcctactgtttgtcttgcacaacagcctcactccctattttatctcctctgacttaaatcttagttttcacaccaagtgcctggcaaatatattgtttgtacttctgttaatcatttattatgttgaattgcacttcatttatatagcatacttcctttttagaactttcctgtggactctaataacattgcctacaaaagtgcccagcacaaagtgccagtgccattgggtggatcaccaaggttattcattcattccgctggccaagtcattgttattattatttgtttggatttcacacactccagatagtgaggactcacctttccgtagtcatctccgaatccttagtctttggcaaaatacctgaaatagagtagatgctcaatgaatcttgaagtgccagaaataaaaataatattagttactatttatggagcatttattgtacatcaggcaccaagtccttgacttgtagtaactagtttcttcctcagaactgtcctatgaagtaggtgctaatattcttattttgttttgagacggagtcttgctctgtcgcccaggctgcagtgcagtggtgtgatctctgctcactgcaagctctgcctcccgggttcacgccattctcctacctcagcctcccgagtagctgggactacaggcgcatgccaccatacccgactaattttcgtgctgatattcttattgtgcagatgggggaacagaggcacagagaagtttgaaaataggtaaagctgagattgaacccaggcaggcatgccttgtgtgatctctctaaggtttctttcatttcttaaatgggtatgattctagatctcttttttttctatgtaaggtcgctccctcctggttagttctccacagggatcaggtagagttggtcctctccctatgtgtgaataatgcctcacagatcctaggaaatgtactaggtcggaacttccacccaggctcagtgggctcggttgtgtcttttatcacttttcaagccatgcattttctttgcctcctgggatcctgtgccagttgccttggcttctgtggctgatggatgattggatccagcctttcagggcagattagggtcagcctgctccaagcagtagcgagaaccgggccctcgcctttcctttcctagaagctgtatctgtgagttaacgcttctcaaaatgctgcacttagctcacttgagcgcagtttgggggcagattggttcttggactcttcaaatccccagtgcagacatgaacataagccttctgggtgctcagattgtcagggcacacacacgcactggttctgagccagcactgaaggagacaggtctgacagagacgagcacctcacccacggcttaatttcatgttttggataaacactcagaggtgagtggcatgaaggggcggataagcaaagatcaccaagagtgagtatttacaaaattttttcattttgctctcaccagtcttcttcctaatagctcttgctgctctgatggctctctgacaaatagaaaggaggctgttttccctctggtccacacctttgctccaaacagtccctgtattgcattccagatgcttcagtgacaggtagtcatcagaaagagacccttggattgcatattttcttggcttcttcgcttgttctgttccctgggtgaaatccctcggctccttcaggctttgaggcaattccttccctcggtccttagtgtgggataatagaaattaacacttggtggggctttgccgtgtgtgctgctctaaagcacttgcatttatgttcatgacacatcacccagggaggcactagcatcaccctccttttagagggaaaggcaggtgcaggatgttgagaaacttgccctaggtcccaacctgtgagtggcagagccacttgtgtggcctggagcccacgttctcacccaccatatatacagtgcatcttgctgcctgtctttcctccttctcctccctcctttctatgacaatcatttggctgtaggtagttcctcctctgtgctgagcactgtaccagtcagtaggaaacagggacaatgaggtgttttccagggcgtgagcgtggcagagccatccagaagtccaagtgtgtccccggtgcaatgagaacacagtacataaaacctaatagggccctgtagggccagaggtcaggagagggcatcacggcagcaggcatgctctgaggacccatgggaaagcacgttgtcatttaggaagacacagaggagccacatagcctgggcaagaggaagactagcagctcccaggtacgccaggcatccccattccattcccatcacagaggagcatccacctcctgggagtggggatagtaggactggagcggacaggggctttgcagtcagaacactcagggtttgaaacctgtctgttccacttaccagctgggtgaccgtgggcttgtctcttgccttctcatgtgtaagtggaaacaacaataccgtcctcacagatgtatttgaaagtctaaagaatgatgagttttgcaggcaactgacacatattaagttctcagcaaattgcagatacttgttttattcctttcgtttttgaggagatcatgtattgataaacttcagatctgtgattgcaaataaaatagagtattaaaaaaatctgttgcggcacatagttgttgctcagtaaatataaagcaaaggcataatttgcacgcacttggactggattcacagccagcggggcatgatggaaaaagcacaaaatgagaactgagagtggctgagtggattgctcagggtcactcagctggtatgtgaaagagctcactttctcattgaatctccacaacagccttgtgagtcaagctgggctaacgttatctgtctcttagagaaaattaaaacccagggaaggtgaatgtcttgtgcaagtcaaattactggattgtagaataatgaacttcatcactaaatagccatgtgacaagtcgaggactccctttcatcatctgtaaaatgggggtggtgatatctgccctgactacctcaaagagttgtggtggaggtcagatcgaagagcaataataagcctggcttctatatagagaatgatctatggtggacaggaatttaggccagatcaccggctgggtagccaacatacttttacagagaagcagtgaggtgacctgaacttagatggtggtagtggcaatggagatgaggcagaagtggctgcctggggataggttttggaggtagaggttttaggccttggtgatgtttgggttgtgaaggagagagaaagaaagagtcagtgatgactccaggttttgacctgagcaaatggatactggcagagaggtcggtgggaagagctgtgtgggacgagtgatccatggctggttcaggacatattgatagctgatcaaagatctgacagtgaacttccaacacgctcctacctgggtatattaagccattcttgcgttgctacaaggaaatacctaaggctgggtaatttataaagaaaagaggcttatttgactcacggttgtgtaggctatacaggcatggcaccggcatctgcttggcttctggggaggcctcagggtgcttacaatcagggcgaaaggcaaagtgggagcaggtgtgtcacatgaccagaggagaagcaggagagagaatacggggaggtgccatacgctttttaaacaaccatatctcacaaggatcgcaccaagagaatggtgctaaaccattcatgagaaatctgcccccatgatccaagaccctcccaccaggctccactgctaacattggagattagatttcaacatgagatttggaggggacaaagatacagactttatcactgggtgttggaactcttgaaccagtgacatccaatagtgaggtgagctagaagccagtgtcaaccatctttactaggaaaattaaaaaaagacattatttggaaagaaagatagggatgcctttttaaaatttccagtggaaaaaagacattgtacttttgtttttattataaagaaaaatctggttgaagtaaagctgaagcatctgcgtggttttattaggcagtgctctcgccatgtggtagggtagaaagtgcaggggttcttgcaccagaagacctgggccctgaatctgatgctgcgacttgctggctacatggccttggaggggtcccctgacctttctgaacctcagaccaagtgggctcctagtccttgctttaggggctggtatgccaagtaagggaactcatactacatgacagttccttgcacacattgtgctcggtgcacgaaggttgatgagtgagtgatcgcctcctttatgagaacaggatagaaaagaacagctacatcatcacatgaagagtagtcactgatgcttgtggagcacttgctatatgctaggtgctgttctctgtgatttacttggattaactcattccatcctcacaaccaccctatgaggctggtcctattatccctgcttacaggcgaggaaactgaagtatacagaggttcaatgactttcccaaagtcactcccctgggaagtagagttggggggactccagggctcaccgtcttgtctccagggaccatgattttgcttaccaggctgtattgtctcagcctgtaaagaggaacccttgttagccccatcttacatatgagcaaactgaggccccaaatggttaaatgaactgcagaaacacagccggttggtgacaactggtacgttctcatttgtgagtggttaaaagtggggtatctgaagctggttctgctgggaccctcagccaaggagcagttctttgcccgaacagaggctccatccatctggagggtgggcatggaacccactcacgttctcttgcacacccctcctggctctgggctttggaaaggttggatttcttgcaaggtgattgcaggacagagctctttcttcccgctgccattccaggcgcttggcctgtgctttctcagtgtctctgtttctgtgcagtcgctttcacggggtcctcacctcatcctgcctgtggcatcgtgagaaattatggtcatgggtatttgcaggctgtgttggtgctgccagaagcctgctcttctcgcaactccaagcccagcggtgttgggtgcagttgttggctccgcatttctgcacttggctgcagcacacttgggtgtgtaggagagtctcagctccctccaccagaaatgtttgcaactaatccaggtgactaatatttgatgcttcagttgttggtctttctatagatatttatattgctatcaacctgtgccttgaaggttaaaactggcttttgggcctctttaaaccatctcctgtgctttgcacttagtgggagtgcattcagtagttgaggtggtgttcctatttctgacacttaatttgcatttttaacctacccaagggagcttgttattgcatgatgtatcaggtgagctattgtcaagactgtaatctaattaaatgctggggtccagaagcctcagtgcttataatgttgcagcgtttattccacacgtgtggccttcgtgctcagagtgctgcttatcatccacacagcagacatattttgacaaaggcttgccttcttttatgaatcccaaactagtagccttcacatttgcaattttccttctatttaatgaagtggttccagatcattctgtgacaatcgaaggtaaacattgctctgcacaaggcctactcttctgggattcttccatgcctctttcacatttctcaaactctcaggcccaaatgtcagatggtgtgggatttggagagtcgggaatcctgagcatatttgagttgaaaattcacacagagcttgagtgagtgaggatggcggtggcgggggagggcatgaactgtttttgcttttatttaatggcgcacctttgagaatgatcttgtggcttttgagcaggttgcaggacttcaaggtctccatagtggtttggtttgcacctttctttttggatgtggaggtttcccctaggtggccagctgattttttggtgcctccatttatgccctaaccccttctttttctcttagatcattgcataccgagcacatatttattaagtaccaagtgtacgtctgatactggactagagtccgagaaagacactaagattaagacatagtttctgtcctgatgaaaattgttcttttgttagtcttaggtgataatgacccttttctgaagataataggtcctcggaggaaaccaggagatgagatgatggaaacactgattaatgagtaaaaagggaaattatagaaaggtgggaagcaagaatttaaggctgagagcaatcttcttttgcagggaaggactcactattgccatttagcatacttgctataatagaagtatgtatgccggtgttcaggaatccagaaaaaggggcacctaagtatctggggacatccaagaaagctttcatggaagaagatgcctcctgggctgaatcttgaagcatgactaggaataggccaaggagaggagtcagaagaccacgcttgagtcctgccattgttgggctctccaggaagcgatggtcaaggtctgtgtgctgagatcgtatgccagatgtggtgttagggatcggcatgtttaacccaatcagtcagatgatcccagtaggaaaagcaacacagcaagtctgaaacactgtatcataccacacagtgcctcagctctcaaatttctctattggcttttgagccctgcagaaaatcagctgtgtctttctacattcagggggtccttctccgcttctgtactcataccttgaggtgctctcatctcatcccccgcctccttccatgccctcatctttggctctcagtgattctgtattaatagcagcgattaaactgcctcatctcatcagggaggagatattaatcttcatcaggcccaaggaagagcttaattttttcctgctcttctcctctccccaggctgccccactgagctcaggcactgtcagctgcaccactgtctgtgggacatttagtgatctgcttctgcagatgcgtttcagtgagttcacttctctgactccctcccttagcctccctgcacccagagcttcacaggctgttattgaagaccactgtcaggagagggagagaaggggaaaaatactccctcaaatagaaattcccaacttcattgtcttgcgtggctgcagggtaaattagaccaggacagtaccgcagctgaaagctgtaggttttttggtttatgaaatcctattcagcccttggagaagtatgccttttttcatgctatgattctgcagttagctgtgaactgaggatgtcagatgcccaggggcaggaacaggagacagggaggctcgagagttcatcaagaaattaggatggaaaagagctattcccaaagccaggcatcccaggctggtcctgccggtgtgcaccaacagccagtgataactcagcgcccatcaagtttctacacgtgcccagtgagcccagggctggcacggtaaaggacacatggtatctcttttaatcttgacaaacttgcgaggcatgtactgttattccatttttccaataaggaaactaaggcctgagagagtaagtacgtacgctgaggttacacggcttgcaaattttgtctttgctttcttcactcttcctgtcatactctgcccactgtatctaggatgactgtataatgtcttgtccaaactggaacactgttaagaatgcgggggggatagggacatacatggggacatacagtttccagtccatggaaactgggaagcatggtctctctttttttttttttttttgagacggagtctcgctctgtcacccaggctggagcgcagtggcgtgatcttggcttactgcaagctccgcctcctaggttcacaccactctctggcctcagcctcccaagtagctgggactacaggctcctgccactgcacctggctaattttttatttttagtagagacggggtttcaccgtggtctccatctcctgacctcgtgatccacctgcctcggcctccgaaagtgctgggattacaggcgtgagccaccgcgcccggccctggcatggtctcttacgactgcccaaccaggaggctgagggatgcttcgtgctcctttggaagcagagctagccagatggacactattcccccttcctcatttccctgccctcctctcctcccatctgagccatctgaggcccctgagtgccctgctggctttccaaatgcctgatgctagagagcctgattagtttgctttcacaatgaagaatctcaaataaccactgccccttcgcccagcaagcagccttcatatccagaccacctcctaggatctatttaactccctctactctgtgggattggcctttgttcagcctttgagcacacctgggttggggaaatggttatttttcccagaatgggctttatttgcattccacgagcaatcttcttactcggagggattcctgggacattaaattagcagaaaatgacattagcgctaagaaccaaattcgattacctgaaatacatgtattattgtaagaaataaaacaacgtcatctccacctccacacccccagatcataccctcacactgaattgtattaatgccagtttccttttagttgctggctttgtgtgtgtgtgtggcaggttgtctcaaaggcacagagtgtataataatagtacatgtcagcacaaggcaagcttgtgcagagtttttccccatgtaatttgccggctcttgtggctgtggtgtgtgaatgtgagttctggcagaggcttgtacactctgcctttacccagccccatctccctagaatccagccacatcactactcactttttcttcaacttgacagttatttttaatgccttcattgttgtcccactctttgctttttctccaggaaagattctacggtgaaagctccacccacttcccccgtacttgaatccttgggagacttttcactctttgctcctggaggcctctgcttattcctctgttagcgctgatctttaggtagagtgctttgcacacggttggtgtgtgatatgtcctggaaaatggaacagtgatatcactacctcataacgctgttatggacttaagtaatgcacctaaagcacaaaaatagagccaggtgtgtagtaattaatattagcagttaacgcttgttatgactaaatgttgggaaagtgttaaaatgccaggacttagcgtgtgttacttccacaaaactgacagctctgggagggcaggggtgtgtcgtcttattcaattttgcatccccaaagccaaagccagagtacctggtaaatgctcagtgagttcagctgagtgaatgagacaaaagcccatgtggggaagggaggctttgaagaagacattctattccctgtatacctggggtaggtttcgagggtggaatgtagggcctgagattcatcagaaacagttatgggacaaataagaagcaaatgacgcagggtcatttcaggctgctgcacatctgaatctgactgtttacgtgggggtgccacagtcttctgtgaagagaggggaggatcccttctgacctacacagcatccaggtcttcgtgcatgtcagggaggtttgacctgtacatcttttgtgggaagccagagtcatttgttgacattgaggcagagaacttgctctgagtccatcgatgcctgaaactccttttgtgaccatggcaagttatttatctcctttctagaatctaaaatatggtggcttgggatcgggggagttaaaacacattttttatggattgctatcctctaaaaagagtaaaaatgaaaataaagtaaatcaaccaaaagatcagagctaaagctgtgagattcttagaaggaaacataagagtaaatctttgtgactttagattaggcaacggtttctgagatatgacactagaagcacaaccaacaaaagaaaaaaatagataaattgagcttcatcaaattaaaatcttttgtgtttcagagggttccttcaagaaaattaaaagacacaaaataggagaaaatatttgcagtcatttatctgataagggacttatgtacagaatagatgaataactcttataacttaacaatgaaaagacaaataagccaattaaaaaattgagtgatggatttgaatagatatttctccaaagaagatacacaggttgtcaaaaagcacatgaaaaaatgctcagcatcattagttattggggaaatgcaaatcaaaaccacaatggtataccacttcacactcactagggtggcggttatcaaaaagaaataacaagtgttagagaggatatggagaaatcggaacccttatacattgccggtgggaatataaaatggaacagccactttggaaaacagttgggtgattccaaaaaaagtgaaatgtggagttgacatgtggcccagcaattccgctccaggtatctatgcccaaaggaactgaaaacaggttctcaaacaaaaacatgtacaaaatttttcaagacagcattattcatgataaccaagaagtgaaaactacctgaatgtctatcagttaataaatggataaacaaaatgtggtctagccatacaatggaatgttattcagctattacaaggaatgaagtactgatacatgctataacatgggtgaaatttgaaaacacgctacgtggaagaagccagataccaaaggccacatatgtacatgtgattccatttatatgaaatgtcagaattggccagtccatagagatagaaagtagattggtggttttgaaggtttgaggaaggcgggaatatggggagggttggggtttgttttctgggtgattaaaatgctacggaattagatagcggtgatggctgcacaactctgaataccctaaaaaccactgaaatgtacacattaaaagggtgacttatttggtatatgaattatatctcaataaacgtattatttaaagaagataaatggagctgctgaaggcaaaacaggaccaggagacttggatcccttcattcaccagttctttcaaccctccctttcctccactgctggggtattttctgagatacctttgttggggaggaaaaaaaaatcaatttttccctctaagttcttagctaggacggacctctgtaacaaaagatagattaacaggagaaaatcaaacagaagtttattaaggtgtgcatttcatgtatgcaggggggacacccagggagtgcatggttctcaaaggggtggtttagaaatccagcttatattgcatcttcaacaaagaacagtaagtttttaggtaagtaacaaaacaaaggaaaaaggcttcgagtccctaggtgcagcaactgtgggaaggcaaatatcaaatacatgggaatttgttaagcagattcctccagtgccttctcctggctgagaagggccaaagcttctttcatgatcagcctttgtccttcctggaagaaggagtgaagggacactgctacctttgtaaactgatgtcctgcttttaggcagggcagagagcttttgttctgtttcttctcagttgtctcttattcaaaataatgcttttgctaaagtgacatattttgggctggcagattctgatctcctacaccttccaagttccaggaacatgttttggaggacttctatggttccttccaacttcgatattatgtgtttccaggaaacaggtgtgaggcattccatggtagccagaggtagcatggaagatgtttccttttgcctatgtctctgaaccccttactctgaaggggcgtgaccaccgactctcccagtttaaacagaggtgggagaaggtctttgtgatgactttccacttagtttatagaccagtcctataccagagctgaggccaggattattaggaaagagaagcatgaaccccaaactcctctccctcattgaaacatgaaagctaaacagggcttccatgcaatttcccaggacaaagagaaacaagcaagagagaaagcaaaaagccctcccgcagatgaacaaagagtgtttcaaagcacaatactactgttgttttagttcctctcgtaaaactcttcagtggtctctcactactaataggatgaagtccagcatcaaggcctctcatcaccagtgtcatccctcacctctgcaccagctcccccatcccatggtctcccattctctgttcctttgaccacatcagtaccctcttctgccgtccttgtaggcaagctcatgttcgtctttcaagatccaacacatcactatgatatggctagaattgtgtctcccacaaaagatgttgaagtcctaaccccctggtgcctgtgaacgtgaccttatgtggaaagagggtctttgcagataatcaaactaggatgaggtcattaaggcggctgtaattcaatttgactgtgtccttgtgcagaggggaaatttggacacagaatgacatgtacagaggatcagatgatgtgagacacacggaggatgtcatttagaagctgaggactcctgaggttactagaagcttggagaaagccctaagcgtatccctccctgacacccttcagaaccaatcctgttgacagtttgatctcagtctcctagcctctaaaactgtgaggcagtacatttctattgtgtaagccacccaggttgtgattctttgtttgttatggtagccttggaaaacaaatgcccaccatctccatgaatgctatggtctttctgcttctccccagcaagccattcaacaagccgtgtcccccagcactttgtcgtttgattattatactaaatttacattatattcactgctgtttgtctatctccctaaatatactgtgatggcaaggtttatctctttgcattcccaacaactagtgatttacctgtcacttaggaaagatgtggctggatggatggatagatggatagatggatggatgggtaaaaaattagtctcttgatttcttcattccaaaagagaaaagccaacctgtatcaaagctcaaagtttcaaatgcaaattaacatgtgaaagatatatgtgtcatctctatttgagtctctttggcaggcagtcttaagtatgcatttcccagtgtaaataactctggatgtgttaaaaagttcaccagtgtttaagttcattaaattaatgttgtcattttgagctgccgagtgtgttgcaggttgtaagctgttcatcacatttctttaattttgcagtagtgtcatcttcaggaatgtggggtgtattaaaaatagaagagttattttatatcaaagagcccaggaccaggaattaaattactagagtctgccacttaatgctgtgtggcttttattgattccttcattcaggaatgcagctaaaatctgagagccggccttctgccatggactctgtcgggcatgagaggtgcggaggtaaaagcaccagcttccaccctcgagtggcttaatactctggggttgttgcgagatgaatgaagccaaattcatgagcagaatggtaaatgatatgggggacattatcataggcggccatggaggcatggatagagggcacccggctgcaagttggtcatcaggaagggcttgatacaggagatgacatgaacacaggaggtgctttgcctgcccacaggtgagggggtgggtggtgtttcagactcatagaaaggcgaatgcaaagaccctgaggcccattctgggacttgaaggcaaatccctaggaaaagggccgaggtgaacggctgccacaggagagtgtgcgagtagactctggtggtgagtgcttcaaaggtgactgcaatcttctggatgcagagattccagggggcttctaatatatgcagccctatacattcaatcttttccccatttgcgaagaatttgcttacttagactttcattactcacctattcttccatttctggaacacagactctggtgtctggtactatgctcagcactgtgcatgtgtcagtgactcaaccaagcgtcctggagtttctgtttggagaggaggcctcatattctctgtcaacttcccaaatcttgttcactgcattcctggatcataggctggttccttctccccgcttctcctgcgaactcctgccccagggcctttgcactggattctggttctgttctactgccctttcagatctactcattcttcttcagggcatccacaggcttcctggcccctcagctcccttttgtgaggtcttctgcagaagatcagccagaaggaaaggagggaggccagggattccccagccccgcccgctccccgaggctgcttctctgtgggcagaaggaacgaagcaatgaagaccacagctcctgcacacgacctttctgtgctgttcttgtgtctcatttctgatgtcctttctgggaccacttcaggcctagaggtgacatggtgcctactatcactaacctggggctaccgaagctcttgttgtttccgtaagccctgcttttcttttttgtttcatgaatttactgcataatagataaggtgatttcagaagacatagtatagctgaataaaagcaaggcatttgaatgcttaatcattattttcctgtagcgaaatatggtctgaatacaaggacttttaagtagattaattactgattcagtgactatatctaaagctgccttgtttgtttttaaaacgactttatagaggatgaaagacatacaaaaagctgtacatatttaatgtgtacaacttgatgagtttgcagataaatgtacactggtgaacccattaccacagtctataatccatcacctctgtttcctgctgccctctttatttattattagtgatagggcttaacataaatctaccctcccagcaaacttcgaagtctacgatacagtattgttaactataggctctgtgttttgcagtagctctgtaggacttactcatcttgtgtaactgtaatattgtaccctttgaataatacctccacatttcttcctccccccagccccaggaagcaccattctactctgttattacacgctcttcaaattacccagtttgagtatggcatctttttcctgctacagctctgacgaatacaactagccattccctttcctgaatttaacagctctgacgaatacaactagctattccctttcctgaatttaacctcctcagatatccaagttttgccccaatatcactatctcaataagttctctcgggtcattctacttagaaatgcaggccgggctgggtgcggtggctcatgcctgtaatccgagcactttgggaggctgaggtgggcggatcacaagttcaggagatcgagaccatcgtggctaacatggtgaaaccccgtctctactgaaaatacaaaaaattagccaggcatggtggtaggcgcctggtagtcccagctactgggaaggctgaggcaggagaatggcgtgaacccgggaggcggagcttgcagtgagccaagatcacaccactgcactccagcctgggcaacagaacaagactccgtctcaaaaaaaaaaaaaaaaaaaaattgcaggctgggcgcagtggttcacgcctgtaatcccagcactttaggaggtggaggtgggtggatcacctgaggtcaggagttccagaccagcctgaccaacatggtgaaatcctgtctctactaaatacagaaaaaaattagccgggtgtggtggcgcatgcctgtaatcccagctacttgggaggctgaggcaaaagaatcgcttgaaccagggaggcgcggaggttgcagtgagccgagatagcaccattgcactccatcctgggcaacaagagtaaaactccgtctcaaaaaaaaagtaattataataaaaataaaataaaatagaaatgcaaccccctctccacttctcatcattcatccctacttaatttttctccttaccactttttaatatgttgtataatacagtcatattacagttgacccttaaacaacatgggaactagggacactaaccccctgcacagtcaaaaattcgtgtaagctttcaaaaacaattttatggatacatagtaggtgtatagatttacagcgtgcatgagttgttttggtacaggcatgcaatgtgaaataagcacatcgtggagatgcatataacttttgacttcctgaacatttgactcttgataacctactgttgaccagaagctttaacagtaacagttgattcacatgtagtttgtatgtatgttatatattatatactgtactcttacagtgaagtaaactagagaggagaaattgttattaagaacatcaaaaggaaaatatatttactatgtattaagtagaagcagatcatcatagaggttttcatcttcatcttcatgttgagtaggctgaggaggaggagagattggtcttgctgtctcaggggtggcagaggcaagagaaaatctgtgtatttgtggactcatgcactttaaacccgtgttgttcaagggttaactgtattttggtctctgtctccctcaacacacacacgcacgcatgcacgcacacacacacgcatgcacacacgcacacacacacttcatgagggcagggacttctgtcatttccataccccaacaatgagactcatgcctggcatcttataggtcctccataaatacttgatgaggggagaacgggtaagcatgagagcctctacatgtgtgtacgctaactcatttgcttctcttgacagccttcctcaggaagcagagataaagatctttgcaactgtaggaaccaaggcttagggaaggggctagggccatgtccatcctgtgttcctgttgttgatcttcattgtccttgatagcgcctgttgtttgggaatgggctttgcaggcccttaaataagggcacccagctctttgagggattggtggcattttcagtggaagtaaatgaaaagcctcctaatgtggctactttgaagcagaccagagtcattggatggaggaagtctggtgtgttataccctaactgatcatattattagcatatttatctctcatgatattgagcacagcaagtaaatttgattcctcatcttctggaatgcattagtgatagtttatatcccttgaaaggctgaagcttaacccatttcccatgacattgttcaatgtcccttctgtcaaaggagagagacctaattcaactcatgtctttttctcttccttctgaggctgctgccttaaaattggatggttgattgcagtcagtatctttggctgtgacttcatgtaattatttccttcccaattcctttccccattgcatattgccttttgcttaatctgcactttggtgttctatatacatgtgttttaattgtaagttaactcattttgggggagggcaggaattaaggtttatattataaatgaaacaagaattcttatcactatatcatcgtcagttcatcatctctatgcattattttatgatgacactacataaattggtttcttttctgaaataaaagctcattccaagaatgcctttttttgtggggaggggggtgacagttaatacctttgagcttctggatctttttacaaacattatcagacaagtaaagaaagctggatattatttctttggcaaagtagagaaagctgaggccaaccgcaggccaaggactcactcacctaatactatatttactcccttcctctatccgtaaccgtgtgtttgtagacttgataattattgagtgtctacctcatgggtgtagacctatgggtcctgccctctagtagctagtgaggaagtgggacacagcaggccagtctagtatagcatcctacctgcctaacaggcattgcctactgggagtgtgtctgtcctggagtgtcagggacaacttcccacaggtggtacctggaagaaatcccctggaaatgtgtctctgttgttggttttttttttttttttttttttttttttggtggtaggggtggagacggagtctcgctttgttgcccaggctgtagtgcagtggcgtgatcttggctcactgcagcctctgcctcccaggttcaagcgattctcctgcctcagcctcctgagtagctgggattacaggcatgcacccccgtgcctggctaatttttgtatttttagtagagacgggatttcaccatgttggccaggctggtcttgaactcctgacctcaagtgatctgcctgccttggcctctcaaagtgttgggattacaggagtgagccactgagcctggccgttctggaaattttttaatttgtgggataaagagtctgtaggctggaggaatagcctgcatatgtgtataggtgtagatgatgaatacgggatactacaagtggagttggggctactgaagtagacaggagccagatcatatgaattgagtagcacagttgatgtgaagtcatttcaagggctttgagcaagacattgctggatcagacttgggttttctctctgtttatatggacacttggcctttgatatcagggcttgtgagtgcagatccatctacctgacccctgaataccccttacctgtccccagtcctttgatctcacctctcctccctgctgatgtctttaatgctggccctgctctgctcaaatctcacctgccctaagaagcttcccctgacctttccaagcctcaggaagtccctgccttccctgactgtcgttgccttggttttctgtgttagccatttagagagaggaactagtttcaggtcccagccttatcagccagtatatttgtgatatcacgtgtatcatgtgattcttctgggtcttactttctgcatctataagatggacatgataataatactttccagaccaagaagataaacagacatacatttgtattcttcctcaagcaaatgtgaatttgtgctagatcaccttcctcttaaacgacattcctggtggggattgaagccacagggctctagtaagctacatctctctccacgttctgttttccatcttcactgacattgctgtagggtggtgagagaaacagggcattagatacactcttttactttatttggtttagcaaaatattagcacctttatgggtcttggttcctcattgcgatatatacaagagtaatacctactacctcctttaatgagagaattgaatcagatggtgaatggatcaccctctgttcagtgcccagccccaaacagatgctaattaaatggcttaatcaaaccagctcaggctgttactggatgtcatcccttggcacagtctgacatttcttgattcttgttaacagccctataacaatattgtcataagaaatagaaaacatcattttctttagggaccaatttggagcccatccataactgtcttccagctcctcctggcttccccctgtcaccttgaccttcagggagccttgtttctgctgccggcattgacccatccgtgctagccatgacagactgattctccctacccggcttttccaaatctactcacatctcatctcaaaacctctttctctcatccatattgccttgctttctcattcctttgccatttagtaggtaatgatttctattaagatgatcatcaggatttattgagcagagaggtagatattgacactgactgggaggcatgatccgagtggggagggaattctgtccctgcaccccaattcccccagtcttgcctgctgcttataaagttagctggagtcccagtgtagtgccccatctgtgcagtagggaaattgcccaccttggggctggccaagtaatggaagcttcacaaatacaccatattaaaaaggactttgcacatctggcattagaatatttccagccctggctcagtgcttggcacaggtggctgttcacagatatttttagaagcaaggaaaggaggaggggaggagtatatcataagacatttggcatctcctgcctttgctgagtaaaggggaaggaatttaggatttgtacggtgaatattgccacgtgtttacgagtatttatataatgctaatatttcagttgcagggaaaaacttgtcctgaagatgttaaagctggaagtcagtgatcttctacacctcctggaattttatagctgtgtgctctcaggtttagagtcaggaggggaaggcccagggccatgtgtcatttcttggcagagcttggcttaggactacttttcatccattccctgttcttttccatatttcccagttttcccatttttgtctcaatctgtctgcctgtctgttgcactctacccatctacttatttacctgtcggcttccactgtgctctagaatgttgcccactgtgatcttttgggcaagttaatgtctcagggcccagtttcctcaactggaaaaaaaaaaaaaaaagagtagctgtgaaaataaatagtgatttataagcgctagattttgggggctggagaatccttccttatggggggcagggaggctgtcttgtgaactgtatgacattttgcagctttccgaacctactatgtaccagcagcatctctcccctgatttgtgactccaaaagtgtctccagacattgccaaatgtctccgcggcaggggggcaaattgcccttggctgaaaagtactggcacagagtaagcaattattaaatattgttttaaaaaaaacactgtcattatgactattctgcagttatttaatttatctgaaaagtgttcatttggtgcttactgtatatactgcagagctctgagccgtgagaggcaagtggaaaatgtaagcctgatgttcttgctttctaggagattacgatgcggttcacagtcacacacctgtggatgggcttccgagggggctttgaacgttttgtttcaacctaaatttagcaaaaggacaattgtgaggcttgagaggcatgtctgcatgctcccagaccttctctttgggttcgtggtcctcccctaccctgccccttttgattaccagtgaatgcagcagtggtgacaggtaaatgaccttgttggttggtcctctagttcctgatgaaccctcaactgggagggactgtctgtgaatcagagcagctggctctttgaaaagaaaggcactattgcacagttgctgctgctgacccttgcattcagaataccggccgaggccaatgggcaggtcaccaccctgtcgcctctgtgctcctgcctcccagaccacatcctgggattcttccctcgccccatgcagtagcagaagggtgtcacaaagcgactctgctcagacccaccatcagacctgaccgctggcctttccagagcttccagagccactcagccctgccctcctggctctgcctcccgcggcccccacccttgtgtcttctcttactcacctcacacacacctgctctcctcactgtgcgcactgccctggccccgcttctgggaatgctctttccatggatcccttgtagcccctttacttcctgcaggtctttgtttacacttcaccttgtgagagagggccctttatgaagtcagaatcagaaccctcctcctcccaccccacctttccttcctttatttccttcacaactctgatcactgcctgatgcctccactgtatttgctggctgttgagactgtctcttttctatgttctcccgctggactgtaaactccctgagggcaggtgattggttggtcatgttcagtacacttagaagtgcccagcttgtcccagacactcagtaataattgccgaatgaatgaatggatgaataaatgaatgagccaagggagaagaagttaccatgactgttacaaagttgataaatgcatgcagagcctttgttcaccattttctgggaggaatgggtctcccgtaccatagcctgtgggcatggctgggtggagtttggtctacattatatcaactcttcccttctctatctggagataattctctcctgggtaatgagcctactggagcatacagatgagggcacgaaggtgacccttatagaactgtggctgagagccagggattcccacttccacctccacccccatagcatcatcagtctagtcaagaaagacccgtggtctttgtattatgggacttagtccttcattgtccctgtggctctgcttttcacccctgtctcatgctctcctccttcacccttcccatctgatgtgtgctgaattgttaggagaacagcaaaaatgcattcctttgctgacacttctctacctgtggttgtcttccactctgcgtcatgtgccgtatccgcctgtcaccccggcacactgtcagccacgcagcctctcgttccctgtgtttccttgcacactcgtgctctgctggcctctgtcactctcactgggcgtcctgcctgccttcccaccccctgcacgtgtccctgttggcacttccctattcacactctcctctccaccaagcttcctttgacgcttcctctttcaagctgtgcagccttcttcagctgacagttcagcatcgttccatttctgaagcagggaattggtttggtgggcactagctccaagtttgcctttgtggtatttctagcctccttcattctctttcctgttttggctgcaaccaaaggctgggctcagtgatgaatcgcaattgggtttggtggcccagccgggcccttctcaggttaagggtggtatagggagttgtgtgaatgaatgaggtcccgcagagagaccatcacacatgggtagagggggaaaaaaggggggctcagaatgcctgtgtggatggcagtctcctgaaatacaggagtttttctctctaaggtacaccacaaattttatcttccaacatttcttagtcattttccaaattccatgtcccttttcccttgatttgttgattaacttcatatgagccttacccaaatccgcctgatatcagtgtgtgtgtctgtgtgtaaggtttttggaatcagcaagcacctttttcattcttgtttccactcatcaccttacagtacctcactggacacaatggatttccaaagcatctgtagacatgagctgattctagaatttctttgtacatcacccacatcctggagctgtttcttgggagaaagaaagatggcatgcctccctttgcccctggaccctgaaggctgtgctctttacaccgtgaacctaaatctgggcttggtctgcagccaacctggaaattcactactgcaactccgttttctttttaacgagagcttcatacggttcttttaaactagaaacttctctttcttgtaattgtctctaatggcttccttgttcgaacaagcctttgctagcttctgtctgacccctttggctttgctttctgcctccttttatcctccagcctttcgtatagattccagaggaatcttcctcaaaggctgtgccactccctgttcaaaggctttctgtggctcctcattgcctagaaagcaagtgagtaaggccagatattgttagtggctcacttaccgcattccaggatcttgctctaatttccctttacaacgtcatcaaaacagctcacccccaagctccgacctcaactcccacttgcgaccccaatcagcagcctacccatgctgcggcctcgatggttccctgaatgcacgtgttccttttctgtctctgtgttgttaactcatgcagggtccacccccttcttcctagacctacctcaccttttttgtagagtccctcttcactgtttcttccattctgtcttatcaggattatttttctgtctttggtcttgccattatacttccctccattgggtgacttactataacgtgccttctgctgtgactctgttggatgtttttgagtgttcattcaattctaagggcaggaatgatgtatttcccccataatgtgcagctcggttccatgcacatcataggtgctcaacacgttttcattcacttgaaggacttttaccgttgtatttgtcacaatatttgttactgttatttttgtcatcaccacatcattgaccttagtatcttcctaatgacttataattgacaaagtaattccctcccttctttccttcctttccttcctttcctttcttctctctccctctccctcctctcctctccctctccctcctctccctctccctcctctccctctccctcctctccctctccctcctctccctctccctcctctccctctccctcttcctcccttcctttctccctcccaggctagagggcagtggcgtgatctcggctcattgcaacctccgcctcccaggttcaagcgattctcctgcctcagagtcccgagtagctgagattacagatgcccaccaccacgcccggctaattttttgtatttttagtagagacggggtttcaccatgttggccaggctggtcttgaactcctgacctcaggtgatccaaccgccttgacctcccaaactgctgggattacaggcgtgagccactgcgctcagccaacaaagtaattttttacccaaggatctccattgtggctgtgactgctgcctataaaacaatataccaaagacaaaaataaagacaaaaacaaaaataaagagtacaaaacagtatgggggttgtacataaggcttttgtgttcctgcttgtaccaaggaaaaagataccactcagaccaatcaggatgcacagtccagagcttctgtgagaagttctttgtccttctatgccacttagagtttttctacgatacctttaacctgcaccatttaataagcttttaaggagccgcacatgcatttactgtgtggctgctctgattctttggcaaatttataagctgcccttcagttgggggcatggatttgccttagaagatcgtctttaaagacacttgctgagaatgttcacaagtgtgttgcccttttatgctcataggtgtgtgtactttcttgttctttgcctttccctatttcacccagacatttaaggtaagtgggtgaatttcgatattgtatgaattgataatagtcctctgtggttatcaagcatggcacccataagaaacttgcacattcaaattctcacctaatcgtcataatacacctgtggaaacaggaatttttgcccatattctatgaatgagactattgccattcagaaggaatgtgtgttttgctctgatttaatgtcttgttcagggtcctacctctggaaagccaggatttcagggtagaactagcaagtcttaagttcagtcctcttctcctccacaatacctggttccaaagtcacttctacataggtagcctcactaaatattgtagcagctgcaaatgataaagcccagttttgttgtttagttgacaccacactgttgaattccacttcctttgcctccatttctttgttttccatcaagaggatttggtttactttcatgctctgaatatctggtttcctttcactcctccaggaatcccgtaagcactaaggaccccaaaaattacccacccaaagcaggctctctttccctgcttgaggagggcattcctgggaattgggctgctctttttccagcagccccctggcctcagaagccttatcttttcttaggaatcatctctgccgtgacaccagatcagcagaccagccactacactcccttgcttaaaccaccagtggcttaagtcagtctacacttcttcaggcctacaaggatctgtgagatgtaggccctgtccactttgtagccagttccttctctgatatttgcttttccaatcttatgtaaccacaggccacattctctggactctgggacttggacctcaagtgtgtgctggtgcagtcactctcagtaaagaaaacaaattattaaaaagtaattgtagtacttttgtagtatagtcatgcgtatgactgggatacattctgagaaatgcgttgttaggcaattttgttgttatataaatatcatagagtgtacacctagcctatatagtatagcccaggggtcctcagcccctggtaccagtccgtggcctattaggaacatggccacacagcaggaggttagggactgccggccagtgagagaagcttcatctgtatttacagccactccccatcactcccgttaccccgtgagctccgcctcctgtcagatcggcagtggcattacattattgcaaaccctattgtgaactgagcacaagagggctccttatgagaatctaatgcctgatgatctgtcactgtctcccatcacccccagatgggactgtctaattgcaggaagacaaactcagggctcccactgattttacattatggtgagttgtataattactgcattatatattacaatgtaataataatagaaataaagtacacaataaatataatgtatctaaaacatccccaaaccatccccttcccccaacctttgtctgcggagaaatggtcttccacaaaaccggtacctggtaccaaaaaggctggggactgctggtatagcctattgcctctaggcagcaaacctgtatagcatgtgactgtactgactaccggaggcaattgtaacacaatggtaagcatttgtgtacctaaacatggaaaaggtacagtaaaaatatggtatagatgagccaggtgcggtggctcacgtctgtaatcccagtactttgggaggccaaggcgggcagattatgaggtcaggaaatcaggaccatcctggctaatatggtgaaaccccatctctactaaaaatataaaaaattagccaggcgttgtggtgggcacctgtagtcccagctactcaggaggctgaggcaggagaattgcttgaatctgggaggcggaggttgcaatgagccgagactgtgccactacactccagcctgggtgacagagtgagactctgtctcaaaaaaataaataaataaataaataaataaataaataaatatggtatagatggcatacctgtatagggcacttaccatgaatggagcctgtagaactggaagtttctttctctgggtgagtcagtgagtgagtggtgtgtgaatgtgaagggctagggcattactgtgtactaccgtagactttctaaacactgcgcacttatgctacactaaatttgtaaaactgttttgccatctttagtcatgctacattagtttgctgtaacttttttactttataaactttgaaatatttttaagctttttgactcttgtcgtaacactcagcttctaacaaacgcattgtatagctgtacaaaaatgttttatatccttacactgtaagctttttgctgtttttaaatcttttaatttttactttttaaacttttttgttgaaaacaaagatacagccgggtgtggtggctcatggctgtaatcccagcactttgggaggctgaggcgggtggatcacctgagctcaggagtttgagatgagcctggccaacatggtgaaactccgtctctactaaaagtacaaaaaatagctgtgtggtggtgggcacctgtaatcctagccacttgggaggctgaggcaggagaatcgcttgaacctgggaggtggaggttgccgtgagccaagatcatgccactgcactccagcctggtgacccagcctgggcgacagagcgagactccatctcagaaaaaaagaaaacaaaacaaagatacaagtacacactttactttagctgagacccacacaggttcaggattatcagtatcactgtcttccacctccacttatttcactgagaggtcttcaggggcatgaacgtgcattgattggagttaggatagggaaggcacctcaccataaaataactgtggatcaggatggaaagaacttagcccactggccatgtggcgagccaaaaagctcatgttgttttcacccaataagaacctatgtctattaaaaatcatggcttcagcttctgtgactacctctgagagtccattcagcacattcattaattatcctcagtatgaacagatttcctctaaaaagcctcctgtcctattttcttagcctcagtctgtgccttccagtttgtccaatctagttcctctcataaattggtcactatcttggatttttcccagcacctggtctggctctccacagtgctgtctttggtgagcagctgaggtcctgatgggtcacacttagccgggggttctcagagcaggaggatgggcctcttctttggtcagcctgttggtattgatccccaggtgtttgttctctggacatagtctgtgtgctaataagggaacctcaggtgacagtaaataacggcatatttggtgtgcttgaagagaaagcctagatagtgttcagaattttctgcaaccacatggaaaggttgtctctactgcaatattgtgattgagcctatcttcaaatggcgtatctcacaaagtatggcaggaacctggagattagaaagggaacttttagagccgagatgggaggaatgaaaacagagtgatgccaaataaagggattgctcaggggtgacatgagtggtgactggtctgggcaggcctggcacagaggcctggagtaggagtggacactctggctcatggggacaaagcgactttggcagaatgcatttgaaatgagatttcaggatggttagttaagtggttttctgtatgattttattagttttcatccttcattccttgtttcttttttcatttgtcacatcacagaaatagtgctagttggtttcttgagtacattcgttagtgcttgggattgttcacaaaagaagcatctgttgggtcaagagccttctcagataacttgtggcttcaagccctcgattccactgtggggatttgagtgttctcaagtggatttattgatctttacgggctcctctgtggctttctggatttctccaagattataatctgaccccaaggaaatactgagtagatgaggagaagaactgggtcaacagagagtccaggaatgtatcaatactggaaaagaaaagaaaaagctctcattctgtggtagcagctgagagcagattcacaaaatactcctccaaaagaggcccctgatggaaaatgttggtgattggctcagaatcagtcagaagcactcactggtatgcctcccaatagttctagagcctggtttcgttggatattgcaagaaaatgaatcaataaatacatggtgcactgtgggggtagatgggtggatgaatgggtaggaaggtaagtgagtgggtggatgaatgagtgaataaatgaaggagatggagggaggaaagaagagacccaccaacatgtaccatgcagaaataggtgttgatgtatttggagagggagagtacaacatatacagtgaagaggggtatcctttgggtatcagttgggaatcatttgtcatttccaataacaacaaaaaacaattaagttgtttaatggtttaaacaagtaagaactcattcatttgatatgtaacgagatcttggttgttgacactggttttgtggttccataatgtctgtgctctgaatgggcatctctgcaggtcttttcgccttctcatatttgcaggatggctgcagggtcttcaactatgagccaacagtaaaatttatccacttcctaggaaccggttgttaaacatttactaacacactctggctccatgtcttgtatttacagcaagtgacacataatagaggctcagtaaatattttgggggtggccaggtgtggtggctcatgcctgtaatcccagcgcttggggaggccgaggcaggtggattgctcttgaatgcaggagttcgagaccagcctgggcaacatggtgaaaacctgtctctacaaaaaataatgtaagttagctgggtgtggtggtacttgcctgtggtcccagctactcaggaggtagaaggattgcttgagcctgggaggtcaaggctgcagtgagctgtgatcacaccactgtttttgagcttgggtgacagactgagattctgtttcaaaacaacagcaacaacaacaaagaaaacaaaagcaaacaaaaaaatttctgaacaaatgcacagatgaagtagagttgccatatgaaaatgtaattccctctgttaaattggaatttcacataaacaatggccaatttttttagtataaatatatcctaaatattgcagggcatatgtttatgcaaaaaatttattatcataaattcaaatctaacggccatcctgtattttaatttcctaaattcatcaacctgaggatataggagtcattttatgggaacagatttgaaggcttatcactgtttcccaaagtaagaggtacctgtgacctgtgttgatcatacttaagtatatggggtgagatggaaattggagtgtacattgtgcaaggaactgggacaatgtattgggagggaaacatgaattcggaattagtagttagtaatggggaattaactcaaaattaaataaacttgtggatggtttgtaactctttagagaaatttcttagtgctggtttcagaacagtgaaaggaaagccgttgtcagctgggatctgccgcgtttccatggaggccctttgctcaatgatgtctgtgatcctgtgagcgtgacaactttagcctagcctgtgcgatgccactgcagttgcaactgggggctcatctgctttccagtccttgccatgtgttgtttggggagctaggggaagagaatttctgaactgggaacttgtttgaaatacaaatgcttggactctatttcagaggcagatgctctgggggttagggcctggcgatcctacatttaacccagccctccagaggaccctgatgctggataaagtttaggagccactgctgtagacagtactaggggatggggctatggaagaatgtttgttttgcagtttaaaaggatagctgcatatgcagtggggggatgagagtgcagccagctaggaagaccactttgagaaagtcacccaggcgttacccagtatccagttaccagcctgcccttaggaacattaattcaaagaagcaggacgacatggatctgttgtacctctaagaagtatgggaggactcagtgagcttggaaaaagaccaccctattggtggtcaaaagagattcatgagtgatgttaagacatgagaaacgcctgtggtgataggcaggtaactctgggttgtaggcctgacctagccagtaacttaactgggtgatctcatacaactacttaattttctctggacatccatttttgattgtgtaaagtgaagattttgaaggaacgaccctaattctgattctttctagcccaagcttctcatgcaaaggtaggagcccaaagatggtggaagtgaagcctccatcaattgagcatggagttcagatagtcctgcttcttaaatagtctcttctccttcctgatttctttccacctcttgccaacaagtccttctggcagcatgcctccaaaggatatgagaggggactgcctttgaatttcagaggacaatctgaagcgggtgaggaatgtgtcctatgttcattacacacgaggtaatcacctgccatctttccataacctgagatggcgtagattggaatttagggtacatggagcagagtggggtttgaatgggtcagagacctgcgtgtggttgctgttctttcacgcaagtacctgaggccagttgggccaagggaggccacaggcctgagtgagaacaagttgagtagcaacataggaccatgccacagtcagttttacctgagcagtgaagattatcctgccaatttcttttgtttttccttccttcaattgatttgttatcaaggtaaatttatattacagttcttaatttggcatttatatgattaaagcagttattatttgtcattgtccccaacagattatgtgttgtcttttatctcatttttgactttggtcatctaattctactaagtgagtgtaattatgtcccccagtttacagatgaggcctcaggcttagtgagggtaaggaacgtctccatggtacacagccagagaagccgagggttgaaccagccttatctgcctctagagctggagttttttattgccatgctcttgaatgtgaggctgttctctgaacgaggggctcctcatttttccaggccaagaccagcttttctcatttctttggaattacatgatcatgtgtgtgatggaagaggggcaacatttctggcctgctggtcaccacagtggtaggagagtgggcacttcagctgtagtagccaacttggtaggagggcaggagtcagtctgcatggaccagtttccaggatgattctgctttcattattgaccactgggtactcattttgttttatgttatgttatgttatgttatgttatgttatgttatgttatgttatgttacgttatgttacgttatttactttttctttgagacagggtcttgctgtcacccaggctggagtgcagcagcaccatcctggctcactgcagcctcaacctcccaaactcaagtaatcctctcacctcagcctcctaaatagctgggaacacaggcacatgccaccatagctggctaatattaaattttttgtaggcacggtgtctcgccatgttgcccacgctggtcttgaactcctggggtcaagtgatcctctcaccttggacacccaaggtgctgtgattacacatggaagccactgtgcccagccctgggcactcattttaaaatgctgaatatcaaggaagaagagtaaacaaatacatggatcgatcatttatgcattaagaaagtttaacctgaaaaaaaaaagagcctacaacagaaccaccaattaggtaattaagagtgccaacctggtttgctgtgtccagctgtgtgtgctggcttgtgtgtttcaaataaaccaccagcgaccgcggaatgaatgaatcctgagctgtgattgatgtgcttcccagtagccagatgtggttctctgcatttatgtactagtggaatagcaggggggattcctagcgaaaggctgtttagggatacattttaatgtggttccagaagggagtggaaacagccctctcatttttctttatctgatcctgggggagctgggacttttttttgaaaccaactctatccattcctttaatgatcatctgaacagccaaaccttctgggactattatgcataatccttctctaagctgaatctattttccctcatctgtagatatatctatccccctactctttttaaaataaaactgattaattataagaaaatagatatgaaatgaagcactgagctgcttcttagcacatctcagcccttcagtgatgggattttgctctcaagatggagaggtcccataaaggggcaatttttcagaacaaacacacaacagattagccacagggtaggcaatttaggtacctttaaaagtgtagctgtcgtcctcaccgttgacaaatacttaccatataccttctgtgagtacaaagattatgcagagcaaattcctaaggcacagagtccgcaccatggaaacataatttaaatttcactctggttgaggctgttgaagaatgctgggggtcaagctttcttccctgtgttgttgcctctgctttcttttttagagactagtaggttagtggcttttcttgctggcctcagcttttcatgctacccacatgcagacacacacacacacacacacacacacacacacacacacacacacacactgtacccctcacccctcaatttctgtgactctaattactgtttgtttcctccacttctctacccatttctttcgtctcttgaccactcagagtcaaggaggggtttcctgatgaatttccattgatgatggagtggactgtgtgactcacctagttaccccatggctggacccacctcatagccagtgggttcatggcctcagtgaacatgcccctcttgtgctggtctcctctagaagccttcgagcctgtgatccgtcttctcgtgcctgcctgaaggctgtttagatgctcagtgcagggccatttctcccactgaggctggcatctttactagctcaaggccattcatttccagtgttaggcctgcaatccaggctccagcttccctgtccgggtaggatttgccctttttttttcccccatccccagggttccagggttgtgccaaatgggatagtggtagtggttaatgctctccagactcaaacttcctggggttgaatcttggcattagctctacttgttgggtggtttggttgggacaagttactccacttttctggacttctgcctttataaaatggcacaccactcaatatgcagcacacgttagctcttacctttattttctgaaatctggagaagataatgtctgtttaaaacccgtatttctaggtcaggcacggtggctcacgcctacagtcccaacactttgggaggctgatgcaagaggactacttgaggccgggagttcaagagtgacctacgcaacatagcaagaccctgtctctgcaaaaaaaataaaacaataaaaataaaaattagccaagcatagtggtgctcacttgtagtctcagctacctgagaggctgaggaaggaggactgctggagtccagaagtttgaggctgcagtgagctatgatcacaccattgcactccagcctgggtgataaagtgagaccccaactctaaaacaaacacaaacaaactcatattcttaccttttcccttctctgtgctctttccttttagtctggtctcagaggtgtttctgctcatatcatttggccataggtagcaggcagttttcctgtacagcatcctatgtatcggtcagctgtgggcagctcacctaacttctctccagtaaggaggtcggcctcattcctggtttccagggtatccttcagacccatggtctattcaatattttaggacacatttgaacgaaagtgtgaagaattctaaattgaggcgtagtatagcagaggattttaacacaggggttagaacccttgaaagagaccaatccattctaaccttcggatctcagttcttccctgtctcctatcctgctgcagaccccctggacgcttcgctccagcaggttacaaaacatgggagcctggtggccaccccttgctcttgcatagctcccttagcagggctcttctctctcctgccttgcttcaccttgttcacctggggaaactgctgtacctctgtgggattaagctggagctcggtgtttgtcaccctacaactgctcctataacacttggccctctcttgcttgcttgggatctatatccagcacagtgcctcgtacacagtaggggcacaataaatgatgagcgaatgatttcttacgtaaagatttgggacagtttactaccaaaggtcttctgcagctgtgtcatttgttgctttggaaatttctaagttttaactggtcttttgagaaaaaacatcatacagcatttatcgtgtactctaatgcccctttttcaaagtaatgacttcccattgaaatgtgcccctggttttaaagaattttgccatttccttctctaatgtgtaggacgactccgttacacttggatcgatgtacctgccattgtggtgatcttgatttattctactcaaatgacagcagagctgttggaatgttatgaattccttaggaatttgcatcattctattcctctgctcagaaaaatcaaatgagtgccttgtgcccattgtgtccagtctaaatgcctctgattaaaagaaccttttgtggtcccccaggaactctctgcacctgctgctgtcatttccattctcctttcttcagccagccagggacgagttgttcctttccccttgacacacagtatggcttctgagccttccttgccactgtcttcctaacttgttcagctccctggctggttcatcaccatgatcatgcattagaccatgacctagccattttctggggccaattcttccagttttcatttttaatttgattctttgattcactggttcagtctcttctgagaagacgttagtctttaaaacctttccccagactgcttattcctcaaaggcttaacaccgaatacaatttgtattacattattctgcattcttaagttttgtttttttttttcaatctccttgaattgcttgtaactgccttgctgtcatgagctattgtcttctgcttctttggaaagtgcccagggtagttctttgctcgtatagctactcaaacagacatttgttgaacggcagtagcattttccaagtgggaacatagacaacagggacagtggaattatacggtgatgatgaagttttcctttttttttttttttttttttctgcctagcaaaggtctgatgagagaggaaagtacatcaaagtagcattggccagctgagcgtggtggctcacgcctgtaatcccagcactttgagaggccgaggcgggcagatcacctgaggtcaggagtttgagaccagcctggctaacatggcaaaacccccgtctgtacaaaaaatataaaaattagctgggcttggtggcgcatgcctgtaatcccagctactcgggaggctgaggcaggagaatggtgtgaacccgggaggtggagcttgcagtgagctgagatcgcgccactgcactccagcctgggtgacagagcaagactccgtctcaaaaaaaaaaaaaaagaattaaagaattaaaatggagagtaggtacctctaaacaaccacgccacctggaccaccctgaatagaggagaatgagttatgaaggaagcgcgctactgcctcaccaaggatgagtttaaatccaagtgcagtcttggcgtgcattcaatgcaaatgactagtaggggtaaagctagatagaccctagatatgagtcccagtgccactctttttagatccatgaccctctggtaagttccttcaccttcctcagctttggctctcttatttgtaaaacagggcctgacgccagcaacctcacaggtctaggcaccttcgtggcgtggtgggatcgtgttttcagggtcttggaggtctggattttaaacctggctctgctgcagatgagcggggtggcttctgagaatcacttacttcctgtgtgtctcattttgctcagtggtataaaagtggtaatgactgtgattggctgaattgcgcccctccatgtccgaagttgtgttgaagccttaacccctgatacccaggaatgtgactggggatggggtctttacagaggtgattaaagtaaaatgaggtcattatggtaggccctagtcctatccgactggtgtccctataagaagaagagattaggacacagatacagaggaaagaccccatgaagacactagcagaagatggccagctgcaggccaaggagaggccgcagaagaaactaactctgggctgggggtgatggctcgcgcctgtaatcccagcactttgggaggccaaggcgggcggatcacgaggtcaggagttcgagaccagcctgaccgacatcgtgaaaccccgactttactaaaaatacaaacattagcttggtgtggtagcacatgcctgcaatcccacctactcaggaggctgcggcaggagaatcgcttgaacgcgggaggcagaggttgcagtgagccgagatagcaccactgtactccagcctgggcgacagagcgagactctgtctcctacacacaaaaaagaagaaacaaaccctgccaacactttgatatcagacttccaacctccagaactctaagagaatgagttcctgttgtttcagccccatagtctggtattctgttagggccgccctagcaacatagtatgaggacaatcacctgaaggtatgaaatgcctcaggcaggcatgtaatgtctgtgttatggcgaggggcactcaggagggcttctggctgggctgggtatgagggtctctgtctacgcattggccaccacaacccccttccagagcgtcttttccccatagacagcctcagtgcccagtgcactgtcatatcccttagatttttcttttctctttccctccctccctccctccaatagcagctccatatcagcaactcctaacttctattcagtccgtggaggctggactcacgacagtgccaagcttggttgaaaacactcttttctcctctgggataggtgctttcttagtcctgagcctgacattctacacagtggccaagggaattttccctaagggtccttctgggtgatatttgggactggatccttctcagcagcttggacatcgtcagcctggtcaagtgtcatcctctctaaggccctggctcgttccatcctgtgtgtgtgcacagatgtccatatcctgggtctctgcttggcaattctgcagacacttccagagctaagcacactctggttccctagtttctctctggctttctcagatgtgcttgatattgttgatttttatgggggttctcgcccccagggccctcacagtgctactaaaatcataacagtgacatcagccacttgggtgtgtgggtcgactgtgggaggcagctccatctggaaactaaaaagagacacaaaatcctcttcttttgcttcccccggacttatctgtatctttgcaggtagacagggccaaatggagaatttacaaattgacacttttctaaagcagcttgatattttagaaagttcccttgattccaaagaactgagaccagggagtaagattggctgcaaagccagagcagttggagaaaggagggagcatgatgcgtgtgtgcttggacagtcttggttgttttgcatcagaaatatagccacaaaccccatctataggattttaggaacctaataaccacttccagctgttaacaccttgagactttctaagttacagtcaaagaggatccctggcaagctaacattgattttataaattttgttatagggaggttgaatgtttttcccattcacctggatactccctgtattttactaatggactcacagtaaaatgatgggcctgcttgtgccagggggcaggtgtggccccgggagctctccctttctcacctgacagatgcatctagtgtcagggcagtgagagagggaagccagcatgttttccccattccctcccacatctttagtagccatgatattattcagctagaattggtctcgcgtgccagttctggatctactgaagatgacagaattcttactggatgatggggtgatggttgctttttcaggctgctttctggtgacattctggaagacacaccttaacacatatatgttagttttctgttgctactatatcaaatcaccatacacttagtggcttaaaataatacagatttacttttttatagttctggaggtcagaagtccaaaatcagtctcactggactaaagtcagggtgtccatagggctgtttcattctgcagtggtttcaggatctgagatgtcatggattaggaagaatttgagattgtacctgcctgagggcagaaaagggccaattcacagggatttatgtgtctctgtcttttgacgaaaagaacttctaagaaggtaggttagctatgcaaatgatctgaggcccaggtatcttctgtctggatttgctgaatcatttcctttctttaaagcgatttagttgatttttactagaacctcttccatccccttccagaaggagaatctgaaattacatcaagttacttgtttaataattttattagttgtcctgtgaccaagactgacttaccccaggtaacacattgagttatgggccgagttgggacttgaacctgtggcttctttcctagccttgaagctcaccccttataccaggatactcttgctgctttctaggagctcccccttcctgtttcctcctctgcagtgcagatggtgccatgagagggagctttccctctgttctcaggccctgacgaggtccctcttggccattggaggcggtaccctggaggcttgtgtgggggtgtgggctgagccgtgtgatccatgtttgctataatgggaagcagctcccagaagagaaagacatgcatttgtatgcagccagtctgatggggttgaaataaactcagcactgatcaaacgacacacagccagcacattgcagggaagacaaaccaacatggaatgctgatttttctcactgtcatctttagaaaccttctttcttgtcgcccaccggggcagttaactgttaggagccagccctgtgttcaaatccatttattgatggatgtgttttccatttatcatctgtgggactcttgggtgatgtttcttttccgagctccaattctttcatctataaactgggcatgttaatggtaactcatagatttttagagttaaagtaatgcaagtgccttacacaatgcctgcacgtattaaacattcagtagtaggtaggtgctattatcatcatcgaaaacattatcatgtttattgccttattgacttggatgaacacggtagtgtatataataaagtagccagtctagaatctggcctgtggttatctgtaataaatgaaagctgtggaaatagtgtgggataactcaaagacctgaataattcagcagatacaatggagttggaagattctagggacttaaattcttctcccagctctgtctcaaaataactgcattgccttggacaagtcgctttgctttccataacttcactttcctcatcagtgaaatggggctgagcattgtgtggtattggaaaagaataactgaagtgcttagttccatgctggaatgaagtagagacgtgagcagtgctgtcttatctgacttactggtgggatcaacatcgctcttcctggagagagccaggtcatcacaagaaccataaattgtgcgtatcctttaactccatgatagacccttcaactcaatgcttttattttcagggaaatactgtctccaaatatagactctaaaagaaaagatggaagggggtggaacagactctgcaagaatctgttcatgacaacgctgttgaaaacagctcaaaattgaggcttcagcagtgcccagtgttgccaggtgtgtgttgtgttgtgctgtattgtgtgtgtttccaccacagagccctttgtggctgtgggacctgtcagacgcatgagacgtgtagctttctaatttatggggtgcaccatggtggcaagtgttggtgatggccacaccctactgttttgatggaaggacagtgacttggccaaggttttacagccgtgaaatgtctcagtgaggatttgagctcaggtttcttgtgcctgggtcctccttagtgtgggtcctctgctctggcaacaggcagagcactgctttagagcctctgcgtgtctggctgtggcctcaggggtctagcagcagtgctagagcagacccagcttgtcagatccggggctgcttagaggccacctaagtgattcctttggcagcaagcaacattcggccaaggacatagctggcgggggccctgacaaggggtgtgtgagtgcataaaggttggtgtatcaggagtaagtgagaaggaggaggccggctggaattttacccttcagtgcttttctgtgtgtagacagagattgggcggaggtaggtagggaccatgtgtaggtggattatcatcttttccaggcctcactgatgagtgtcgtgccttgcaacagtagtgctcagggaatcaggctcagttgcgagaggctcccggcagatgagggtactgcccagaaggatcatggagagctcaatgatggaatgttcacaaagcttctggccctaagagagcactcggtgagcatgggttgcctgtcccgttcctggagttggggcagggtgggacatttgaacgaggtctttgtagccatacagcaatcatcaggccaggattctggggagaaatccccaatttccagtaagttcccctgtctgcacacccgtgcttgtactgggtcacagccctgcagatacatgtatgcatcttcaagaacattagagtgggatttggaggcataaaatagccttccatattcctttgttttatacagtatacatcattactttgttttatacagtaattacagtctataataaaagaaatgagtcaataaaatggataattagacatgtggtcattcctaagatttaagatctagaaatatgacaattcagcgctttagtatccctctgctaagacgctttagtggaagctccacattgaggataaaacttaaactcaggctggtgcacagatcctcccatgacttggcctgagcctgcctcctctaattcatttttctgatgttcttccttaacattctggaagacacaccttaacacatatatgttagttttctgttgctactgtatcaaatcaccataaacttagtggcttaaaataatacagatttactcttttatcgttctgaaggtcagaagtccaaaatcagtctcactggactaaagtcagggtgttcacagggctgttttcttctggaagctctgagggagaatcccatccccttgcccttttcagcttctagcagccacctgcatcccttggcttgtggtcccatcctccatccacaaaatgaatcacaccactttctgcctccattatcacaccaacattccctccgacgccgactcttcctgcatctctcttataaggacctttgtaattatatcaggcccagcaggataatctgggatcatcttccacctctaggtctttaatcatacctacaaagtccttttttgttatgtaacgtgatactcacaaatttcaggaattatcaggaggtaatctttggggggcattatttagtctatcatgatgtgtctctctagtctttttttattttattttttttttttttttcactttaggctctgggatacatgtcctaaacatgcaggtttgttgcataggtatacatgtgccacagtggtttgctgcacctgtcagcctgtcatctgggttttaagccccacatgcattaggtatttgtcttaatgctctccctccgcttttcctccacccctctgataggccctggtgtgtgatgttcccctccttgtgtccatgtgttctcattgttcaactcccatttatgagtgagaacatgcgatgtttggttttcttttcctgtgttagtttgttgaggttgatggttttcagcttcatcaatgtccctgcaaaggacatgaactcatgcactctagtctttgtacctggtgtttgcacttcctggaacaccttttcctgccttctttgccagggtaactcctagtcaccctttagaaccccgtctcagggtcttctgctctacaagaagacaactttgtacctaatctttctcctgctccattgttctggcaatctgcccctcttccttgcttatctaatatcttgagcctacacatctagtaacatttacctcacactgtattgtagttataggtttatttttcttgcctctgtagtccttggggacaggagctgctgtaatttgatggatgcccaggataacagggaccacagcaggaaccttatctcacaccatagaggcatcccaaggagaagccctttgtcctgatttccacgtagccttccttgttggcctggaattacatttcctcctagaaactgcagtccattgggcttcagcttgtcaaggtcccgtgttttcctgtcccttcgactgtctaattccctctttgttggtctgctgtagattagcctaagtaaaagtgaatagacaatttcctattaacatttatattgcttttcttttctatttctcggcaaggccctgaaaactaggatggctgtggaaaaatgttgttttatctaaataatgtccctactgggggctagattctggcttttggctgggccttggagaatggtaggtgtggtggacacatgagccccaggaaaaaattaaggcgcagaggtcagtccagaagctgcagattacattcagcaaatgcatattgaatgcctactatgtgtctgcacccatgcaaggtcttagtgcatgtaattcatatctagcatttattaagcggttattatgttcccagcacataatatgtgccaagcattgttcctagtgctttaccttgactttttggaacaactctgtgaaatgcagccacagttattggaggagatggcagtggagccggctcttgcagatgagaaggattgggacaggtttttatgacagaggagaggaacactcacactaatgaactagcaaaatcgcaagacacaagtagattcagacacccatgagcacaagaggccgacactcaaatatcccctaagaatctgattacttcattgtgccctccccttttgagctgtcaccatggattccacttgcagcaaggactgccatgttgcttccctatatccattgtcccttttctgcttaggaacagacttctgcttacattcaggagagcaaagcagccagataaatgactgtctccctgcccctgtggcagttgggcatggccatggaacttcagggaatccacttacaatcacttttgctgttgagatgtgtccccgtttttggccttctcttccactacttttggctgccagcctgcaacaaggatgttgatgctctagcatgatattggacactgaggggcctcaacctagagctgaggatggtaaagcagaatgttgggatccagggaagtcaatggcactgttaaatcacgttccaccctacactaccaacctcctgactttctggatgtgagagagacataaaagtccctttggtttaagccactgttatcaggaatttattgtcacgcgctgccgagactaattgcagtggatgcactgttctgtttccagcaacctccttttcatctgcagaagtccacattccacctttgctttatgaaaacttttggcctccaattcccattttcctttccatctgttgccgttcttctgaaaacaccatcatggacccatccaatcatgtatcctgacagcaatgtaaaggcatcatttccaagcatcttcaggtactctccctgtagcacctgcgttcccctccaggccgtgaccactccgagtgtgatccaggtacaaaaagcatcagcatcacctgggagctgctcaagaagacacaactgcaggcccatcccaagattatgaatcagagcccgcattttaacaagatcccaggaaatccatgttcctcttacagggtgagaaacactgctgtcaacgtctttgtcctcactgccagctgctcacctcagaccacggatgtggaaatccactctcgggctacaccctcctgtccctccaggtctctcatgccttgtcaacctttcctacaagcttaaaaggtacctaaactactgcagattgctacccactcttcccagaacaaaataattgctttcacacttccctgcttttgtttctgtttttccctctactcagaatgtccttcaagacctctgcctacttatgggtttcctactcactcttcaaggccagctcagacaccgcctccaggccaccagcatttgggggagagggactgtgcctctccatcaataagagagcaccacagtgggctctgaacagcttcttcacctataaaattcagagatgaagtccaccgggactcttggatcagaatcaatcctctatttccttgaacagagcatagttctggcacccccgccagccctcatgtcatcccattttgcattttatttagtcatttacacacataccactttggattgtgaggcagcattcagccttccgcatagtgcctggtacacaattaattctctggacattgtagttaaacttcagtgaatggtgacacttgagtggtcaagttgatggtagatagtactgggtgtttttcctagagcatcgattctcaaactccagcatgcatcagaatgacctagaaggcttgttggaaccccttcttctccccaagtgtctgagttagcaggtcttgggaggcctcagaatgtgcatttctaactactgtgtaggtgatgctgctgttcccaggacaaccctttgagaaccactgtccttaaggaatacgtagatttgttgcctttcctggaggcaacaaatctcatgctcctggagagaaggaaacaaatctatgtactcgttaaggacagtggttacattagaacctgcaatgtaagtcagtggttgcatcggaacctgcaatgtaaatcaatcttgaaaatagacaaaatagacatgggaattaaatacagagaaattagatcaatggatgaaccaatagagaagtgactgggatcaagagtgctttggagtcttgtttttcaatttttttccaaacaaattcacctaaccttagatgctgctgagtgtaagacatggcattgttttacataaagccaagaaatcttttaattaaatcatggcacaatttttttttatccctttgaatctttcttttatgcttattgaaagaactattttagacttgggtttttgtcatattttattgctatgcctacacataaagaaaagtataggcaaatatattggttcagatattgcaaaagcttctttgcttggaatctcactcttcagaatctgtttttcaactcagtgtcatctcctgcatctgtctacatcgtgccgtcctctgcatcatcatgagcatggagcatttcttatgaaaatcctgtgaagacgacacttaacccactttgcagctctgtggagctggcctcctcctggctctgcttctaggaatgttgctaaacacatctggttctccatttcttcctgcctcttcccacaaccatttggttcatagcggttaaaagaatgactcccttcattgtctccgggattttcactgaagcctgtgacacccattctgcgaagaggtgaaggcactagtggaaacagctgtgttacccctgctgtgtggtctccagtgattgctcaaactttctcgacttcagggatgttagaatgtgaaaaatagtttttcttagaaacaataaagcttgtaaaatgctctctacttgccgagcagatgttttcaccatcatgggttttcatataaccagtctcagttcatatttacatcggttgttcaaggtcagctttgggaggtcagcctacagaggaggaccccgagtctctgtcaaacttgcaggcaggcattcgttcactcttgaaagatttatggagttcgtgctatgtgccagtcaccaggggataatcagtgaagaaataggtatataagattgagtcatttaagtgttacggggaagaaagtaagtcaggggagcagggtgttagggaaagctttttgaacagacactagagtgaagtcagggtgcacagcacacaaatatcgagaggatgcacgttccatccagtggacattgcaagtgtgaagttcccgtggcaggagtgtgcttgtcttgttggaagatcagcaaggaagccagctgggctggatgagtggacgttcagtaaaggttcagtaaatggccctacctgggatgtagctgagctgaaatgtccatccagatctttgagttctaagctaagggtttgttggctgggcgcagtggctcacgtttataatccctttgggaggctaaggcgggcagatcgcttgaggctaggagctcaagactagcctggccaacatggtgaaatcccatctctacaaaaagcaaaaagaatacaaaaattagccgagcgtggtggtgtgcccctgtactctcagctactcagggggctgaggcaagagaatcgcttgaaacttgcagatagaggttgcagtgagcagagatcacaccactgcactccagcctgggtgactgagtgaggctaaggcgggcagatcgcttgaggctaggagttcaagaccagcctggccaacatgtcaaaatcccatctctacaaaaaaatacaaaaattagccgagcgtggtggcgtgctcctgtactctcagctactcggcagcctgaggcaagagaatcacttgaaccttggagagagaggttgcagtgagcagagatcgcaccattgcactccagcctgggtgacagagtgagtgagactccatcttaaaaaataaaaaataagtaagggtttgtccacatgcaataaagtgtgagaagccactgcagattacatccttctctgtttactgcggtgagttgagtcttttaagaaacaaatgtcttgattaatccagccccagtagcaaggcatggcagaaagatatgcttattgctgtcatctttgtgctgcctaagaaacacccacagtgtctcattcctgagcagcggtttaactcacccaggcaaggatgaccacacatgtagggtgaaaaggatgtgacagagaaatacaaacatttcattcccagtgtgtgttctcaaaatagaatgtgggactttcaactctttcttctttgaagaacattgttgagagaaagactctgcagcgcaccgcagaagaaggaacagagatctgagttttgatcccagctctgccaataattagctgtgggactataaccattagagttcagttacagacaagaggatgcatgagcttcaacagaaagagatgtatttcctttttttttttttttttttttgggacagagtctagctttgtcgccaggctggagtgcagtgttggtcaggatggtctcaatctcctgacctcgtgatccgcccgccttgggctcccaaagtgctgggattgtaggcatgagccactatgccctgccaatgtattgccattcttaagtgccttgaagaatcctaagaggctagagacaaaggtgagaaccatattgaaccagaccaccaaggaaactgtggttaagaagccatggggtggctgctcccttacggaccctgctgtatctgctgagatctgtataagcaggacgagaaccatactttttgatacttgagaagtttgggactggactcagagctctaacgacagctgcctcaaaaagaaaataacatcccttgttcatgcttgccagaaaacggcagcagaagcaggcccaagggcatcctctacctcctggcattcatttttgcctctgtcatctcatgcaggtgtgtctgcttggtggaaactgggtttcacaacagagtccaagatgtaaaggagtttggaaaatgtctaatgtggcttttgatgtatgtaagggaaatatttaaggcaatcctattgtaaatgagagaggataaagggatacaatgggagttaagtgtgctgcagttcactcgaactggtaaaatgtcagccccagttgactttgataaattatgcatatgtaatataatacctagagcaactgttcaaaaagctatacaaagagatgcattaaaaaccaccataggtaaattacaatggaattctaaaaaatgttcaagcaactcacaggaagcaggaaagaccacaatgagatgccatttcaaacccaccagcatggctaaaattaaaataaaacaaaactaacaacatcagatgttggtaagaatgtgttgcagctgtatctctcacacattactggtgggaatataaatggttcatcccctttaaagaaaggtctgctgatttcctataaaactgaatagataggcctgtaatcctagcactttgggaggccaaggcgggcggattgattgaggtcaggagctcgagaccagccaggcccacgtagtgaaaccttctctactaaaaatacaaaaaattagctgggcggtggtggcaagtgcctgtagtcctagctactcaggaggctgaggcaggagaatcccttgaaaccaggaggcagaggttgcattgagccgagattgcgccactgcactccagcctgggcaacagagtgagactctgtctcaaaaaaaaaaaaaaaaagaaagaaagaaagaaagaaagaaagaaaaatactgaatagatatctaccctctgacccttcagttgcagttgtagttatcgctggactatgaaactgttattgcaaaaacagcccaggtattcatcactgagagaatagataaataatttgtgttccgttaatatcatggtatgccactcaccaagcggtcagtaaaaacagattagcaatacatgaaacaacttgaatgaattgcagaaacttgatgttatgagagaaagcttacccaaagagtatatacttcaggattcctaatagatcgagtttggggacaggaagaaccaatctataacaaagcttaatcaataagggattgcctatggtgggaggatgcagatattgtcagagaaggagcttgagggaacttcctcatcactccagaacgttctgcatcttgaaaagtgtttgggttacataggagtatgcattgtcaaaattttcccagtgatttgtgcatttcattatatgtaacttttaccatgaaggcggggaaaaaacccataaacattattgaatcctggttaatgatatacatattaaaatgcctaggaagtaatgtgctgctgactatcttactgttttgaaatgcattaaaaaaccaaagatgtgttgatagatggatagaaggataaatatgatagaagcaaatatggtaagagggtcttggtacatcacaggggcagctatatatatgttcattgtagaattctttcaactttactgtgtatttggaatttttcataataaaatattagggaaaaatctgaaaataaaatcttaggatgtgtggtaccttccttcatctgcatcaggtggcagttgtttgttaagaaaatcacggctgggtatcccagcactttgggaggccaaggtggatggatcacttgaggtcaggaatttgagaccagcctggtcaacatggtgaaacgctgtctctactaaaaatagaaaaattagcagggtatggtggcgtgcgcctgtaatcctagcttctcgggaggctgaggcacaagaatcacttgaacccgggaggcagaggttgcagtgagctgaggtcttgctgctgcactccagcctgggagacagagtgagactcatctcaaaaaaaaaaaaaagaaagaaagaaagaaaaaattactgcagctatctgatcattgctttatgggacaagggtgatttttgctgaattgaatagagagtatacaaaattaaaattttaggagactgaaataactgggattggggatgcagcctggatatagtattcactaaagatgctcactaagcacttaattaatttatttcttttactttgtaaagataagcccaaaggttcattctctaatctcatccttgctcatgcccccaaagtcagtgctggcatgcaaacacgaccactagtcatcttttagataaggttcaatgcaaacatttatagttggaagagactagggggctacctgatcctatttttttcattctccctactccctcccttccccctcctgtctctccacaccttctctctccatgtatgtgtatgtgtatgtgaatttacctaaatcaatttggtcatggacaactcttagctgaatttgtaggtaatagtagtggccaaaaagttgaagatggtggaacctcaaactagaactttactaacatattgtgatgaaaaaaaaaatattccaccagattctgccacacaaagagacatttattgatcaaacgttcattagtaggcgcacaatgattcaaccaacagtagagatatgtctctgccctctgtcctttcagatgctctgaccactctcttacagaaaggttcactagaggcaggtgtgacactgtgacagggaccattgctgtcaccctcatagttggcattaggcaaacagaatttctcctaagcagcagctggaaacagaatagctatggatcaccccttagacagcatcgctaagaatgttggtgtcagcctctctagattttccttctgtgttatgaaaaggtggggagtatctctaatattactgtagccagtccacgttgttggtagcactttatcttaccaatgagagctctttcctaacatctaacatgtcatttgacaagctgctaatgtcaccaggaaaaactgattccagaattcactagatcaagacagtggtgacagagggagccacctcaggactgtattgggcctcaaatactgtgagcagatactgctccttcctccagggtgggtccctgagtaaaatggtcactggctacacctgggttgcactgcaacctaagacttatgtaaagtctaccatgacacacaggcacaccctacagcgtgcttctgggttgaggttttcttttcttttttctctctcttttttttttctttttttaatagagacagagtctcgccccgttgcccaggctggagtgcaatggtgtaatcttggctcactgcaacttccgcctccggggttcaagtgattctcctgtctcagcctcctgagctgctgggaccacaggcgtgcgccaccatgcccaggcaaccttctgtatctttagtagagacggggtttcaccatgttggccaagctggtctccaactcctgaccttgtgatccgcccgcctcggcctcccgaaggctgggatcacaggcgtgagccaccgccccagccatgggttgaggttttcatagtagaatgactcttgtttgtttgttttaatttggtaaattatatataacacaatgagagctctttcctaacatctcccttccttccctccctcactccctccctctttttaatttttttttttttcatttcagttgctttaaggttacagatggtttttggctataaaaatgaattgtgtagtggttaagtctgagattttagtggacctgtcacccaagtagtgtacattgtacccagcgggtagttttttggctctcactccctcccagctttcccgcttctgagtctccagtgtccactgtactgctctttctgcctttgcgaaccgtagtttagctctcacttgtaagtgaaaacgtgtggtgtttggttttctgttcttgtgtcaatttgcttaggatagtggcctccagctccatcgaggttgctgcagaggaggtgattttgttcttttttatggctgtgtagtattccatggtgtatatgcaccacattttctttatccagtctactgatgatggacatttaggttggtcccatgtctttgctattgtgaatagtgctgcagtgaacatatgtgtgcatgtgtctttataatagaatgatgtctattcttttgggtatatactcaggaatgggattgcaggtttgaatggtagttctctgcctttttttctttaatacctaaacttcataaaaagtacatatgtcatatttttggagtgatgtgtacatacagagaatttatacttacattgtaaaaattgatacagtacttttagcaaaatgatgtgtgtgataaatattgagttacagaactgataaaattggtagaaagtcagaatgatatatacacatattgaaaaccttaagcatcagcagaaggataatgagggtctaaaatggtgccattggccgggcgcggtggctcacgcctataattccaccactttgggaggccaaggcaggcagatcacctgaggtcaggagttcatgaccagcctggccaacatggtgaaaccccatctctactaaaactacaaaaattagccatttgtgatgacgggtgcctgtactcccatctactcaggagactgaggcaggagaaacacttgaacctgggaggtggaggttgcagtgagccaagatcgtgctgttgcactccagcctgggtgacagagcaaaacttcatctcaaaaaaataaaataaaataaatgttgctgttattggggaaggccgtgttactgcatgcatagcccctgttggctgatggctgcatgaatagttttgagatcaggaagcagtgttttaagcattttgcatcctaacaagagaagttgtcatttacatacaactatctaatggtattttcttttccattttggacattgattggaaagggaagtgggcagtttgcttagcatacaataaattttaatttttaattataatttataattttaattataatttgtcctacttaaaataataggagattggttccgtggtagccttttggcacaaaacattttattttcagaaacaaatcagtgatgtaatgagggagatacttttctctaaggtctattcaagatactgtaaaccctcttcacttaggagaaaagaaatacgggggtagagggaggaagagaactgctctcctagagtccagggagctgcctagagaagacgagagtccacccctcctaggccaaggctgttctaagttccatatgggtcttccattgtcttcctgtgagacccattgaaggatctgacccagacggtaggaagaggctaattgttaagtggattcatggcctttgcaaatgcttattagaaatcagccatgatggtccaggacatgctgggaatcttagattaatggggcttagcagatttttatgtctgaacctgcgtagagatgtatggatgtgagcagagaggcatgcgttttgcttgctgactgacttgtttcctgccccatgaggagccatattccagtcttgagcttgcgtagtttcttactgtgcagtcaatatttgctggtgagaaatgagcccactggtactggtgcatctgatcctctgccgtgcttattctctctgtgatcaatgtcgtgtgcatggcttgtagtgttagggcagcaacaaatctatttttaattccctcttccttcccatcttttagaaatgggtgaaaccatttctcctgacgagtaagcctcttctcctcctccctccctccctctctcctccctccctcaaaatgtcaattggattaacatttgcagttgtggctgcctccacatctgctaacagagcgtggctggactttggaaaacagttgcccagagccattctggggtttctatatttatttctttcaatgacatccatagcaaatttgcactgctctcaagccaaaggttgatttgttccatgggctgcccagtcaacctggggtccccctggagatgaggacttggggtctggtgccctgccagctctggtgtaggttccagagctaggaaataactggcaggcttgttgtggaggcgccatggcagggtccacatgagcgcctgctctgtgttgtggcactagttcagcggtactttatgagaccaggagggtgatggatggagccatggaaaggtgtgggtggagggagggacaggcatgtaggcagaacagcaagaaggtgccagcctgcaacatcgagtgccagcctcatcagctagcggggcccctaatgtcagatggagacagcccccaagccagcctccaccttggctgcctttgtcaagtgggcctcgggatttctcttaccattcctttttttttttttttcctcttctctggtctctttgccttctcactctgtctgccctcaccctacaaggaaaggtccttctccctttcttttcttccctgttttccacacttccctccctctttttccccaggtctctagtagaaggagcatgaggtgtgtttgaattccacctcctgttgatctttgggagagtaactcaggtcaggcttcttccagccttacctggggatgtagatacctatttctggggttgctgggagggctgaatgacaaacttttatagccgttacgttcacatagcacttactggtgcttcatgggtatacttagttagtcctgaggacagcccatgagatgggggccattatcttcagtttataaaggaggaaactgaggtctaagaacattaaccagctttctgaaggtcacgtagctgttacttcattttgcctaacttttctttctttttgtcatttctactttttgggttctgtattccctcttcctgtctccatttcctttctgcctttttcttttgccccaggcaactcagggcagcctggccacagagtaccctctcttacccttcataccctgcggagcttccccttggaagcagccagcatgagaggaatggaggacggatgtctagtgatcatgtgggagtgaaagctctgtaatgtgtaatgtgaaagatgtacattataagtatctacaagattagttattcatatcatttttccctcctttttttttttgagacagagtctcgccctgtcacccaggctggagtgcaatggcaccatctcagctcactgcaacctccgcctcccaggttcaagcgattcttctgcctcagcctcccgagtagctgggattacaggcacccaccaccatgcctggataatttttttttatctttagtagagacaggttttcaccatgttggccaggctggactcaaacccctgacctcgtgatccacccacctcggcctcccaaagtgctggcattacaggtgtgaccttctgtccattttaattctcccccacctcacctttttctttacatttccttcttctgagcattttgcctatctcttcttctttctgtcatttctactttttggactcctcaatatattccttcttcccagtacccatttcctttttgcctctttcttttgcattccccaaatcacttctcccctaaccctgttccttgcctgtttggtttttgccttcggtcacctctgtctgtctcatctctctgtgttttatctgtcacgatattggccaaaccaagccctggaagtgcgctgaatgcggcttcctgggcattcatcagggtgtgctctggagttcttcctgcttgagcaactgtgcagcatccactgctgctgagaatttaacctcaccagagtcaggaaagttctgagattttgcactcctcataaacttagccagcctgacacacatgtgtgtacacacacacacacatacacacacaggaggggggagagagagagagagagagagacagtaaatttgtcagcccttgcagtagcacgcatttctaaatatgggcatagtaggaagagagatggttactgtgggaactataacttttaatttactggcctgaagcgctaaaccagggcttgatacttaatgtagtgtttttacatttagatgtgtgcttaggaaaggcataaaacttttcaaagctggggccagtgctgggggaggtcactgaaggaggttcaggagtggtggaaaaattagggaggtggagtgggcccactgggaccaatcagcgtgccctaccaatcagaagtggaagaaatagacacattatggacagcacagttggtcaggataggaggcttaatgaccagcccagcaagggaggaaggctttatgaccatccctccacttgcaaaggagaccaagatctggagagaaaggatgatacggccaggggaggaggctgaaggtgcatgacttttggaagtctgagttcaaaacaatgcagggccgggtgcggtggctcacacctataatcccagcactttgggaggccaaggcaggcagatgacctgaggttgggagttcaagaccaacatgaacaacatggagaaaccccatctctactaaaaatacaaaattagccgcgcgtgatggtgcatgcctgtaatcccagctactcgggagactgaggcaggagaattgcttgaacccaggaggcagaggttgcagtgagccgagatcgcaccattgcattccagcctgggttacaagagcaaaactccgtctcaaaaaaagaaaaaataaacagtgcaacctgcaagggatttggactctgacactctgagcttaaagtaatgatgaacacttaacctactgcttcctatgggctagcactgtttccagcaagttagtactcacccatttaatcttgaccacagctctgtgagggagggactcttctcacctctactttataggtggacattgagatagagacagcgttcgagtaggatctcatcccaaggagcctggcttcagggttggtgcatttcattatctctgttttgttgcatttaaatcctgacattgttacttacttgctgcgttatcttggatgagtttcatcacctctttgagccttgactttctccccatgaagatgagggcaggaataccttccatgtgaggttgtggtgggtctagggagggaataagcatatggaagttctctgtaggtatgacattgtattatgtttaccatcaagagagaaggtgagtggaggctccgtcagataaagaataggacaaatattagtattcggtatttttacttgttaagtgggtagcactcaggttggcatcaggcctacctggtgaacagcaggttctcttcccacctcccacctcttccgtcttccatgtgagtgggtgcatcggtcccgagcgctcctcttcccctcccatctctccacactttccctagcacgtgacataactgagaagtcaataacacctgctggggtgtgtcagcctggcagaacttctggcgtggctctcaagaacatgcgacgcctcctggaaccttcactcattcaacaaatgtctgcttcgtgcctactctgtgctccctgttgttctcagccctggggatatgttaatgtccaaggcagatgcagtctttgccctcataatacttagtttccagtaagagaaatggataagaaccaagttctatcggctggtaatgaatattatttaaaaaaaaaaaaagcagcaaggtaaagggatggagactgaggcatcggatggagagtaggattttagaaggtcagagaggacttctttgaagaggtcagcttgaggccatgcacggtggcacacgcctgtaatcctaacacttggagaggccaaggcaggaggattgcctgaagccaggagtttgagaccagcctgggtaatgtggcagaaccccatctctaccaaacaaaaaaaaaaaaaaaaaggaagaggtggtcatcttggagcaggaagccaagcaaagatctgagggaagaatattccagatggaaggagcagccagtgcagtgatccccaagacagaacaagcttggcatgttcaagggacagcaacgaggaagagatgggaacagagagttaggtcagcatccgtgatcgggggcctcacagatgctagcaaggagattgagctttgttccaagtgcagtgggaagccactggcactggggttgccagataaaatagaagacagcttgttaaatttgaatttcagataaacgatggataattgtttagtttggacataattgaacatcctatatttttgtttgctaaatctggcaaccctacactgatgggctcagagcagggatctgctgtatgcagagagcattgggctggaaggaaaactgcagtcaggagaccaggaagagaagggcgccatagtccccaagaccaaagcatggctggtctaggccatgataggccaaatggacatgctgagtagtgtttggatttgggggtatgttgtgatacctgtgcaggcttgttaagttattcatatcatttttgttttttttttttttttttttttttgagatggagtcttgccctgttgcccaggctggagtacaatggcatgatcttggctcactgcaacgtctgcctcccaggttcaagcgattctcctgcctcagcctccccagtagctgggattacaggcacgcaccaccacggcctggctaattttttgtatctttagtagagacagggtttcaccatgttggccagtctggtctcgaacccctggtcttgaacaggggttcgaaccaggggttgttagtggattgggtacaccagggaaagagggcggtcagacagaaacaatcctaagctccagttcacagggagggacattgagcatctcagggcccggtcagctgtgcaccaagtcgccacttgtttgcctgagcccaacccacatatctctagatgggttagctttaggtgcccacaaggaaagagagtcggctgatttaatttgccatggcttgctgcatttttttgaactctcagtgaatttatatgcactctgtatagatagatgagtcgataaatactaccataaatgaattcatcatcttttgagcacttatcctgtgccagattctctgctaattaattgctctgcatgtttgtctcttggttgagcctcacaacaggtggggttgtgcagtgatggtccacattttacagctaagaaaatcaagactaaggagagtgtgacacacattctactgtatttgctttatagtgtcatggttatttctttgtttcctgaagttttgttggcacatgtgtctcccagacctatagtcagctctcagtgggaacattgtttagatgagggcgcatcttggaaagctgcctcaatcctaaatgctagaattagaacccagttctgattccagaacttgatagagcagtgttcacagacttgagtggaaataaaaaatacctagcaaatttgtttataattcatatgcttgagtctcatgcctaggattctagttcagtcagacagggggcataacctaggaatctgcattttaacaaaaccacagttgattcagatgccattattcttgtatctgctttgggaaatgctgtaggactttgccttaattatgccaaagagaaaaccctgtcccccaaatgctcccaaggaatatgactgggttctataatttggatattagggatgcacatttgactacaggttgatgtcactcacattcctgtttttaggcatttgtacatgctttattagatgcctctaggaagtgctttgttcagcatttcaggcaggatggctgggatttcttttgtatattaataccccctggcatttgttcagcacttcatccagtgcccagggtttccaggtcaccatcacactacctctgtccaccctcttctcatctccagggcatatgccagctgccccagtcacagtcttgaagctcttgccctttccttgtgtgtgtggtttaggatgggttcccattggctgtgtttccatcccatctcatctcaagggaaatctctggtgtgaggagctggcagtgctaggattggtctgtgcttggtggctccaccccccatacacctgaaaatcctcagaatgaaaccaatggtcatggagcctcagcagacatcattcatcaccttgaagaagtgaaatgaaaggtgaacaaccttggttgaaaaagtgggggaagaagttgatctgaatcaactatggtttgttaaaattcagattcctaggccacacaccccctttttgatggaaaaaagggaaggccatcgctgtaagaagcacatggggttgggtggcatcccgggatgagctttagaatgagttctcagcttcttagctccaccctggctggcttggcgatatttttcttcatccttgcatgtcctagtgaggaacttatcattatgcacacagtagcttctcctgagctaggttctcaatttcctcagttccgcatggagttacaggcaaccaataactgtccctaaatgggccatccctttgttaataggcagcgtgactcaggagatcagtgaaataccagattcattctcaaaggaaaggttctcagggtgacttctatgggattttctcttctatccgtcttgtttctcgggggcagatcagggcctgtggaagccaggggtgcgaagggtataaatcacatgagtagtccgaggctgaggcccttctctaggtccttgcactcccgttggccttgataattgtgtcatgtttctcttacgtaaatttgttaccaaggtgttggtggtggggagcaaggtcagagaagggagtggatgacatagagaagggattccagtcacacaacagtgttccttccccaaacacattccacattcaccgggtgtacaacgtgcaatgatttctgttgttgctgacttaagagcaagcacgttcggtactaaatcttgcctcgtgtcttattaaagagcagctcactacaaaactgttagtatctcagaatggtttactctccacaccttcctaccctcctggctgtcatgccaaaggacagtcttccagcgagggctgtcttgctgctattactacaaccactggtgatgctgagattgctgccatggaccagactgtggtggcgctttacctacagtaaacccccagctccattctagtacttctggacccaggctgggcttttcatcaagggctccagagagagtatactctgttttcttggtgttgtatagtcaacttactgggaagagaaggcaatggaccctgactggcagagttcagatagtatctctgtcatttagtaactatgtgtctttgggtatattgcctaaccattctattcctcagttttcctctatctccatctatcttctgtctatcgtctgtctgtctgtctgtctgtctgcctgcctgcctaaccattctgttcctcagttttcctctatctctacctatcatctgtctgtctgtttgtccgtccttccgtctgtccatccatccatcctattgattctgttatatataatatataaagagatttattgtaaggaattggctcattcaattatggaggctgagaagtcccaagatcttcagtcagcaaagctggagacctaggagagccaatgatatagttccagtctgaaagccaacagactcaaaacccacagctatatttctgttcaagtttaaaggcaagaaaagaccagtgtcccagctcagctgtcagacaggcagtttctttttactcagcctttttattctactcagatcttcaattgattggatgaagcccctccccgttagggagggcaatcttctttattcattctaccaaatcaaatgttaatctcatccagaaatactctcacaggcacacccagaataatgtttgaccaaatgtctgggcaccctgtagcccagtcaagtcaatttattaccaagacagattgcatcgtatatcttatggtgttataaaataaattaagagcacaaaatggctagaacaattcttgtcatataggagaccatcagtatatgttacccattatcatttctatcatcatctttgtctttgccatcatcattgttttcattactaacctgaagtgggttggagccagcaaacttgggatgggaccactggctttgttccctaccattggtatggccttgggcctgagcctcagtaaaataaaaccatatgtctctggttttcctctgggttcagatagcatagcagcaagctcacagcagagtgcctggctcacagtgggtcatatacttgcaaacatatttgtaccaagtttttactctatgccagccactgtgtgtgttactagagaatcagtaattcaaagattcatggttcctgatttcagagtacctactatttcccaagagcttagatgtgatgataaaggatttcatacaatgaaagagttgcggaaatggaagatggtatgagggcagaggaaccaatcaggaagtgccaatgtccaccagcaggagtcaggaagatttctcatggatttatgatgagggggacttgagagttgagtaagaatttcccatttgggggcaatggcagaagcctgggtgacagggaacagcctggggtgtcctggtgcaggagaagaagtgggaagggtgggagaaggaggccagggccagatcacaggtcgtttggacacaatttcttcaatttagtgtcttgccatcccaaggtacaattttcacagaccactgtgttaacgtcaattcttttcattttaatattacttaaatgtgcaatttggtgcagcctctgtatagggagagcctgcatgaactggaggagtacaacagatttatataataaattctaagaaaactataaaactaacaaagtttaagttatgagcacgttaacgtgtcaggtgatgctgtgttaatatggtgtggatcactttggcatggaatttgcagtgtccacgcaccacaccatggctcatatttctttccagccagagagcacccaaccactttgcgtcagattcttggtctttgcatggtagaagtgcatcatttaggcatctagccttttcctgttatctgctgatcagcctggggcagttaaggtagtgggtacaacctggggctagcatgagcatagacttaggtgtaaaagtgggctgtgacattgggctccgctaaaagatgactgtccagatgaccctgaatgtgcctctgtacatttttaaaaagataattatcaaagtaagaattgcaaattagcaaacacttttagaaaacacagaaaccccagccactattgcatttgagacgtagcattgataaagagaaattttggagagatctggtggattaaatcagactaatatagagtgggagactgattattgttattgtgcaaatgatggtgatctttaatagtataggaaatacttattctagcaagtgcttaaattttgcttctcatgtgccaggtactgttctgagaactttatgtatgttatctgttttaatcttcactatacctgtatgaggtagatgttgttagtattctatttaacagaagaggacgatgaggcccagaaatcttaagtcatgaacctaaggatacagggttaataaataccagacctgggacgtgaaccctggtagttgggcccttgactccttgctcctaacaactgaaagtatgaattaacatttcaatgcctgttttaataactttctacacaaataactaatggcccattcacatcatcccctgcaaatgttttggggtgacaacttgttaaaatttaatattcagagcaatacagccccagctatttgacaatttcagatataaatctaccttaaagatgtacaagtacaaattatgcaatttgatttttaagtgcttttctagcaatataaataataaagtgtgttggaactggcaggtatagtacattaaattgagtgcaattaaaacactgtgatatttttaaattaacaagaaaaaaataagtggcgaaattaagaaacctgaatctgtctttgcagcctcctccagctgataactgggtggatgattgcagagggtattagtaacatttatactctggatttcaagtgtgatggttgtcacatttaacacaaagagcacttcaatttcacttctgcataacaggcagatgacatttcccacaacataatcttttcagttttttttttttcctaaagcagatgataagggggtattctgagaagacatctgagttgaaataatgacttgccttgtggataatgtctcaatgagacatctgaaagtcaagattctctttgttagacgcaggaataatctgcatctttcacactcatgggcggccttcaccctctccaaaagctaacagtctgttcattggaaaccaggaagatggtgcaactgttgaggttgtttttcacgaccttcccaaaggtttgatatggacagagtgagatctgctctcagccggtagttattgtaaaaataaaggctgatcaatacaaatttgtgcatcaaaggtctcttctgccccccaccccattctggagttagaaatctcccaaaggtttgatatggatagagtgagatctgctctctgtcagtagttattgtaaaaataaagcctgatcaatacaaatttgtgcatcaaaagcctcttctgcacccgccccgagccccattctggagttagaaaagttcaggcgtagatcatggactgattttgtcatacacacacctgtacctctgcattgtttctgaatgtgttttccctggaacggaccatctcgcttacttctccacttactgccattacttagggcccttcatcagtgttcacagactccaagggaactctgtgtttaaaactggatgtatgacctgaagcacattgttttgagtggaacaaatcagggccatgagccactttagactggaatgtgatcccctccatttgaagtccccacagctgccgtaataaagtaccacaaactggatgactgaaacaaaagaaattgattgtgtcccgcttgtggaagctagaagtccaaaatcaaggtattggctaaaccatactccttctggagatgccagggaaggatctgtgccaggcctctctcctaacttctttttttcttttgtttgtttgtttgttttttgagacagagtttcgctcttgttgcccaggctggagtgcagtggcacgatctcggctcactgcaacctccgcctcccgggttcaagcaattctcctgcctcagcctcccgaatagctgagattacaggagcctgccatcacacctggctaatttttgtacttttggtagagacagggtttcatcatgttggccaggctggtctcgaactcctgacctcatgcaatccacctgcctcgacctcccaaagtttgggattacaggtgtgaaccaccgtacctggcctttctcctaacttctgatagttctttggcttgtggcagcatgactccaagtcttcacaaggcattcttcgtgtgtgtgtgtgtgtgtgtgtgcgtgtgtgtgtctgtccccaaatttcccctttatataagaacattggttataatggattcgtggacatttctactccagtatgacctcatcttaaccagttatgtcttcaacagccttatttccaaataaggtcacattctgaggtgctggggcttagtacttcaacatataaattttaggggtgggacacaattaaatccataacgctctgtaaggagcaaagtgtctggcacataggtgattgatttatacattcattgttcattgattgaatatctgagtgcttgagtcaggcactgttctagatactgagaataaggggatgaccaaaataaacagacttcctgatcttcagaagcttttattttaatggcagagatagatattaaacaaaaaatattatctggagagttctgcaggtggccgattctggggtccccaccgctacctgctgaattgaagggatccgggcttgctatctattttttatacaaagctctaaggttaattctgctacacactcagggttaagcatcgctgtcctaatgcactggcactatttctgtagtgatcaactatttcgttagatgcgcatcagggaaagtggatgggcaatgtacttcggttcccagcacagtgtcttgaccatcgcatggcaaaacggtcgcagatgcgcctcttcctcatggtagtcatgcagggttctgtcccatggtgcgctctgctctcattcgtggagggtgtgtcatcttacccacactctcctcggatctctgaatgtcattaagaaatgctgagagatctgggtcagcttggagaagcaggaaagagagaattagctgctagtgccagtgctgaaaatagaacttgagctgaggtttatcttctcgtctcctaagaaccactagaatggagaaattaaagacaataatgaggcttcctattctagcatcttcctagtgcacttttatgtaaagtgaggaattctttgcgatgtcagtcacccctcctcccccaaatgttctgtgtatgcatttaggtggtggtttatactaggttgtctgtgttactttagatatttcatggtatccattagcaacctatattagaatatatggtcaaattctttaagtcaaagaggagggcccagctcgaggtattgttccttctcactctgtcctttgtagggataaaaagcagctttccgcagctgtggaaatagtatccctttacgtaaaataagaaccctttccacatgcataatattgtagttttacatactggatttctcatctatatgactgtcactcttatttggtctctttttgagctctccagattctttctgaattgagtaaatacgtcccacttcttttacataaattttacaaatgcgttttttattccagttggtttctgttcctctgatctgtctgctggttttctcatattgtagatcccaatcgtcttctcacttttcctgatattagacacattgagttgtgtgctcacctgtcaagaattgactttgtctctagctcctgcattctgaaatatgtctggtactggaggaccgcgttccatctttggccataactggactaagattgtacctataacccatgcctagctaactcttgtgctcccatgtgactaatcgggtctcaagaatttggacagacaaacagggtgtaagctgttggtctggacaggagaggctgactcagggcaatggtaccactttggcaggcatccttgttcccatgtcgactggagaggcaggcacccttgggcaaaagaatttatcagctggtagaaaagagagaatgctgcaaaccccagataaagcacaagtgagaaacccttaggcttctgactgagggccatggtggggcacagggagagaagagagaaggagaaagaaggagagaggagataaacagtgatggagaaaaaatatggagacagtgagggaggggtaagggggagatagatggaagagacagagataaatatggagagataactgtcgtaatttccagtgggtttccagttcctgcaagaatcagaatactttgttcctctactagttccattgtttatgtgtttatgttaaactgtcctttttccttgggccagttcgagtgagtttttcttttctttttttttttttttttttaactcctgaaagactgtggactgaatcacactaggagctgttacatcttgagaatcattttattatcctcccccgtctttttcactaaggaattgtttctcatttattaagcaattagctgcaggggatggtgagaagaacctgagcattaacacatcaacacacctgggttctaatgctggccctgccacttgtgagctggctggccctgtgcaaatggtcgaaggtctctgagccgtcgatttttttcttctgtagaatgaggataaatgatatttgctttacaacatagggttttatgaaaagtaaaacttttggaaacattttaattttccttcttttgtgatattgaagctctatcttattgctttgaagaatctgagaggtcttcttcttgacctttaaggacaggttgccaaattctggcctgcaggttaaatcttgctctctacatgtgtctgtaaatatacttctactgaaacagaaccatgtctctatctctggtggccactttcaagctacagtggcaccactgagtattttggcccacaaagtctaaaatatttagtatttagacctttgtaggaaaagtttgccaacccctgttcaaggatcttacagtcttgatgagaattaatacaatgttcttctaatatacatgttgtttattattgttgattttcttattttttttttttgttggtggtgtttttcttttcctgtacctgctgatggcagatattgtagatttagctttttattttattgtatagttttcttggtctttgatatgtattttggcttttcacttagaagtctggtatattttatgtcatcctcagttatctatcactattgttataaaatgcttttaaccagccagcttttttttttttttttttttttttttttttttgccattgaatctgtaacatatgatgtgtaggtttaacctgctggacgtattctctgatgtgcaaataatttgatgtggttggtgacagctctcagaggattctcccacctgctgctgactggcttctcattgtccagtttcatctccagaatttggtctctttagggtaaactcaagctgtgacctaagtctctgcagccggtatagtgagcagtgaatctgcataagccactttttgatgttttgtgcaaaaatatcttttgttactaaaatatcactctacaacttgtactgctagtgcttttaatgcataaaaacatagaactctctttggaaccagaatttaaataagtacttaaaaaaaaaaagaaaacctccaggctttataagaggtatggtttggtgaaaatgtcgtggattttggagacagatttttgttcacacctgaggccctttcacttaccagctgaatgaccttgggccaattatttaactttccaattatttaacttgtcttacttttaatatgctgtcctctaaattggagtgaacaccaattgtagaggctgttgaagggattaactgagaagatacctataaagcagtttgggtcataaacgccttttgtgaggggagtggttattggagagttatttagagacaattcctttggcaggtgactcaaaattgtggtaccaggtataatagaacttccttgaaccagaagtcttcagagagaaccaatttgccgttgtcattaggtcaggcagctcatcgctggatctccttgttcaccctgtttcacccacactggccttcgttttgtcttattttgttgttttttgtttcccaagtacatcaacctctttcctaccccacggcttttatacctgtccaatcagagatatgtgctgctctgccacagtctatgccctacttcccagttattctcttcttattcattccctcttgttcttcagttcttggatcaaatctcactttctcaggcatgcctttcctgaaccagtcttggtcaggttctgctcttgtgttcttttttttttttttttttttttttttgatggagtttcgctcttgttgcccaggctggagggcagtggcgcaatcttggctcaccgcaacctctgcctcccgggttcaagcgattctgctgccttagcctcctgagtagctggaattacaggcatgcgccaccatgcccagctaattttttgtatttttgatagaggcgggatttcgccatgttggtcaggatgatctcgaacattcgacctcaggtgatccacctgcctcgggctcccaaagtgctgggactacaggcatgagtcaccgcgcctggcctcttgtgttcatttttaagcaaacaaactttttttttttctgagcccctactatatgctggatgttgcagatagaatggaaatttaaaacatacactccctctcctcatttgaaacttctgcactcagcagaagagagaggtattgcgagcatgcaagcatacagatagattgtgatatcactgcaattgagctccacagaggagaaagccatgctgccaagacagctcatgaagtcaacaaattgggcgtgttggggatttcaggggagactttcctgaggttgaggaccatgggcctttatctgaaggaccaatgggagtgtgtagacagagatcctggaagagtgatccatgcattgggaatggcttgcaaaggcctggcagtgggagagatggatgagacagtttgccatacctggggcactgagagtgggagtgccatgctgggaagtcactgtcggctgagcatgcacggccttgagtcatgcaaaagagtttcgccttagtcttttgagaaactaaagctgcatggagggctgacaagatcagattggcattttgaacagctcccgctgtgcagagaatagattgggaggcaagagtggattccagttaaggacatgatagtaggtgaaataagccagtaataaacaagtaaagactatatgattctatttatgtgaggttcctagagttgtcaaagtcagagcaacagaaagtggaatggtgtccaccaggggcttgggggagggaagaatgggaagttggctgggtgtggtggctcacacctataatcccagcactttgggaggccgaggcaggtagatcacatgaggtcaggagctcgagaccagtatggccaacatggcgaaacccgtctctactaaaaataaaaaaaattagcggggtgcagtggctcacacctgtaatcccagcactttgggaggctgaggcaggtggatcacatgaggtcgggagttcaagaccagcctggccaacatggcaaaaccccatctctactaaaaatacacaacacacaaaattagctgggcgtggtcgtgtaacccaggcaggtggatcacatgaggtcaggagttcaagaccagcctggccaacatggcgaaaccccgtatctactaaaaatacacccacaacacacaaaattagctgggcgtggtcgtgtaacccaggaggctgaggcaggagagtcctagaacccaggaagcagaggctgcagtgagccgagattgcgccactgcactccagcctgggcgacagagcaagactctgtctcaaaataaaaataaaaataaaaaagaatggggagttttttcatgggtctggagtttgtgttttacaagatgaaaaagttctggagatggatagtgatgatggctgcacagcagtgtaaatgtgcttcatgctactgagctgtacacttcaaatggtaaagatggtcaactttatgttacgtatattttaccacgattaataatttttttgacaagaatggatgcaaggggatcagctggcaagctgttgcagctgtcagacagagagacctgctgagagtttgggatgtggagttgtgggtggagatggatctgagaggtgagaggggatgaattagctgtggtgcagttggcagcatggaagagtactgcttcaagggaggttgtgggtcaggcttattcaactggtggggccatttaccaacacagagaattttttttgagacagaattttcactcttgttgtctaggctggagtgcagtggcatgatctctgctccctgcaacctccgtctctcaggttcaagcaattctcctgcttcagactcccgagtagatgggattacaggcgcccgccaccatgcctggctaatttttttgtatttttagtagagacggggtttcaccatgttggccaggctgggctcaaactcctgacctcgtgatctgcctgcctcagcctcccaaagtgctgggattacaagtgtgagccactacacccgaccaacacaaagcatcttgataacaatctctcagagcaccctgtacttaccgcagtgtaactaaataattatttgggcaatcgattgtcctcctgatgagctgtaaagaacacacaggtagagaccatatctgccttcttcaccaactgtcttcagcacctggcatattgtcttgcacataataggtgccgtatagatatttatgaaatgcagatgatttggggtattttaaatctacttctctaccaactcctttggttcttaagcttatttctagcattgagtttttacatgtcagcaatgagaacagactgagagacacaggaccaggcagaaagagatcaaaatattactttttgttccaacagtttagagaatgtgtctcaaccagatagacttacttccccacccaaattggtcaggagcatagcaaacagtatcaagtcctctcctaggaacacatggcacatactgtctacaggcagacagaccctggaagaacaggagagcagggctggctgagcatggaaccaggaaagtctttctcacagacttggcaatcagatgtcactcctcttccctaggaaggaagtgggggcaagaggttaggcttgttgctctgctagagctcactcttcattgaaacctcaggaatgaggtggaagggttaatagatgggatagcttttcttgctgcaattttcggtttttctgagggaggtgttgtgagtggccaaagtctctggtcctctgaccattttctgtctagtataagaaagagcgtgagagacacgtgggtacctgtctcctcttctgtgcttatctgggacaggctttataacatctctcttcgtaggtcttcttctttctaaaacccaggggtgtacatgatgatttttttattacctaatatgtagctgtttcctaacttttggaactgcctgataaattggctgatagagcaagtgtagcttaagattgataagtattttttatgtgtggtaagaaatgtctcctaaacataacatttgaaaggtaaaacatcttcatgtaaaatgttttaggagatgaattgtcagtattctttattgtcaagtatatcacacatacagacaagaatggccaccattcttaatccatttatgctggaggttgcaattttttgaatttttgcaatcagaccttggcgatgaccttgaacggtaggatatcaataactcccacatgcttagtgttccaataatggaacactaggcatagatgggttgaaaatcttaaacgatgcttaagagaaaggacaacataactttgattctgcatgctgaacatattgcatcatgaagttaagcatttcagatttcaccatatagctctttctcttcatagccaaatgttgtgttagggattagagaatgaacggttctagctctatctagcataagctttggtaataatatggaaccaggaaaggagacattaacagcttgagggtttgaggcaggactcaactttgctgtagattgactaattgtagagtatgaaacacacatacgtgaatgctaggtaataacttttcttcgtaaagcattttacactttacgtatagtatttactttggttcagtgtttaggtgtaattgcaggccattctctagacatctcatgatggctttcatctcactcagtatggactcagcagtgtggtatctgcatgatagatggtgaaatgtagccattctgggaactggggaaatccagtaaaactcaggtggtggtgtacttcctgcagcagggaggtttagaggacaactcttttttagctccccctggcctcaggataaagttccaagttttttggtgtgcctagaaggccctctggaatctgatccacttgtctttccagcattttctttcactggtccccacttcgaccagggcttgagtcctatcacagtattttatgttcactggaagctctactccctctgatctccaaccataggatctcacattttctcattttttggtgcctttggcatctcagtaattttttcacagcacccgtaggtaaaatgaaatacctattttgttattaagcatttatgtcctaacaacttagtagctgtctgaaaaaaaggatacatataaattgaagggaaaaataccattatttcactcttatccacatttatttgcttatgggatgtatggacctgttgggcactgtacaatttttcaaactctggaattagattggacaggcgttgcacactgatttccatgcagttattgttttttatcatagcaagttctgaaaattcagctgtgtttaaatacagccaccaaaggaattagtgcattctaatgttgaaactgtgaactacctcgagctaatagttgaggctgtgtccagcatgtgctgagaattgctgcacttctctagaagttttaaagtatcctgcggtgcccccgtgggtccactttggcaccctggggcaccttggcacacagtttgggaaccatggttctaagatgttgtatatgccgtttcctctgcttgaacatgtctctcaatctagcgtcttggtgctcacctttctaatctcaacatgtacgtgatgagtcctcgaagtttttcccttaatctttaagactgagctgggaggtgcttccaaatgctacttcagcactctgtccttcaccctgctatttttctctttgcagtgtgattttatcttttttcttctactaggctttatagtgattgatagggaaagggactctgtagtgacactgcagatatttcataaatgtatgaatttaatgagtgaatgaatgagtgaataactgctattggatcttaaccagaatgagcttgttggctggagaaaatcaaataaacaaacaggttgacaagtacagggctcctttcatttgtaggagaagagtttttgtaaaatcctgaccttggggacttgcagtgtctcttgcatcctgcgacctcacatcctctttggttacacacaacggcactccctagttatagcaaaaggcctcatgaattataataccaacaacagtgcaggtcaatgtgagccttttgcatttattcatgttgtgagacattgacccatatgcatgtctctgttgagaaattgtaggtataacttgcttcaaatgtatgtgttctttcctttagagggaaatatattaagttgcctgatggctcagactcctggcatattgcagcattacagaaaatacagatgtgctgcagtaatttaatctagaggtgatggaggcttggggactctggcgcagctccagtcacagggagcagatcttgggctttatcccacagcaggtgggaaaggtctccccaggcctcagctagcaggtatttctgtttctggaactaatagaacatcaggaaccttctgataacaatgagtatcaaggaagagggatgtgcatttcctcctccagaccaaaagaactcaggtggcttttctgagctctgtggacattgttttgctttagttttgccttatccctataataggaggatactaatgttataatctaccagagatggctgtttttattactaaattgaagagcatggtgcatgaatgttggccaataataacagtaatagtaatctcagtgaagtcctgtgcatctccacttaaggagaacatcatgtcctattcccttaagatttcctgttttccctaggcctttcccataggcttaaaaatgcattttcaaaacagccctgaaagatagatggaaagctatgttcccagttaattgaagctgagggatataaaattacttccccaaagtcaacatcgctagtaactcttctgagtcctcctttgtaatggctcagttgctgcaaagcaaggggagccttttctccactctgctgccactctatgggcctgggagatgccagtaacgtagcctgaggtgttaagactcaaggttggctgaaatgtttcatgcagaaggacagaggtctgctgaagggtccttgtgagtgctgcaaattaaccctctcttgcccttccattattgcgagggaggatctgtttctatccatctttttacgccattacatacttacactacttccaaagttagaaaggtgagaagaagcagctaaatgtatactaaaagcaggttcagggaatgggaaataacaaagaggaaaggatttgattatctctggggtcctgctttcaaccttcctgtagatcttaggcaagtgcctgtgagtctctgggtctcacctgccttatgtagagtgggcacaatcactctctcttccgtacctgcatcaatggacatgagtgatcaatgcactagcacagcctcagatgctccaaaatctgtctccaagttccgccgatctaaaggagtattatttttctcagaagcatatgggagtttatttcagagaagcacccatactttacagggaaagtgacttaaccgatataataaggtaaataataagttgtcaagcccttatctcatacttagctggagcagctaaatgcctctagtgcttcatctcatttattcgacagtatcacaaggtaagtgctcagtggaagatccttaactcatctccactgaagaacacatccaataagcaaggattcctccattccctctggtaaaggagtgttcactgcccactgaatgtggagtctccagctaccagcttactttctagtactgtttagcattgctgattgcaccagttaaactgtgtgctcagtttcatcaagcttattatagcatatctttacctataattaacaaatacagtttaattaattattccataaagcagtgaaatatgagtgcaggaaggaatgtttctataaaaaataataagttgtgtattttggaacagtagcctaaaagcaaattgccttaagaagagctgtcaaataagatgttggcaagacaactgaaaaatggcggaaaagataaaaataggaaaggaattctgtactctgattagtttacacatatcttttaagtttaccccacactatgaaagaaaaagaaaagataaaagtgtgtggcgatgtctgtgatttatgccaggaaggcaaggtaggattttcagacagcgggcatgtccttatagaaaaggcctttgccccataaccaaaaattgtccaataaatgcatgtttgtatgtgataaactaaagtgttcctagtttatacatgccttaatggtgctggtaagagcatgcctgtttttacccccatttaacagatgacagtgaggaccaggggatcacgatcttaaccaatgatgaagagacccagagttaataatttatattatgtttttaatcctgttgtctgcttctgtctttcgaatgttttaagtatacttttaggcaccttttcttggccccagtggctttctcattacaatcaggctgtagtgcctacagctgacactggtatttagaaggctctgatgttttcaagccaggctaaggccagtgttcctggcttttctcctgggagtaatggcttttctgttaaggcatcctttcctgtaggaggaggagctcagtgactttcctcacagactgagataaacgtcatgatagagataagccatcagatacttagaatttgatgctgtttgcatttccttctggcttgttgtttggggctgacgcttcttagtccacaggtgcaaagatggaaaaaaagtgtcaggaatatgtgagaaggatggaagccttctttctggagaaactcatataactctcccatcatccagcaaaacaacccaggtgtgtgtatatgcgagggtgtgtgcacgtgggtgcatgcaccgggctgagtaattataacccttatagaggcttattgtggtggaatgcagccttctgggatctggagagagagaggtctcctatgtgagctctggattttgacaaatggcatattttgggatgtggggtttatttctgctgaatatctggcttgattagcgtggagaagcacatgcaaagcagactgaagccccacccacccaagcctccccagtgctgtacaatcaggaagtgcattctcactcccattgtggctttggagggaagtgtgctttacatatgcaaatgcaagccccaagtttcacttaataattatcagctggagattctattgatgagcagctgaagctactcatcagtagagaaactgtgaattaaccatttctaggccatcctggagactgctgcctcagaccagcctctgaatccactggcggttgcagaaaaagatttctgattcctcctgtgtgtcacttctcctgtctgacctgagcctggcagctgagacctcctgaccccttttattatcatgtgtgcatctcttccctgctcccacctcctttctgttttgtaggctacagaaggcagaataggtgcgtctctattggcagtagcaggattgcttacagctctagaaataatggcctcatgcactctctgcggtagctctcctgcttaggcagctgccagtgtccttttgaaagggcacaggacaacccaggcagggtagccagggtgttcagattaagatgtcaggaaattgccttctttctgattcttctttcctttcttctgcatccatgcttgccctctgagtgtaataatagtatacttgggctgctttatcagcctcgcttgttcttgctgtgccttggtagagttcagcagactgttaaaaatggtatgatttggattctcttgttattcatctttctgcaccaagttccttactttcctgaatcttgttgaaacaaggctgctgcttctctttcctgcaagtggcatcttgcaagagggtatccccagcttgttgtatagaagtacaacctttatttcctggaaagagatatttagatgcagaaagtaaaatgaaaatcgaggttttttttggagtcaatttgatctttttttttttaacttctttttgcagtaaatcttgcaagttacttaaactttacttaagcccagtgagcctctgtttctgcttttttttttcttttttcttgagacggggtcttgctctgttgcccaggctggggtgcagtggcacgatctcggctcactgcaagctccgcctcctgggttcacaccattctcctgcctcagcctcctgagtagctgggactacaggcgcccaccaccatgcccggctaagtttttgtatttttagtagagatgagatttcgccgtgttagccaggatggtctccatctcctgacttcatgatccgcctgcctcagcctcccaaagtgctggaattacaggtatgagccaccgcgcgcagccctgtttctgcttctttaaaatggggacaataaacccgtttcagagaactgaaatcactatataagataatgtatgacattcatcccgccaaagtggctggtcagtaagggagccctaatcttgatcctcatttgaaatccgattctcatcactgaactgttgcaaaagttgcttgtattcacctgcgttcttgatttagtatcaagatgtgtcttttgagtgcttactgtgtgcttggttccagaccctggagatactgttgttgaaacagatccacagaagactctgctaccattgaacttgtgttcatgaggtggagacaggcaaataaaaaggaaacagatacgtttatacttgaggagagtgttgtgatttgtggagtggagaagaataaaccaggggacagagtgaaagaaacactgtggcctcaggatgggcagagatggggttttaaaggttggcttacagatgctgctctgaagaatggtattatatttaagcagattcctaatgaacgagggaagaggcaacagcaagtgtagaagccctgagtgggagagtgcttgctatgtatcccaggagcatatgccaggccggcatggctggtgcccagggagcagaggagcattttgaggtcggaaagataactgtggttgatgggaaggcaggttcaaagccctgggttcgaacaggatagacatgtggtctgataaccagtttttttgttgttgttgctgttgttgttgtttttttaagatggagtctcgctctgtcaccgggctggagtgcagtggcgcagtcttggctcaccctccgcctcttgggttcaagcgtttcttctgccgcagcctcccgagtagctgagactataggcatgtgccaccatacctagctaatttctgtattttagtagagacggggtttcaccatgttggccaggatggtcttgatctcttgaccttgtgatccgcccacactggcctcccaaagtgctgggatcacaggcatgagccactgtgcccggccctgatagccatttttaaaggccatctggctgtgagtgacaagtagaatgagtgaggcagagtggcctgttaggtggctattgagtgagtccaggtaaaaggtcccagaactggggtcatagtggtgggggttgtggggaagtgtttgtatccagggtatattttaagatcaaaccaacattgcaatacattgctaatgacatacatgtgggacatgagggaagaaattcaggagtgagtcctagatttttggcctgtgcagtggggagcaaaagtgatgacatttgctgagaaaagaagcagaaggttttggaggtggaaatccaaggctgtggtttggatgtggggacatgaaaggactcctaagtcatcatctccttccacagtgttgtggctgtgtaggaatggccacggtgtatacacgttgtgccaggcactgggaagcacaggtgattcagcctggctcctgccctgaacaggtgttcagttgacgtgttgagacaatggaggtggcataaagagctgttacacatggggtgagagccactaccttatctacgttgtggaaggtagtaggaaatccaaggatggtgaaagaagagaaggagccaactcaccctgggcagattggagaagggttcctagaagaaattattgagccaggtgttggagggtccatggtaattcaccaaatgacaaaacatgcaaaggaaataatacaacatttttaatgcttattccaactgccagccctgcattcaggaacttggcacagggcttgtatatgtaggggctcctgaaatccttgttggtgaagatcgttggtccactgaggactcttcagagccaaaagatggaagtataaagtgcagtagatttcaccagcaatttcagaaagtttagcaaggcttgaaccaggatatcctcttggccaatcagccgcgtcatccccatcctgacactgtctctgagatcagtccctcaggtgggcctctgtcctgcaaggggcttttctttttggggtcagaaattgggatcctgtactggaggcttcaccatcataggcttccccttggtcctctgcacctgttacttcctgcactcaagcgcatcattcctctcagcttgcagaggaaaatcctgactttgccttatagtggtattgagttgagggttcttagttttattcttcttacttttataagactgctggaagcaccttataaaaactctccggtgtaggacttggaagaaaatacccgtccgtcaaaagtagagatggcgggttttgaccttaataagtattaacacaagattttacccaaacatctatcttgctcttggtaacatgttatctttgccaagtgcccatcccaataaagcgttatttctgtcaagctgaactcctgatgaaatcttctattcccctctctccctgatcggtttcgataaaacctcattcctcattctgattttctcctaagggatggtttggatttgtcaggaaagggtgaaaaaagaggtgattttttttttcattttcctcctcttatttctttttctaatatagatacttgttggaattggaatataactttaatgtaagtcaaactgataaagggtggttggacactactgtgaagaaggaaaagaagataggaaaaaggaggacagtcacttacaggcaaaggaatgtccagccaggcttttgcttgttttctcttgtttttaatttacaatggagctgaggaagataacactgatttaggtgaagtggcattttacagcagggggatgccattgaaggaatcaatgacattcacaaaagtacttgcttccatttttttttttggaatgggttagaatattctggatggcagctactcatgccgttggatggctatgttgccactgctaactttaacaagtacagagtcccccttatctttgataactagctctttctattcctctttttaccagccccatcatttctgtctctcatctggttccactatcgaagagtgaacactgcaggccagagttggacacttctggtgaagtgtggcttgcatagcaggtggtctccatagaaggctaggcaaggggtggggagtttggatgaagggcggtgatttgtctcaaagccagttgactgtagaggagatggggtatgtcagagggccccgagaatatggtgcaagtcaagtccatcctcactgatgctggggctcctgaaaagatggggcagggcctttcctcccatgttgatcttgcttacatgcagtataagggaagagaacttttgctcaggtttggcaggtgcaccatttcaagggcagtggtcagataggcaaactgaccattctacctgacgcatagcctaaagaacactctctggaccaggcttatccaacctgtggacagctttgaatgtggcccaacacaaatttggccactttgaaaacactatgagattcttttcctttttttttttttttttttttttggctcctaagctgtccttagtgttagtgttttttatgtgtggcccaagacaattcttcttccagtgtggcccagggaagccaaaagattggacacccctgctctagatttttagtcatgtttcacattcagttttcttcttacagtcccaagacattcatggaacaactgtcttccaaatacagagaaggatatcaaagtctgagtgggttatctggtagtccccctccctcccgaggacagcagaacaccatagttcaattctgatgcagtccaattaaagacacactcatgatgtacggtcatcattctgttggatcctttttgatgagagtccctaactcttctctgtagatctgaatttcacttggatatttctcctctcaagtgaagcaggaggggcacagaagcccaaggagcaggaatgaatggggtcagggctttgctgatttgtctggcatcctcaaatagctgctgtttgccattgaaatctttcatcctctgtaacccaaaccagacattattgtcagtgctcctcatttaaaaaaaaaaaatcacagaaatgccaggtgcggaagctcacatctgtaatcccagcactttgggaggctgaggcagatggatcacttgaggtcaggagttcgaggaacaggctggccaacatggtgaaaccccgtctctactaaaaatgcaaaaattagccaagcatggtggcgcgcctgtaatcccagctacttgggaggctgaggcaagggaatcgcttgaacctgggaggtggaggtcgcagtgagccaagactgagcccctgtactccagcctgggcaacagagcgagaccctggctcaaaaaaaaaaaaaaaatcatagaaccttttttggtaataaatatggccaaccagaatgacagtttgaggcttacagcaagtatagattcacaaagtgagaaaaggatagttttcaacatactcagtatgatgaatgcaaaataaaattgaaaatctttgctaaaaaatcatcccatgtgggtcttctgatttgaacaagattttagctacaaaaaaaaaaatcaaacctcattaaaaatttttactgtaaaatatgattcttagcacgtgtgattcgcctcactcttggaacattttagtgggattttataagggctatgaatatttcatatcaaataacacatttattgcaaaggttttaaaaaattaaatcagtggaaaaaacacttatgaaatctttcatcttgagtgctgctaaagagaaaattaagaaattctatagtatttctgcatttgattttatagtaaatagccacattgaggacactcagttgatgctttgcaaaggataaaatcgttatggttgtttagcttttagttttgatgaatctaccaacaaaggggattgtgtccaactattgcatatgtatgaaataggactcaagaaactggggaaggagaaaggatgctttctcagactcaaccattggagaccgtcactaacgctggtgatgccttcaaggctgtgtaaaagtgattgaagtttaggggctaactgggggcagaggctcttcaaagatgactggaatgtgaatttattgtgctctcacacacagatcaattgtcaggatttgcggtgaatatctattcaccttttctagtatacactgttatcattaccctccaatgacggttttctaaaccacctggtgatctaagagaagaccttcactctgctgtcaagtccttccatttttctaggaaacagagcactaaatacattatcttttttggccttggttggtgacgatttgaatgctactaacaaagcccttttgtccatactcagactccttgagtatatgacgggccagttatagaagcaggaagacatggttgccccaccatggtaacagcagttcaaagaccaactgcctccaactttcaaaacttagcatatttggcaaaaaaaaaaaaaaaaaacacacacacacacacacacaacaaaacatttgaagctttgaaatcattgaacctgaagtttcaaaagacaaaaactggtatcattgctcgttagaacacacttcaagcatttgtagtctaaacccaggtataggtacagcaaattggtgctaaaaatgtcttcattttcttgacttaatgaagctctttaagctaacgttcttggaaatgattttatggaagacaaaagtcagatctcattcagcctattatggtgcagtgaatccaggcctctttccctggcactgtagttgcaaattctttttagaagctagtgaggaactctcctttttttttttttttttttaactgttcttccatctttgtcagaagatctgtctccagggcctttgctggaactcaagtgtgctttggttgccaaagataacttccagaaaatcacttaggggaattttggggcaaaacattccctgtgtacctcataaaaagcgagcagcctttgtgtgtcatcattgccattttccttcccacagcaaatctgattccatgcttttgaaacttaagaaaatggctcagcctggacctgtgtcttgctgtgacttataaactgcctagaaaagaaaagctgatgacacgttggcagactcagctctcctgtggacatctcatgatcaaaattaacttttaagatcaaactgagttttctaaatttttctaaaatgactttggctgcaatatttaatttactttgaaatatcaaatgatattagatatttggcattgaatgagggtgtgaaatctttatgttaattaaaaggagggcattttctaacaaaaattacaaattgctaaatgaatatagtctcatatggagaatgaaaaattgaaacatatattggaataaggtgacctgtgattggtcaagagaaaggaaccagaaaccggagaagctggatagtcaggcagctgggctagaagggaactgcttttgaaggagactgtcttccaggaagcagggcgatgccgaggagcaaagcaggccctatgcttggaggagctacaataccaggaaatcatgtgggtctgggtcacatgatggaagctgctgagagaatacagtagaggcttgtgtaagggaaatggagtgcagggtcagagcaatactataattaagtgtggcaatgctaagacttcctttgaatctagagagtctggggaaatgcctcagccagcatttctcaaccttcattacacatgagaatcccatgggagtggctgtttttaaaaatgctgaaaacccaaaggaatataaatcattctgttacaaagatacatgcacacatatgtttattgcagcactattcccaatagcaaagactggaatcaacccagatgcccatcagtgatagattcaataaagaaaatatggtacatatacaccatggaatactatgcagccataaaaaggaatgagacaatgtcctttgcatgaacatggatgaagctggaagccattatcctcagcagagtaacacaggaaaagaaaaccaaaaatcgcatgttctcactcataagtggaagctgaacaatgagcacatggacacaagtaggggaacaacacacactggggcctgttggggagttggcaggggagggagagcatcagtaagagtagctaatggatgctgggcttaatagctaagtgatgggttgatctgtgcagcaaaccactgtggcacatgtttaccatgtaacaaacctgcatgtcctgcacatgtatcccggaccgtaaaattaaattaaaatttttttttaaatgctgataactagacccccacctccagagatgctatatgaattcatctaggttgggacctgtgcacattcatattgtttcctaagttttttaatggaagcccagattgaggaccactggcctgagggaccagggaatgaagcagaaacaacaaccgcaaccacaaattaggctggacttgttcggagggtgttgaataggagacattccggttcggtgcggaaagagccatttatctggagccagtgaacctgggttcaagactctccctctgccattgttgctgggatgacatggaactagttaaatcatgtgcctgtttctcttttttttttttcattagtcaaatggaaatagtgagaatacccacttcatgacagcgttgcataaattaaaatgagacgatgcagacacagcacccaaggacatgtactcagggggaactgaccaagtgtttgttgaatttgatggatgaccttgaagtagatagagttgtttttgtgcattatcagactgcaaacgtggtggaaataggattgaagaatgttatccgtggcacctgcgagtgagctgacaggaacagggagaaatcagaggcagggggactagcccaggagacccacacaatgttctaggacaggatccataatctatggccaaaaagtatgcctgatctggccctctgcttgtgtttggaaataaaatttgactggaacacagccacagccatttgttatgtatttctatggccgcttttatgctacaatggcagtcaagtgcttgaagcagagatagcatagcctgcgaagtaaagcacattgactctctggatgtttacagaaaaagtttgatgacccctgttttaggataagattaagaggcttggcttcggatgagatgtttgaaatcaaatgggaagagcaagtgcttcaaacatcaggaagaaagaattggcaggctttagtgacagattgtacgtagggagattttgccatataaaggttagggatgtagtgtctttatcacgggcaggatgatgcaaccggacagctttcctgaaatctggcactaagtgcaagagtttgctttcctagactagagagatctgggtctgtcacccctgaaagggtctgagcccccttcatgggaggcccatccagaccctggccctgcctgcattaatgagtcccagtcctattcatttcaaagtggtggatcccacatgcagtaccagatgccagcactctggagagatccagagatactcagcacattcagattgattgagatcatcacttaggacattttggatggtaagtccctaatctctgtcactgcactgcacggaggttgattttcaatttaccttctttgttctgaatcttagatgttttgattcttaattcagaacattcatctcaagtggattcagagattcagagtcgatgataaattcatgtttgttgagaagttttgcagggaggaggatgatgttgtcagcttagtttttgaataatgtcttgtttgacattttaagctgaaagtgggctgaaccgcagatcaacacacacacgtattgcatgatagaacgatacatcatgttcatacatagactgtgtatatctaaagagtagaaacctggaaggaaaggtaatagagaaacaaaggtaaaggcacttacacgcaggggattctatccacttctgcctttatgtgccctgcctgcagctttagtgggcttgggctgggagaacagcagagaatttgagtattgatacggtttggctgtgtccccacccaaatctcatcttgaattgtagcccccataattcccatgtgttgtgggagggatgcagtgggagataattgaatcatgggggcggttccctcatactgttctcatggtagtgaataagtctcacaagatccaatggttttataagggaaacccctttcgcttcactctcattctctttttgcctgccaccatgtaagatgtgcctttgttcttccctcacctttcaccataattgtgaggcctcccaaaccatgaggaactgtgagtccattaaacctcttgtttgttataaattacccagtctcggctatgtctttatcagcagcgtgaaaattgactaatacaagtatctactctgtgtaagcctgatatgaagtaatatttgtgtgtgtacacacacacacacacacacacacactcatgcttatgctcccatgtccctcattttacataagacactgagtcacagaaaagttaagtattttgcctaagttatttattagtaagtggaagaaccataatttaagctcagctctttcttactccaaatcccatgctcttacttatctacttgatttgtttgcttttctcagttctctctccctcttccccagcatctaatattataatgagatgtctttttaaataactagtagtttatgatgtgctaggcattttatgcctttttttaacaaaaagttatagttgttagttcttctctttctctcttcctcaaatgcttgctaagtatagggagcatgccaggacctggggatggagactggagattgggcggtgccactcaaggtgtgatctgcaggccgttgttcgtccttctatttgtcagggctctttagagaagcagaaccaatagagtgtgcatatacagctatgtttattgtaaggaattggcttgcatgattatggaagctgacaagttccaagatcttcaggttgagtcagcaagctggagacccaggagagccgatgtgtagttctagtctgagtccgaaagcctgagaaccaggagatctcatggtgtagttccagtccaaattccaacaggctcgagacccaggaagatctggtgattcagtttgagtttgaaggcaagaaaaagatgatgtcccaattcaatggctgtcaggcaagatgagttctcttgaatgtggaagatggtcagcatttttgttctactcatgccttcaactaatgggaggtagccaacccacaccaggggaggacacctgctttactctgtctaccaatttaaatgttaacctcatccaaaaacacctttaaaaaaaaacacccaaaatgatgtttgatcacatatttgggtaccacctggcccagttgagttgacacataaaattaaccatatcctcaaattgttgctgctctgcaacaagatacatatggaacttgagactaagcattttagaaacatctagagcaaatggactttgtggccagcatcaagtgtatgatcaatagtcttgattaacgtagtgtagaccagtttgtttaattccagtgatgagttacacgtgggccaagctctgttttacctttgagtgttaggggcaaatttttatccaggatggactgggggagggagaaaaactggttcttcacccaagctccttgtgcttccatgcctctcttgctgtcttcaccactggtagtttgagaaatatcagtgtgggcacagttgtttacatagccataaaatcgtatgtaatgggctgtataactacgacctatacacaaagcttgaggagcgttcctgggagggaccagtgcctgtaaaacgtaacagagaaacgtaaggaggctggctgttcactaccctgaccctctctcctgcttgtgctcccagagagtcaggagaagcctgagcaaagagatcaggagccagaaaaaggaatagtcaggaataaaagcaaaagtcaggatgaataaaacgagaatgagctgtgaatctggcaaggcagcagggcccactattcacttctgatcatgcggtgttgggatcatctggaccacacagctacggagagttagagctgagaggggactcggagcacatctccagggccccgcctttcagaaggcaaaactggcttgaggaaaaggaaggggccggctcaagataatggacctttaaaacaaaccaacaaaccggaaaggacaattctgccattaattgagcacttcctccatgccagcagttgggcacagcatgaatgttgcttttttcaacattgattcctctgagacctgacattaattatttagttgtggcttcattggtgacaaatctatagggcttttaaaagtgggaaaacccccgcacgtctttgagagttaaatttggttaaaaccatttggggtctaaagcaggggagaaatggacacaggatgtcgatagcatttctcttaagcccacaatcagacaatcataatttacgtaaatgtttaaaatatgggactttcaggagaggggctagagaatgtgacccggcctctttggtgaagcctgcttgcttgctcctccatgttcttacggattaaccatgaccccggctaaggatgaaggcaggaagctcagcagtgcctcctcttggagtatatctcaaaggaagccaaggtctgttgactgcttgttcccccatacaacacacagaacaactctgtgttctgaaaatacagcgtgctttacaccttaaattacatcatcaactcatcttacccatgacatcaccttccctcactgagaaagggtcacaggaactcactgatgccaagcgcctcccaataagggacaccatgctctgtattttgttattttgcttaagcctcccatcactcttactggaacattttatgttcccatttcacagaagaaaaaatcgaagctcagagcactgatgtaactcctccaaagaggaaactcacaggtcccatttgttaattttctagagaccctgagaccctgttgagcttcctgcatttctgcccaaatgctccaaaatcctttcctgagaaggaagaccctctcagtctcctgagcgtctttacctctaacttagcacatatatgcaggagcatagctgagctcaaagtccaggagaccttgtttacagtcaaactgcaacataataggaacacagtttaaactttagtcttggtttctgcatcagtaatagggataactattactacttaattgtactgatagcaacctaaggcattatcagcatgaaccacctagcgtggtgcagatccatgatagacactacagaaggtgtaactcccgaggaagccagaggttcatctttacccacccctgctcaaagggtcgatgttggttgagaaaacgcaattattaatagctgcctattctttttcattctcagttgtaccaaacagggagacaggtttcaaaagcttgggttgaagcttgtaattggccagtcggtgacaatgcaaccctaatcaacctgtgatttcacgtcccctaccaattctgcatcggcctttgatttgtggtcccaggcagtgcaattcattgagtcatatttgttgcattgataggagaagaccaggcacttaggcgtttaaccctgaggtgattaagaggaaaaaaaatgagtcatatttgttaaggcccaaagatacatcaaaaagccctgggcagaggccgacacaagcacaagtgagacctgcagggtgtaattcatcacattctttgatcctcaagtttgtgagtcacagagactctctgggacagttttgaagctcaggggtctgggcaggaaggaaaaacttgaagtatggaaaaagaggaatgtttttttgacaggcagctgagagaggacgattttctagagatatgctttttttgcttggtaacccctgaggtggctgtaaatgtagctggagcccaggatttctgcagagtggaaacagaaataagtgatagctttgggtatgccttgtgccactggggctcctgaacagtaagcatgccttgagcgcctactttatacaaggtgatataagtatccttgggagatggggtttttatactaataagtgtttgtttttttttaatgttagctctctgaatagcctataatgaaagtttattgaagtggagagtgtacaggcccagatatcagagagacctgggtgcgaattctgacatcaccattgtggtggcatcacattgagagacctgcttatcgtctctgtgcctcagttttttgtgttgtttttgtttttgttttttgttttgagacagagtcttgctctgtcgccaggctggaatgcagtggtgcaatctcggcttactgcaacccctgcctccagggttcaagcaattcccctgcctcaacctcacgagtagctgggactgtatacaggtgcgtgccaccatgcctggctaactttttgtattttagtagagacggggtttcactagcttggccaggatggtctcgatctcctgacctcgtgatttgcccgccttggcctcccaaaatgctgggattacaggcatgagccaccacacgcggccgtgcctcagtttttattgcagggttgtatgattgttacatggagtgttgctggcactcactttaatggttaactgtttttctgggaaaaccatgagatgggtcatgcttctacttcttttttccttgttgcttttaatattttattcttggcatggagccatgcatccagtcttccagcatttctcagaccttgtgacatgttaaccacaaagacaggtaagacccgcctttgcctacattgaactcccagtcttcataggcaacatttagtaaagctgtttaccaaatacagtatggcagatacatgttttcatagcgctacatacaaattatttcggaatatgtggaaggatatcttgcctgcaaatggaagaaggtttcccctgagaggtgatgcttttaaaacaggattttgaaagatgtataggagtttgcataggaagagctcaataaacttagtcattattattatcttttttctttttttttttttttttttttgagacggagtctcactctggcccaggctggagtgcagtggtgcgatctcggctcactgcaagctccgcctcccgggttcttgccattatcctgcctcagcctcccaagtagctgggactacaggtgtgtgccaccaagcccggctaatttttttttttttttttgtatttttagtagagaccgggtttcaccggttagccaggataatctcaatctcctgacctcgtgatccgcccgtcttggcctcccaaagtgctgggatcacaggcgtgagccactgcgcctggcctattattttttccttattactcgttctcttcctcttgctcccctccacttcctggtactccttctcccctcccttgtctttctccccaatccgcccactttgtattcataattctttattgttaagaagcctacttagaaacatgccaagtagggagaggaagacagtgcatttaattagaaacaattttattatgattgccttctctaaaaggcatattagcttttatcaccataataagttgttctgttctcaactttgttcccagttcaatctggatgcgtttatttgtaactcactttccatctgttttccttaaacatgggattgtgcaaggagcctcgccatgtagtaagggatgtctggggaacttggaggggcttgaggcatggttcatccagattaaagcttccctggtgtttcgctccccagatggaaagcccgtgtctctgtcaccgctggagtcccaggcacacagccccaggtacacggcctccagccagcgggagcgcgagagcctggaggtgcgcatgcgcgaggtggaggaggagaaccgcgccctccgcaggcagctcagcctggcccagggccgagccccatcccatcgccgaggcaaccactccaagacctactccatggaggagggcactggagacagcgagaaccttcgggctggcatcgtggcaggcaacagctccgagtgtgggcagcagccggtcgtggagaaatgcgaggtaaagggcatctggagcctggggaggaagttgtccaaagtcccgattgccctcaccccttgcaaatgcctcctggaaacacagccagatgccaagagctggcattcttgattctagcccgggtgtgtaagtctggcttgctcgctaactttgctcaatggtctgacaagtcatttagcctctctgagcttctgttttcccatctgaaaatggggataagaaggcgtaatctacagatattaagaggagctcactgatggaacctaccgcttgtttctatgtggttcattttgacatgcgcagggtttctacacctagctgtcatcctgtaggcccctgcttcttagactatagtgtgaatggtacacctggagttgtggcccagttgggcagttttcttagacctcattatcacttcactgtataaacagcctctccaattcagaaccacagacttgttccttatctaaagaagtaatttgaacttttatagcctaatatcacttctccccttttagggtatgctttctttcttagcagctctttggaaatgtgggatatttattgtcctctatttcctcaaatacctgcatccacgcttctatgtgcagtgaacacacatacactcattccccattgtttccagttctcatggtggagatgaattagggcatgcctattcataggaaggccttttgagagatgggcgagactgaattcatatcccagctttagtgatttatgcagagagtacccttgatccagttgcataacttctgtgaactccaggtgtctcatcagtaaactttaggaaataatacctgcttcatggagtatttgtgagaattaaacagaatggccatataaaggcttgactagcgcctagtacatagtacattttcaaaattatggttagtttttactattcttagttaaacatagataggacctgctgtttctttattccattttctggaataaagagtggttagacttcaaactccctaaagagaatgctttgcaaactgtagtattctattctagtgaatgggattattagtaatattggtgatactatccaatgagactatccagtgtcactaacaaatggcttcctcagtgatgtagactaagttctttggaagttcagtggtgagggaggaggacaaggagagcccctgaggataggagcatttctcaggtttctcaagcctggttgaaaagtggattggtggagaggtagagagcatccgacagaggatgtccaacgaggaatgtgtcatatgagtaggaacgatgtgaaacaaacatccattatagcaggattcgggatgtcacaagttggtccttcagccaagcccagagaacctgggcgaggaggtggttctactccatcatcatcattcatttatttatccattcgttcagcaaacatattgcactcgtgttttgtatctcattctgttttatgtgttgggaaacagcagtgaacaacagcaaaaaagacagaacccctttccctctggttcttacatctgtcatcagaggtagagggagagatgataaacaaataaataaatacaaatgtcaggacgtgataaatgctgcacatttattcagccctgactgtatgccaggcccagtgccctttagtctttgacaaccactgtcagtggcttctgttacttaatatctctatgtatgaaaacgggcattcagccacgttaacaaattcctttggtcttggctggtctggggagggccctaatttagggatcttctgttcttgccttggtgaaggcatatttgatttctttcaggttctctgctagcagatcacagccatggtgttggtttagaaagggttagtttggatgggaactctgctacccaggtgagatggcccaaaacgagcaaattttttctccaagcgtatttacactattatgacatagaacctaaagaacaaataagaatcgaggaggggaaaaataaaaaaggaaaaggggaaaagaaggcataaaaaagagaaaaagagttgtgtttgtggggacatttctcttccttctgtaatctctctagccaagagtttcactcccctgctcagtcttctgagaaataactcattgtaatttgggagtcccctgtacaattgtgtagaccaaagaccattggcttttgaagctgggagttgtgagtctaaatcctggccccatttctagtttaacagctatgtggctttgagcaagtaagatcacttttctgtggctgtttcctcatttgcaaactgtggattaaaatcaagttctgggcccgacacagtggctcatgcctgtaatcccagcactttgggagtccgaggtgggtggatcacagggtcaacagattgagaccatcccggccaacatggtgaaaccccgtctctactaaaaatagcaaaaatcagccggatgtggtggcgcgcatctgtagtcccagctacttgggaggctgaggcaggagaatcgtttaaacccaggaagtggagattgcagtgagccgagatggtgccactgcactccagcctgggtgacagtgcaaaactccgtctcaaaagaaaaaaaaaatcaagttcctgccttttactatttcagtggtgacaatggatattggaacttgagggaaattctaatgtagttagttgtatcagtcttagatttcactgcaggttatcaaaaatcccaactaacactggcttaagcaagatttgcatcttgtttctcattgtgtttaagatgtctggaggccatcagtgtagggatggcagtattgggatttctttatctttcaccccagcctgcttgattgacattcccaaggtcatctcatgacccataatgattgtcagagctttagctatgttgtccacattccagctggcaggaaagaagtgttaaggtgggacataccactttccttaaagaacgtatcttggaaatttcacacttcagatccttttagatcctattgacacaacttagttacagggatacccttagctgccacctaggtccaagagagcctggaacagatagattttactcaaggaagccatgtttttctggaacattctggagttctgttactgtggtcacagtgaaccatgtctgtcacatgggtggttctcaaacttggttgtgtgttagaattacatatcaaaaatgtgtatccatgagacctaccccagacctactgactaagaatctctgggagtagcccctgagaatacagatatttaacaaaagaatatatccagatgattctaagataggagagattgtttggaaaccactgctttaggctggacacagtggctcacgcctataatcccagcactttggcaggccaaggcgggtggatcacctgagttcaggagtttcagaccagcctggccaacatggtgaaaccctgtttctactaaaaatacaaaaaaatagctgggcgtggtggagggtgcctgaaatcccagctacttgggaggctgaggcaggagaatcgtttgaacctgggaggcggaggttgcagtgagctgaggtcatgccattgcactccagcctgggcaatagagcgagactccgtctcaaaaaaacaaaacaaaacaaaaaaaggaaaccactgctttaaggagcagcacataggattgatgaattttctttatccctgtgttccttgaaacataaaacagtcatataggaattcagatcttgaactcgttgacttttttttttttaaactttaaattctggagtacatgtgcagaatgtgcaggtttgttacataggtatacatgtgccatggttggtttacagtacctatcaaccatcatctaggttttatgccccacatatattaggtatttgtcctagtgctctccctccccttgccccgcccctcaacaggtcccagtgtgtgatgttcccctccctgtgtccatgctttctcattgttcaactcccacttacgagagagaacatgtggtgtttggttttctgttcctgtgttagtttgctgagaatgctgttttccagcttcattcatgtccccacaaaggacatgaactcattcttttttatggccgcatagtattccatggtgtatatgtgccacattttctttatccagtctatcattgatgggcatttgggttggttcctagtctttgctattgtgaatagcactgcagttaacatacgtgtgtgtgtctttatggcagaatgatttataatcctttgggtatatacccagtagattgctgggtcaaatggtatttctggttctagatccttgaggaatcaccacattgtcttccacaatgattgaacttatttacatccccaccaacagtgtaaaagcgttcctatttctccacatcctttccagcatctgttatttcctgactttttaatgatcgccattccaactggcatgagatggtatctcattgtggttttgatttgcatttctttgatgaccagtgatgctgagcttttcttcatatgtttgttggccgtataagtgtcttcttttgagaagtgtctcttcataccttcgccactttttgatggggtcatttgttttttcttgttaatttgtttaagttccttgtagattctggatattagccctttgtcagatggataggttgcaaaaattttctcccattctgtaggttgcctgtttactctgatgatagtttcttttgctgtgcagaagctctttagtttaattagatcccatttgtcaattttggcttttgttgccactgcttttggtgtttcagtcatgaagtctttgcccatgactatatcctgaatggtattgcctaggttttcttctagggtttttatggttttaggtcttatgtttaagtctttaatccatcttgagttaatttttgtataaggtgtaaggaaggggtccagtttcagttttctgcatatggctagccagtttttccagcaccatttattaaataggaaatcctttccctatttcttgtttttgtcaggtttgtcaaagatcagatagttgtaaatgtgtggttaatttctgcggcctctgttctgtttcattggtctatatatctgttttggtaccagtaccatgctgttttggttactgtagccttgtaggagtaccatgctgctttggttactgtagccttgtagtatagtttgaagtcaggtagcataatgcctccagctttgttctttttgcttaagattgtcttggctagatgggctcttttttggttccatatgaaatttaaagtagttttttctaattctttgaagaaagtcaatggtagcttgatgggaatagcattgaatatataaattacttcgggcagtatggccactttcacaatattgattttcctatccatgagcatggaatgtttttccatttgtttgggtcctctcttatttccttgagcagtggtttgtagttcttgaagaggtccttcataacccttataagttgtattcctcagtattttatgttctttgtagcaattgtgaatgggagttcactcatgatttggctctctgtttgtctgttattggtgtataggagtgcttgtgattttttcaccttggttttgtatcctgagattttgctgaagttgcttatcagcttaaggagttttgggctgagaagatggggttttctaaatatataatcatgtcatctgcaaacagagagaatttcacttccttacttcctgtttgaataccctttaattctttctcttgcttgattgccctggccagaacttccaacactatgttaaataggagtgatgagagagggcatccttgtcttgtgccagttttcaaagggaatgcttccagcttttgcccattcagtatgatattggctgtgggtttgtcataaatagctcttgttattttgagatttgttccatcaaaacctagtttattgagtgtttttagcatgaagaggtgttgaattttatcgaagaccttctctgcatctattgatataatcatgtggtttttgtcattggttctgtttatgtaatggattacatttattgatttgcgtgtgttgaaccagccttgcatcccagggatgaatccaacttgatagtggtggataagctttttaatgtgctgctggattcggtttgccggtattttaccgaggattttcacattgatgttcatcagggatattggcctgaaattttctttttttgttgtgtctctgccaggttttggtgttagggtgatgctggcctcataaaatgagttagggaggaatccctctttttttatttttggaatagtttcagaaggaatggcaccagctcctctttgtacctctggtaagatttggctgtgaatccatctggtcctgggctttttttggttggtaggctattaattactgcctcaatttcagaacttgttattggtctattcagggattcgatttcttcctggtttagtcttgggaggatgtatatgtccaggaatttatccatttcttctagatttcctagtttatttgtgtagagatgtttacagtattctctgatggtagtttgtatttctgtggaatcagtggtgatgtcccctttatcatcttttactgtgtctatttgttcttctcctttttcttctttattagtctagctagtggcctatatattttgttaatcttttcaaaagaccaactcctggattcactgatttttttgaagggttttttgtgtctctatctccttcatccatgagcatggaatgtttttccatttgtttctgctctgatcttagttatttcttgtcttctgctaggttttgaatttgtttgctcttgcttctctagttgttagggtgtcaattttagatctttcctgctttctgttgtgggcatttagtgctataaatttccctataaacactgctttagctgtcttccagagattctggtatgttgtgtctttgttctcattggtttcagagaacttatttatttctgccttaattttgttatttacccagtagtcattcaggagcatgttgttcagtttccatgtagttgtgcagttttgagtgagtttcttaatcctgagctctaatttgattgcactgtggtctgagagactgtttgttatgatttctgttctttgcatttgctgaggagtgttttatttccaattatgtggtcgattttagaataagtgctttatggtgctgggcagaatgtatattctgttgatttggggtggggagttccgtagatatttattaagtccacttggtccagagctgagttcaagtcctgaatattcttgttaattttctgctcattgatctgtctaatactgacaatggggtattaaagtctcccactattattgtgtgggagtctaagtctctttgtagatatctaagaacttaatgaatctgggtgctccagtattgggtgtgtatatatttaggatagttagctcttcatgttacattgatccctttaccattatgtaatgcacttctttgtctcttttggtctttgttgatttaaagtgtgttttatcagagactaggattgcatctcctgcctttttttttttttttttttttttttgctttccatttgcttggtaaatattcctccatttctttattttgagcttatgtgtatctttgcacatgagatgggtctcctgaatacagcacactgatgggtcttgactctatccaatttgccagtctgtgtcttttaactgaggcatttagcccatttacatttaaggttaatattgttatgtgtgaatttgatcctgtcatcatgatgctagctggttattttgcacattagttgatgcagtttcttcataatgtcattgatctttataatttggtatgtttttgcagtggctggtgctagtttttcctttccatatttagtgcttccttcagaagctcttataaggcaggcctagtggtgacaaaatccttcaggaggatttgcttgtctgtaaaggattttatttctcctttgcttatgaaacacagtttggctggatatgaaattctggtttgaaaattcttttctttaagaatgttgaatattgatccctattctattctggcttgtagggtttcagcatattgatctgctgttagtgtgatgggcttccctccataggtagcctgacctttctttctggatgcccttaacattatttcctttgtttcaaacctggagaatctgacgattatgtgtcttggggttgcctttctggaagactatctttgtggtgttctctgtatttcctgaatttgaatgttagcctgtcttgctaggttggggaagttctcctggataatatcctgaagagtgttttccaacttggttccattctctcggtcactttcaggtacaccaataaaatgtaggtttgttcttttcacatagtcccatatttcttggaggctttgttcattacttttcattttttttcctttaatcttgtcttcacactttatttcattaagttgatcttcaatctctgatatccttctgtttgattgattcggctatcgatacttgtgtatgcttcacaaagttctcgtgctgtgtttttcagctccatcaggtcattgatgttcttcttctctaaactggttattttagttagcatttcctgtaaccttttttcaaggttcttcacttccttgcattgggttagaacatgctcctttagctcagaggagtttgttattacccagcttctgaagcctacttctgtcaattggtcaaactcattctccatccagttttgtgcccttgctggagaggagttgcgatcatttgggggagaagaggcattctggtttttgttattttcagcatttttgcagtggtttttcttcatcttcgtagatttatctacctttgatcttggatgctgatggccttttttgtgggcatcctatttgttgatgttgatgttattgctttatgtttgttagttttccttctaacaggcccctcttctgcaggtctgctggagtttggtggaggtccactccataccctgtttgcctgggtatcaccagcggaggcttcagaacaacaaagattgctgcctgctccttcctctggaagctttgtcccagaggggcacccgcccgttgccagccggagctctcctgtttgaggtgtctcccaatcaggaggcacaggagtcagggacccacttgaggaggcggagtctatcccttagcagagcttgagtgctgtgctgggagatgggctgctctcttcagagccagcaggcaggaatgtttaagtccgctgaagctgtgcccacagccaccttttgccccaggtgctctgtctcacggagatgggagttttatctataagcccctgactggagctgctgcctttctttcagaggtgtcctgcccagtgaggaggaatctagagagacagtctggccccaggtgctttgccatgccgtcatgagttctgcacagtcaattaacactgtgaggggaaaaccgcatactcaggcctcagtatggtggacgcccctttctccaccaagctcaatcatcccagctagacttcagactgctgtgctggtggggagaatttcaagccagtgtttcttagcttgctgggctctgtgggagtgggaccagctgagtgagaccacttggctccctggcttcagccccctttccaggggagtgaacgattctgtctcactgggattccagctgctactggtgtatgaaaaaaaaactcctgcagctagctgggtgtctgcctgaactgccatgttgactttcggtataacttattttctagtcttttgcacttgagaattaggttttgttcttcttctctttctttgtgtttactgatcatgttaacttcttagattcttaaaaagttatttttggtagaattcttctatgaggaacccctggtcctgttcagaacctccaatagatgcacttaaaagtcttggcctgctacagtcatatttcaaagcacactctccacaaggtgctggcctcctacccatgagcagtgcacttcctctcactccctcatttggtgtctttaaggattttaacgaaaaagccatagaggcagacaagaaatgtcagtcagtagagtcaaaatagaaactcccttcatcacagcgctttttggttccaagtgctgaagctcatcttgacatcctgtcacggtgcagggccacgtaaccagagatgctgccaccatctgtgggtgttgcggaaacttctctgggctccgaaaagcatttctgaaaactcctctatcaatatgccaaggctgtcagctgagctatctggtgataggaacaacgggccctcatcagtccctttgccctcttatcatttggtaattatgtgtctttcaaatagctgcctgtcttattcttgcatatttctgttgcctgtgcagtgctgtttcagtgatggcctggcctctgtgtgcctcagaagttggagcagaacgatcccctttgatcttcactcatgcacatgtgtgtatggatgtgtgtatttttcttgcctttccggttcaggtctattctgggactcagctattgtacggaagaaaaaacagtcactggaactggtatcagaattcctgaacaggagactttcctttgctactcattagtcttgtgaccttagacaattcagttaccttttgggagtctatttcatcattataaaatggaaataataacatgttcttcccagtgcaattgtgaggatgaaatgaggtggaggcaggggaagctaactatgcatgagtgtcacatatactcattatgaatattcaacttctccactggtacctgaaaaatcacctaacacttaaataatctgaaacagcaccagttattttattagctgtcatggtttctgtgggtcagagatttgagaaggacttagctgagtggttctggtatggggtccctcatacaggtggcattagtgtgtggctggagctggaacagtacaatgctggaagagtgggtgctgacccaacctccctttcttttagactcaggtcctcatgtggtctctgcatgggctagtttgagcttcctcacagcatggcagctctaggcagtcagctgcttacatggcagctaaaggctttaagtacaagtattcccgtaagcaaggcagaaaggaagcacttttcatgacctggcctcagaagccacacagtgtcacatctgctgatagtggattctgttagttgaaatggtcacaaaagcccactcagcacatacccatctctcaatgagaggaacgtctaggcatttgtggatgtacttaagaactgccacaatggatattgttattatggaaagtgaatgaatgttatcctctgatgccagaccactccttaaggaagtactcatttttccttctgctccttgctttgaacttcatttctcagtagtaatgtattatagttaataaccgttaatcagtccttgaaatgtaccagacatcatgctagagctttacataaaatatctcatgtaattcacacaacatatttaccttcatttgacagataagaaaactgctaggaaaggttttataattatttcaaggtcacacagccagaaagaggtagagcttgggattaaacctaggcagtttgattctagaacctgttctttgaaccattgcactgaagctctgtgaattagagcttgtgggacccagactctcatcagctgctgagcccagatccttattgtgtgcttcacaggggcctcacctctgcagactttagggttaccagtcattatatggggatcatctttcaccttgggggctttagcagccccatgaggtaatcgttcctcagtgagtttaggcaaagatctgtctgttcttctaaaagaagctgaaatgttttaaattattctccagactatggatgtatttattagcttagtggggcgtttgcattttgctggaggcaacatgtttataaaacttgatgcgtctcacctatattctgggtcctaactaaccttacagtattttaatgcactttttctattgtatcttcatggactttacataataacccagcagtgaaggcgtttgccagctatctttccatatcccacattgctgttggaggatactatcatagcatttagacacacattttattagcttcataggccttctttggggcttcttcaaggatgtaaatccacaaaaataaaaatgtcctctttaaatttcaggccctgaaattaggggatgttatagctggaaggaacctggtggtattgtcacgtgcagtgattttcagggcaccttaggtaccctccctgtatatgttagttacttattgctacatagccaggtaccctcaaaacttaacaacttaaaatgtcaagcatttattatctcatacagtttctgaaaattaggaatctgggagcagcttggttggggattatgactctcaacctttaaagagattacaattaagatgacatcaggggttgcagtcatctgaaggtttgattggggctgaagactctgtaaccatatagtttactgacatgattggaattctcatttccttaggactgttcaagtgttctcataacatatcagctagcttttcccagggtaagcagtttaaacagaagaagtaaaaagctacaacgacttttataacctagcctcggatgtcttataccattacttctgctgaattccattggtcatacagcccggctctgacacagtataggagaggctacacggcatgaaaaccagggggaagggatctttggagacagtcttggaggctggctaccacaccatggccaaggcaagggaccatatctctgccagccccctgtctgtgctggcctcagagtagccttctcttgttgcatattctgcttttttgtaaaacttattttagaaattgtgccactgagaatgacaacaacaaataaagatgcaactctctcattttaaaaatgatgaaagggtcttgcctcaggttacaaagttgcagccacagcccagatgatgagtcaagtgtctcacctcctcattcctgtgtcttttaccctgttatctggggagaggtgacaaggcagtgtcagcatttgatggaacagagggaattgggcaccttgaagaccttcctttcaatgatgggaaaaatactatcctaaccttacttgaaggtagaggaaagagtgagagaagaagaaaagaacttgatggctgacatttgaggaaatttggggctcagaccttagatatagaacgttcagcttagaataaactataattgttattattattgatgattgctgatacatacccattacttacaaggtaccaggctctaatccctttacgcgagtcatctcagttaatttgcccaacagttagttgacatggggctgggcatggtggctcatgcctgtaatcccagcaccttaggaggccgaagtggaaggattacttgagcacaggagttcaagaccagcctgggcaacatagcgagaccccatctctccaaaaaaaaaatacaaaacttagctgggcatggtggagaacacctgtaatcccagctacttaggaagctgaggtgagaggatcgcttgagcccaggaatttgaggctgcagtgagccatgattgtgccactgcactccagcctgggtgacggagcaagaccctgaaataaatagttgacacatttattactcctctttatagatgaggaatctgaggtcccaagaggtggagttacgtcttgaaatgtggggaagagtttgataggtgaggtgaagggtcagagcaatctagaatgaaggcacattctaaaaacaagaaagcttgatgagtcatctagcatgaccataacatggcgctacactgatcattgttgagtgattgtctggctaatgtgtgtggactttttggaccaggccagtcttccagaggcccccatgatggatcagtattggggtgttgttagataacccacctaccccagatatgatctccctgtattgattacaattctcttgacccaccccaaaatcggtctcatcctttaatgttttctgtgtaaaatttgggtttctgatttctcaggtggctatgctctttatagcacaagaaagtcaatcctaaagcagactgggatatgcaggatagaaaatcctggatgcttcattcattcatcatccatttatgtgccttgccgtggaggggacaccaagagactccttgttctcacagcaggccctggaacccatgtggtcacacctgttcctcgctgagccctgaaggcttggcttacaaagccaggtggtgcatctacttctgttttctgcatagttgaaataactttgtctttgcatccatggttcagcatttagagtggacagatttagatgagtggtttcccaaatcctggaggtttgtaacatgatttgagagggtacatttgccatatgttttaaaaatgttaataggtacatatgtgttttattgaggccattactgtgggcttaaaagcaggaccctgaattcaacccgtcactttgtcacagactagctgagccctcggaccttgggcaagttacttaaccactctgtgtctcaccttcttcagcttgaatttgggaaaaacctggatgttaggaaaatgctgtatagaaattctaaatcccttgtttgatagaggcagtggctgaggatccaagaggttagataatttgccccaaatcacttagctggcacaactgtgtcatactggaccccttttgactccagtaaggacaacaccgtgtctgagaggttgaagaagagactcagagccagtgaatgagacagggtttatggagaacttacatacaggggtggaccagtgaccgcaggctgaacagcagaactgctaccatttgtaaaaagcatgcagttgatatcatgttttcacttagcagtctccaccctgcaaccatcacttaaccaaaaataaagggcctcgatcccctgtacggtctgcattccagggaatgggccaggggttcagattccttcatagataaggagtgaatctccagattggccactgtgggattctttttctttttttttttttggagatggagtcttgctctgtcacccaggctagagtgcagtggtgcgatctcggctcactgcagcccccacctcccgggttcaagtgattctcctgcctcagcttcccgagtaactgggattacaggtgcccgccactgcgcctggctaatttttgtattttttttagtagaaatggtttcaccatgttggccaggctggtctgacctgtgatccacccgcctcagcctcccaaagtgctgggattacaggcgtgagcaccatgcttggcccgggattcttagctcagaactccaaacacacatccttcttggaccatagggtcattctcaggaattgcctaggttattgctgtcaggtctgtctgccattacaaactggaaccagcatccagctctctggatttccaggggtttttattattattattattattattattattttgaaattttttttgcagtagaagcctatacccattctcatctctttccattttttctcaccctgaaagagtaacaaattccaaggcctcgggacatgtggtggtagctgaaagaagaatgcagcctttccttgtcttgtccaagtgaagaaaagtggtgctctctacttgagaggaattggaaatagattatttgcacgccctcgtactctctcaaaataatcacagttaacatgtgttgagtttttactatagagtctcttccaagtgcttctgctagagcagcggttctcaaagtatggtccctgggccggcagcagcagtgtcgcctggatgcagactattctcaggctccactccagagatcctggatcagaaactggggaggagtccgcactctgttgtaacaagcccctccaggtgattctgatgcatactggagttggagagccacttactccatgtccttaacaagcactttaagattatgtcccccattatacagaggatgaagtcaaagaaggaggactctgaacagtgtcttgtgctgtttattcattcaggaaacattaataagcattgatttattaggggcactttcttgcactcatttgtttgatcctgacacaacccaatcggtagctgtttttatctccgttttacggatgaggcgagtgaagctcagggacactaaataactcttccaagatcacgcggccacttagcttcgagcttgtggctccaatcgaggtctctctgctcttgttgtgggatttgcacactacgttgcccctgcctctgaccctcgctgctgcctgtctgaccccggctgttcgcttctccgcagctgtcagagcatctgtcctctgggaggtcttgcctgtccccctcaaccccaccaaaagtctgcagctaccatccagaatctgtgctgagcctgtctttccatagcacacctgatgcccaagttgaaatgggtttcgcctctcactctctcagtctgtctgataggagatgcttaactgaatcgtgcccccaggcagaatgggctgaagggagcaccaggccctgtgggcaagagaagcagggctggcagggtgttgaagagttctgccagggccacagcttgcctggcatcccttagtttggtgtgaatttcttttgggacaatgatttttttccccatatttatctgtgaaaaactgctccctgaggattctttcctgctgggaggcagagcatggagaactttatgtttcaggttttcatggaggctgacaagcaaagagtcacaagtccaggctggccctaatatcactggttgctcttgtgtggtcactgaaatgccttctcctccaagatgctctccctgcatcgtctcttatctgggtgatgctggccactctgggatgcaaagacacccagcttgccatggtaggagcctctcattctcctgtgggatctccctggttaactatcaaattgcctccacacctgattttggggaatggggattgtcttaaaatttacctttatttcctccaagcccagaacagtcctggaacactggcaactctaaaaacatcaatgttatgaatcttttctgcaggttgtaagacaaggtcatcccttgaccccagtggggtcaggaatgaacccagttcacagttctgcactaccttacctgtatcatcaagtacagcctgcaagattcaaagtgtgctgggtaccatgtctaggatgacaggaaattagtggaagccttagcattgccttagaaagagcttttatggttcattactcaagagctttgtaaagcttttaaaaagtataaataaaatgtataaattctcaagtttgttacattggtgccgtttcctttagggatcagcaagtatctatgaatgcctgaaagtcttctgtgctttctttccagccaacaggacaagtgagatgctgaggaaaggtcctcagtgttggtcaggtcctggcaagttactgcttgcatgcttaggggctgaaatgattccaggaggggccaagaggtatgggcagggctgaggggaggcaacacagaggcaggaaggtgttaagaaacccagcaaggactggaacttgtgtgattgggcccctgacaggagccggggaaatctgacctctgagacccccactggtgcctcccaatgaccaaactcaacccaaaatcagaggcaaaaggagcccacttaacgtggtctacaaaggtcagactcaaccaggcacggtggctcatgcctgtaatcccagcactttgggaggccgaggtgggcggatcacatgaggccaggagttcaagaccagcttgggcaacgtggccaaaccccatctctactaaaaatacaaatattagctgggcatgatggccgcatgcctgtagtcccagctacttgagaagctgaggcaagagaatcgcttgaacctgggacacggaggttggagagagctgagatcataccactgcattccagcctgggcgatagatcgagactcggtctcaaaacaaacaaacaaacggccagactctccagacacaggactgttaggagaagggtagagagtgagttggaggggcaaacgagaacatcattccatcctccatctggactttgtgacagagaaacatgagtgttatgtctatacagtcatgtgttacataatgacatatctgtcaacagtggactgcatttaccacactgctcccatcagatcataatggagctaaaaattcctattgcctagtgacatcatagccatcctaacatcatgtgcaacacatcgctcatgtgtttggtgatgttggtgtgaacaaaccgactgcgctgccatttgtataaaactatagcgcaattatgtacagtacataataatactagagagaaaatggctgtgttaccagtgtatgtatttatcatactatcattattttagtgtattccttctacttattttttttaaagttaactgtaaaacagcctcaggcaggtccttcaggaggtatttcagaaggccttgctgtcgcaggagatgacagctccatgtgtgttaatgcccctgaggaccttccagtgggacaaggtaaggaggtggaagacagtgatattgatgattctgactccgtgtaggcctaggctaaggtgtgtgtttatgtcttagtttttaacaaaaaagttttaaaagttaaaaataaataatttttaaaacagaaaaatgcgtatagaataagaatataaagtattttcatacagctgtacaatgtgtttgtgtttcaagctatgtgttgttataaaacagtcaaaaagttaagagccaggcacagtggtgtgcaattatagtcccagctactctggaagctgagacgggaagattgcttgagcccaggacttcgaggctgtcgtgttctgtgatcatgtctgtgaataaccgctgtactctaacctggacaatatagcaagaccccatctcttaaaaaaaaaaatagacagttggctgggcgcagtggctcatgcctgtaatcccagcactttgggaggctgaggcgggtggatcacgaggtcaggagattgagagcatcctggctaacacggtgaaaccccgtctctactaaaaatacaaaaaaattagccgggcgtggtggcaggcgcctgtagtccaagctactcgggagactgaggcaggagaatcgcttgagcccgggaggcagaagttgcagtaagccgagatcacatcactgcactccatcctgggcaacagagtgagactccgtctcaaaaaaaaaaaagagatagttaaaaaaaattttaaatttgtaaagtaaaaaagttccagtaagctaagtttaattttttattgaagaaaaatattttttataaacttagtatagtctaagtgtaccatgtttataaactaagtgtacacagtagtgtactataatgtcctaggccttcacattctttgaccactcactgactcacccagagctacttcgatttctgtgaactgtaatcatgatgagtatcctatacaggtgtaccatttttttctcttatattatatttttactgtactttttctatgttaagagatagaaatactcaccattgtgttacagttgtctacaggattcagtgtagtatcatgtatacaggtttgtagcctaggagcagtagactctagtatatagcctatgtgtgttgtaggctataccatctaaggttgtgtaagtggactctaaagttgctcggaagacaaagtcacctaacgatgataggctactcagaagatatctgtgttgttaagcaaagcatgactgtaatttcaggtgtagacaggaaggcctagtgcaaggaccagtggtcactgattctgacattcagatcccaccctttggtttgtttgtttgtttgttttttggttttcggttttttggggtttttttttgagaccgagttttgttcttgttgcccaggctggagtgcaatggcgagatctcagctcactgcaacctctgcctcccaggttcaagcgattctcctgcctcagcctcctgagtagctgggattataggcacacgccaccacacctggctaattttttgtatttttagtagaaatggggtttcaccatgttagccaggctggtcttgaactcttgacctcaggtgatccgccgcctcggcctcccaaagggctgggattgcaagcatgagtcaccgcgcacagcaaaattagcctgcagtgatggtgtgtgccaccatgttggccaggcgggtctcgaactcttgaccttagatgatccgcccaccttggcctcccaaagtgagccacaggcatgagccaagaccccaccctttgataggaggaatgttgaatagttgtgaccatttttaatctaccacaccaagaaacttaaaaactgaacttaatagcttcaagccctaaagtcacatgacaaaaccatttttgtgaccccattctttcaaggatcgtttatctttctccctactctccccattcccactccaacccctgccccactcatggttcacttctgtaaccccagattttggaacacccaaaactcctctaagaacatagtcgatgccactgtgattttctgctttcccagggagcagggccctgctgctatgcctccagatgatgcatttattcatggtggcaggtgtattcgatgaaactaaagagattggaaaattatgtaaaatgttcaagaatgtgcatgcttgtgcttacatttaatgggcccattttaaaaagtctctgaaccctgaagccaagacaaagtttgatatctctgaggctgtatgtttaaatatttgcgattctgaagagcctgattcagcgtgtttttccccattctcatccccttcccagttatgtcttccatgtgcaggcgttttcctattcatttccctcatgattgaaatggtgacagttacatctgcattataatctttcatcctgagtcttttacagatattatccagagataagcaatggtgtctttcttttacaggtggagaaattaaaatatgcataaattagcctgaaaaaaaggtaccagaaaacccagagggatctgacattgcttcattttgcttcattttgctccctcatccctcatacagggttttctaacagcactgctcttgacctttggggcaggacaggtctttgttttggggctgtcttgtgcattgtgggatgctgagcagcatccctggcctctactcacagatgccagtagcatccccctgccccccaccccagacccaccaagtagtgacaaccaagactgtctccaggcattgcagatgtctgcgggttggaggatagggaggtgaatatgtccctggttgagaactactgccttccagtagagcatttgaagatcctgggcatcagggactgtgaattattggtctgaaggacggagggcctggggcacagaatatatcttaaaaatctgtttctgatgtaccaccagggttaagaatctattctaggccggggtgcgatggcttatacctgtaatctcagcactttgggaggtcaaggtgagtggatcacttgaggtcaagagtttgagaccagcctgaccaacatggtaaaaaccagctctactaaaaatacaaaaattacctggacgtagtagtgggtgcttgtaatcctagctactcagaaggctgaggcaggagaatcacttgaacctggggggcagaggttgcagtgagctgagatagtgccacttcattccagcctaggtgacagagtgagattctggctcaaaaaaaaaaaaaaaagcaaaaacagtctgtttcagaattcaaatcccaattctctaagcctgggtttcctgatctgtgatactaaaatgataatactgtacctgtctcatacaactttgagcctgaaatctggtaatatgaagcacagtgcctggaatgtcatgatttgctcactacatactagctttcatgatgcttctcattcctctcttgcatctcccctcctctttcttcttgggagcaggtataagagcagaggtggagaccgtagcacccatctgggttggggatttgcattttgaatgtgggggtagagtgcatacgggagctgagagcagagtggggtgatggttcagatgagccctggtgggggccagcatggagcctaacagtcaacggcaaagggaccctccatagaggaagaggagcggtagagtgatgtgaggctctgagtcctgctcatgtggcaagcccataattgtaggatttctgagaaaattagattctatatgaagccaaggtcaagtttctcgtactgggaataggtgtccaagttggggtgaaggtcattggggttaaatgggtcatggatgtggattggagggtgtgggatggttcatccctgatggccgagcctcccgtgctgatataagacagtggggtgatgaaggaggcctgggaaccagaggacattgtcacatcaccctgtatgggatggacccagatatcagaactgcattttgacatggctggttgggataacaaggtatctggaagcccgtgtcatgggagcaagggctctgaggagttctggaaaagaaaaggcatctctcaggtcccctcctttaatggaagtattgaatgctggaggaaacgtcattgttctacaatatgcccaggacagaatgcaactggagtgggtgttaagaggcaggtttccattcaaggaaggctgtgcttcagtagaaaggacaaaatccggaagtatgaactctccattcttcccgaggctggataatgatgtcccgtcggggatgccctagagtggtgctttccgatctttttcaagttgtgccacacatagaaaatgataactgctatgatgcaggaggaaaatagaaaagttgcctgaggatgccagccccgcccagtagcttagagggcgtaaacagatgagtatatttgtcacctgtaattcaatcgtggcacactaaggtgcctgggcactccatttgggaagcccagctctggaggaccttttttggtatcattggaatgtagtgtggtgggcagcatattcccctcttggcattgttccctcactccttagcaccatcctgcaagacacatgtcatgacgcttaaatggcagtgagtcagtggaccctgcagcactcccagggtcaccctgagttcagggattcatgtctgaggcccatgctcctggctacttagttgagatgaccccttgggttcccttcaattctgccagtcttccgttctttgaactgtatcccagatggggtgcggaggtgttcctgtgtcccctttggcccttttattaggttgaccctaacccaacacatcttgtgggaacatttcactaactctctgagccataacttcttagtctgagatccctgattgttggttcatactttcaagatgtatttctttcctctctgtttaaccaattgtcattgtcgctcagcttgaggacaggagactcactgtttgcctatttgagccaatcaccatctctcttgtccccaaaatgtaattggaaggagccttaatggtttccaaatgataatagctccataagccgattaaaaaggccttaataaaactgtcttgagttattttccacagctgcagacagtgtcctttgttttctaatgatgccaacaagaaatcagggcaatttttctttctagtgtgatctgaagcaccaggaaggcctccttccgtctgtctgactgctcaccccgtcttcttttcttcccagacaatccacgttgctattgtctgcgccggatacaatgccagccgggatgtcgtcaccctggtcaaatccgtcctgttccataggtaagaacaacttctgtgctgtgtgggctgaggtctgtcactgcctgcctgtgtatttccttggggaagggttaaataggagcaaaatttctcatcaatcattctagctgccataaaaatgtaatttttgtctgaaaccctgaggagatgattgtgttaacaatgtttaatgacagcgattaggtgctgtcttgccatgtttagaattgtaactctcagacctaatgcaatcttaaaggacacctcaaatctgatgcttcagtctctctatcagcttcccctgcctagcatttaccagatctcagttgttatacatccttgtcggtaggttgtgttatggattgagttatgtccaccacaattcttatggtgaggccctcattcctggtacctgagaatatgactgtatttggagatagggtctttaattagattaaaatggggtcattagtgtaggccctaatctaatatgacaggtgtcctttaaaaaaaagaggagattaggatacagacatgtgccaaacacagaccatgtgaacatacattgagaaggaggccatatgcaagtcaagagagcggcctcaaaagatcttggacttctggcctcacagacagtgggaaaataaatgtctcttgttttatccacctagtcggtggtgttttcttatagacaggttgcttcctctattctggtgtgggctgtcccacttttgggcatttctgactgtaaaaaagtcctgccttagttaaactgtttcccaacctgcggatgatctccattgactctcgtggacccccatgggaaccatcatcctaaggattggttcttcttctacctggaagtgataatgcctctggatgctcatctcttctccatgtgacacttccagcattggcttctgctttctcatggaacttttcttctgttcctcactattttgattggcatctagacatacccagggtcctatccagaatggtgttcatggttccagccagtgtccttggctctgctttaacactcttgccaagggtttggatgaagcttatccacagctgtagccaacagcatggaaacctgttgggtggatgagtcaggatccaggaggctctccatagtaggaatagtggtgaaaagtttgcagaggtcagctgaacagagatcagtgtaaaatgctgcacctgaatctgtcaatggcataaacaaagatgggaaccatggtgggcttcaagacctaccaaccctgcaaggaactgggattcgtcattggttctaccttctctctgtcttccaacaagcccatctgcagtcagtgctttgcgattctccctctgagatagttttcactttctccccgttctctccatccccactgcaactgatgtcattcagggccacctatcctctcaccttcatgtgtccttcctgcttccccagtttctactcttcagatcatctgctgtgattccagaatgacatttcaaacaggcacatctgatttctcaaaaccttttagcggcttctccttgtcaaggggtggaaatcaaacccttttaccatggcacaaagaccaggttgatctccatagtgctttctgtctcctctttttgctttgactttgcactccagcagctctgacctgcttgtagctcccctctgcccccatagcgtgtccggcctgttgtgtctggttatgctgctctgtctacccatttctccctccttctccatttcctcccaccctcaccttggcaaactccctcttagcctttaagactttacataagcatcttttctaacaggaagccaaccttctgcctgtgttggggtttctcgtctaccagcccacaataccccctgtgcttctttccatcattagatttattacattatattttatatatctattaatgacaggtctgctgtagcagaaggtgggctttctggaagacagaacccatgccgtcattttctgtgtccctagtatcttagcaaagtagctgacacgtattacatgctcaataaatgtttacttatttgacaagtcagtctgggggagttcattaataaagaacgtgaagatatatattcaatcagttaattaatatatccagcccagacttagttcagttccacattcatgacactatattgctgagtgattgtcagcagttcgttttgccttatttttattttttattttattttttttgagatggagttttgctcttgtcgccaaggctggagtgcagtggcatgatcttggctcactgaaacctctgcctcctggattccagcgattctcctgccacagctgcccaagtagcttggattacaggcgcctgccaccacacccagctaatttttgtatttttagtagagactgggttcctccatgttggccagctggtcccaaactcctgacctcaggtgatccacccaccttggcctcccaaagtgctgggattacaggtgtgagccaccgcccccagccattttaactctttagactttaggttttttttttttttttttttaaatcagttaacttttgctgtgtgtcagttcaccctaaaacttaatggtctgaaacatttacttattagttcagttgtttctactgggctgacctgtacggttcttctgctgggccacttacgtgcctgcagcaagctggcaagttagcaagcgtcaaattcactgcccatcctgaatggagaagtggataggagaagtaagcaatcaacaaatagataacagttcaccgtagaggctgtcagttcttcctcatagcgctgtccagttggaattatgatttcagttgtatatttgaagaggaaatggaaacaccaaagaaagaatggccaaatggggcttgacctactgtcttctgacctgaggtgagatgccctttccacattgttattgtttctctgcagttttgaaggctcctttcagtactacggccttcatcctgtggcttaaaaccaggcattttgtacactaagcattgaatgagatgagtggtcttcagacttttatgtatttactacttgttgccatgacgtatcaggtctctccctggtttaaaaaaaaaaaaaaaaagcccactttctagaaaagggcctttgcatgatgtacaggtattcaattacgctatttctcaattatggcaaagttaaaggtcataaaaacctctggtgttgtgtataaattttattcctgttgccctagctgcaaatcagataatctaatagttgttgaaattgtaagaatcctgttgggtgtaaacttttactcctacagtaactgtgcagcacaaagatgttaaattaaaaaatagcggtagtaatattattagctgctgatggcatgtcgtacttttaagacggcgtgaggacttgagaagaaagcaaatccttagtatgtgctacgaaaattctgcatcccatttgttatgctgagcccctgtctactccagtgggcatggcactaggttcaggaggccaaagaagaaacccagggccagcaaatgagacgttgggtttaactgggggcttacatatatggggagagattccagtggcagcgggctggacagatctgccttacgtacagcccagtggcaacaggctggtcaggagaaccccaggacccagtggcagcaggttgggcaggaaaactgcaactacttatgaaaggcatgcagtttatataacattttggcttagcacctgtgttagtccattttcatactactataaagaactgcttgagactgggcaatttgtaaaggaaaggggtttaattgactcacagcttagcatggctggggaagcctcaggaaacttataatcatggcggaaggtgaagcgggagcaaggcatcttcttcacaagatggcaggaaggagaagtgctgagtgaagggggaagatccccctagaaagccatcagatctggtgagaactcactcgctcactatcatgagaacagcatgggggaaaccacctccataattcagtaacctccacctggtctctcccttgacacatggggattatggggattataggaattacaattcgaaatgagatttgggtggggacacaaagcctaaccatatcagcaccctttccctaacaacctccagtgggggtggcaccaggaggttgccaagtagcaccacttcaatcatcccaaaactcagggcctcaattccctgtatggcttgtattccatgggacagtttgggagctcagatgtttcttatagacaaggaatgaatctccaggttggcctttcctggattctccagttcagaacatacattcaggtacgtctgtcaaacagggtcattctcagggtatgcttaagttattgctgtcaggtgcgtttaccatacaccattttaatgactactgaccaccttggaccaaattaccacagaagttcctgtcatccctgaaattatacaaatgggaatgattctgtgaattgatatgctggtgatgagttgagatacaagacaaaaggacttttgaaagactttcggctcagaaagtccagctataaatagcttcattgcttcccaagcacattatggggattaactaatacatggttataaaatacattgacaaatgaagtaccttactaatgttaataataatataataatagtggtgcaggatgcttcttttggctttcactgttaattatagtaattagatttattttccagacaagatttggtgcaaattttcatttaaggcttgcttcattacatcaaatcagttttacttctgccatatgcttgatgacatatttcaaaagatagtaaaagagtaatatagacacacttgcacactaatgccaacgctgacaattgctgcgacctgttggagagaaattaatacaatgtgggaagaccttgacccagtatgaccaccgtagggactctcccttaaaaagagaaccctaacaatagaaaaaccttttataaaatattgctttataattataaaattggataatacttaagaacagaataaataatggaacattctcttatggtaaaccatgtactcagttttgaaaagtatggcataccatgaagcaatgcttatataaaataagtgaaaatataatttaaaatgggatgcatcgtatatatttcagtatacacacacatgcctatatgtgacatgtacacatatacagggtcaaaatgcagactagcagaaaatacataagaaataggacttttgcgtcttgtgtttgggtggtagaaataaaggtaatcttgttttttttgagacagattcttgtcctgtcatccaggctggagtgcagtggcctgatcttgatgcaatctcagctcactgaaacctccacttcctgggttcaagcaattctcctgcctcagcctcttgagtagctgggactataggcatgcaccaccacgcccggctaattttttttagtggagatggggttttaccatgttagcctggctggtctggaagtcctgacctcagatgatccacctgcctcggcttcccaaagagctggggttacaggtgtgagccaccatgcctgggcgtaatcttgtttttgttttcagtgttacatatatttttggttgtgtcagcatgcaacctctatggtgaagaagaaagatggatgagaaaaatatatacaaattataaatgacaaaggtttgtttgttacccagtagaaaatagcacaatacacgtctgtatcacctagacggcaggctattcagaggaaaattggggggaatgcctgtgactccaatcccagttgcagataaacggggaaatattgctgctcttcaaggaaactaaactcttagggagcagagaaaagaaatatttatttagcaactaagtgtttacctcctgggcaggaaagtggatcagcttgtaaaaatttaatatttgtttgctagcatgatctgctttcacactctacagccttgttggcaggatgaagctgggttatttgccttactttgcatatcaagtagttgtttttggttttgtttttttaaacttcacttgtgcccctgaaggacgtggtgaataaaagagcatattcgtgaccagtatctgcctttaattgtcttatcccttattcaggcttgaattcattgtagaactgtctgagttgtgcataggatttgaataaaacaaagaagcaggcctgggttctggttctgctcctaccaggcctgagctgggtgaccctaagcacgtgcctctacatcttggagctttggcttgtttctcaacctgccttagagccccgttttgaatatgggaatataggctgtatgtaatacttgtctgtattttatttatttaacaaatacaaatgtagctcttgctctgtatcagggtctgttccaagtgttttccagatggtaatgcattgattcctcatatgccttcaggaggtgagcactattatgatgtccattttactcagagttaaactaaagaacaagatggtaagtcgtggctcaaggtctcagtgagaagatgggcagagcctagttggaaaccaggcaatctagcttcagaatctgagcttctcaacaaaaagaagttctcatttttagtatcatgcttcttttttctttttttctttttttttttttttttgagacagagtctcactctgtcacccaggctggagtgcagtggcgcagtctcggctcactgcaaactctgcctcccaagttcaagcaattctccttcctcaacctcccaactatctgggattacaggtgcctgccaccacacctggctaatttttgtatttttagtagagatggggttttgccacgttggccaggctggtctcgaactcctgacttcaagtgatctgcctgccttagcctcccagagtgctgggatgacaggtgtgagccactgtgcccggtctcattattcttacttttacttttaattttcattctgggtgatagtgtagacgttgtgatctccataatcattttgatgcaggattttttgttccttagctcagctaggtctgggttcttgtctcgtgaccaggaagaattaggcacacggacactcaaagaatgagcaagatgggaagttttattgagtgatgaaacagcttttagtggggagaggatgcggggtggtccccctactcaaaggcaggagagttcccaatatagctgagctcaaggcttcttatgggctcagaataggaagtgcatgctgattagtttgtgactatgcaaaagaggttaaagcaaagacaccacacaaaggtgggcatgatagtgtagaaaaccgattaggaaagggtagttatgtgtaaaataggtgaaggatgtggattaattaggggaaatcacaccaaacaggaaggcgggttctcaatccagttccagaatttacccaggactgtttctggcttgaaggttggatttcactggggacctgttcctttctgcctaggcatttgtctgccttttgcctctatcaattctcaccccttccaggtatgtatttttgaggtgttaagtgtagaatcaatacaggttttaaaggcctgggcatcagtatttctagttaagtcttaagaaaatagcataggcacgtgatatctttgaacaggtaagagatcaatggtatttggtcatacccataaatattaaaaccaaaaggaactgctttttatagtgcagatgttaagcttcacatgggctattgtatttgaatgttatcccgacctggtgccattatccccataaacagatgaggaaaccaaggctcagggaagttaaatagtttgttcaaggtcacagatgaatcagtctccaacctggactctgccagcccctacaatccatgctgcttttactgcattacaaggccttttgatttttcttgaaagttgctctgttcttctcttttggaaagcttttctgatatggcactgacttgtccttgaatcttcccatatcatcaaaggcacttggccactctcaaatgaaggactcactgaaaaactctcattctggctgcggtgattttctgaaatgagtcctattaaatctgtaagtgcaacagattcactgagaattcaggttgctgtcacacgcgctttcttttcctaagtttgccattgcattgtaaatttaataattaaagattatttcagctcaaatgtccttgtatattttaatgaaaacaggccctagattgccttggagggactgtggcacattcctgacaaaataaggaaggcaggaagaaagcaatggcttaatcatctttgcctctttgtagtaccatatttattgcatctcagcctggaacaagggagcagttaaggaaaccagagggagcagaagcgttgctcattaagagtgaagtctgcaggctctgctggagaggaagcacatacttgcttccttctttggtgtagaattgtggtctggtctgtctgtggaccacacttgatgtctgcagcaatatgtgggttgcagtaacccaggcatgctatgtgggaccactctgtattaagatgtgtacccaagctggcctggccaggcagaagctttttctaaggggcctcaggcagtgctcgcaagtgtatttataactggtagctggcataaaagactattttagatgttatacaaatataaaactaaatagccttgaatcatatattgagaaaattattcctctgaatgagttttattatctgcagttggcgaaattctctttggtgtaaatatgtccttaacatctgtctaactcttgctaatctccctttgaacaaaagagaataggatgtagactcataggctttggctgattttggaatttgcagggctctgtcattaaaactatttcttaccttcctgagttaggaaccaaatgtgaaataaggctcagaagtcacgcatataaagaatgaaataagcctcctttatggccgttagtcttgagtataggatgttctttcaactgtggccacaaatagagctctcacttatgtctccatgaattggacttacctcccggtcagaggccagcctggacaattgcggggtttcccacatgggcacaccatttactgcttagcacatccccctagggaaggaagcccagaaacagaagcagagcaggcctccttccctctcccaaatacacaggtcagaccaacattccaatatttgcctattcctctgagatgaataagtaaatatgataaaatttgctctttaaaagtgtacaatttagtggttgtttagtaaattcacagaattgtgcaactatcctcagtatttaatatcagagcatttttataaccttaaaaagaaatccccagccccaatactactcatttcctcctcttcccatcccataccaaccactaatctgctttctgtctttttggatttgcctgttctggacatttcatgaaagtgaaatcatacagtatttagtcttttggactggctttttttcatatggcagaatgttgtcaaagttcatccctgatgtagcatgtatcagttcttcatttattttaattacccacaaatattccattgtatgaatataccccattgtattatccattcatcagctgatggccatttcagttttttccacttctttttttttttcttttgagacagagtcttgctccattgcccaggctggagtgcaatggtgtgatctcggctcactgcaacctccacctcttgggttcaagcaatcctcctgcctcagcctcccaagtagctggaattacaggtgcctgccaccatgcccagctaattttttaattttttaaattttcttatttttttgtttttgggagagacagggtttcgccatgttggccagcttggtcttgaactcctgacctcaggtggtccacccacctcagcctcccaaagtgctgggattacaggcatgagccacagtgcccggccatccacttcttgactattatgaacaattctgctaagaatgttctgtataagcttttgtgttgacatctgttttcatatttttatagatatttttatttttatgcttaattttttgagaaattgccaaactgtttctcctaccagctgcttcattttacagttccaccggtaaccattgagggttccaatatctgcaaattcttaatcactgtttgttatatatcttttttatttttgccattctagtgggtaagtggcttattgtggttttgatatgcatttccctaatgattaatgatattgaatgtcttttcgtgtgcttgttggccatttgtatatcttctttgagaaatggttatttaaatcctttgctcaatttttattggcttacttgtccttttattgtttgagctgtaaagtatctttatatattgtggatacaggttgcttatcaaatatatgcttgaaaatattatctcccactctggtagtttttcactttcttgatcatgtcctgtgaagcacaaagtttcttccttttttttttttttttgtttttccttaacactaatttatttcatatggttctgaagttggggcagtctgagatcagggtgctggtctgagatcgggatctggtaggaatggacccttttcctggtttgcagatggccaccttcttgctgtgtcttcacatggcagacagcagaaaaagagaaagggttttttaaaaattatttcagtgaaatctgttttttctttcattgtttgtgcttcagggaccatatctaagaaacaattacctaacccaatgttaaaagatttgctcctgcatttttttctaagtgcctctgtacctaacttccaggtaattatgtcaagctgtgggcatttgaatctctttggtaattgcgtcaaactgagggcatttggatctttttggtaattattcatgtgttcatttattcattctttccttaaacaatcactgagtatttctacctgtaaggggctgtaaaaaaaaaaatctaggtataagattcttaacaaaataaagcatccatgctaagattccatctagcagggaacaaagaagaagtaaatagtcgattatttcaaagatctgaactaaggtttgagcacagactcagctggagccactaagaagggcgtctgacaccgtggaatggcctcctcagaactgtggtgtctaacttgagaacagaaggccagacgcagttagcggggtgaagcgtagatggtccaggaaaaggcgacacatgggcacaagcctgccaggagagcatgctcaaccctggaactgcacccgagaccagctagatgctctctaagcgctggggttgtagagagtaaacaagagaggaggtactttgtgaagctggagaagcgctatcctccacagctgacagtctcatggagggtaggaggtagtcttggaggttaacatggagatttccagtgataataaatgctaggaagaaatctgacaggacagtgggatggagagtgatgggggagatggggctgcgttggatggggtgactgtggaaggtttccccgggaatgtggctgttgactttattcctgcaggaggagcaggagctggtcacaggcagaactgagggagaaatggctggagtgcagggtttaaggaaggggtgtgaagatatgagctttgagggacagatagggtgagatcgttgaaggtcttttttgctccatgcgagaggctggggcttatatattgtacagtgagcaaggggctgtgtgattacattagagcaagtgtatggcttaggggctagaggatatatcagagtgagttagagagtcagaaaaacagtgaatatattcatgagaaaaaagagtgaatattttcatgagatgtccccaaggttggataggataatgaggctaacatttactaagtcctcacttcctgccagtccttgttgtaagtgctgcatatgttttagctcaatcgatctgacaataactgtaaggtaggagctattgtgatcaagcccattttgaagatttggaaactgagactcagaggtgaagaagctttcccaaggttcaacatttgttcatgacagaaccacgttaagaaaaaaaaaacaggcagttttgctttcaagacccagctcctaaccattaagctaagctgcctttcaggacttgaggttgattgagtgtgtggcatacagctgggtggggggcccagggcatacccccatttctagcttatgaggctgggtgaatgaggcacctttaacgcaggcaggaaattcaaggggaaacctgtgtaaggggccaggagagggaaaactgatttctgttttggaaattgaggaagccactcatccatgcagtcctgcagaataaacaaaagcccctccttactgtgtcaggtggtgctctgggagctaggatgcagcagtgaatgcaagacccagtctctgtccccaaggagcttaaattctaaagaagagacaggtcccagacaaacactccacaaatcattagaaacttggtgtgtagtagccgggcgtgatggcacatgtctgtaatcccagctactcaggaggctgaggcaggagaatctcctgaacccaggaggcggaggttgtggtgagccaagatcgcgccattgcactccagcctgggcaaaaagagtgaaaactctgtttccaaaaatagaagaaacttgtgtgtagtagaattgtaattgggtgcttcttgattcccagggacctgtgggatgtgaaagtggggccatctggttgacagtcagatttacaggttaaagctcaggggaactatttcggcttacacagaagctccaagaaaggtggtctgggcagtattttcatgtgcttgtgccatggtttggtgagcctaaaaggaaaaggccactatcaggaactgcagtctgggcccaaattcttatgatggtacccaaagtggaacattaatggaacccctcaagcatgctgtctgataggagtcagacacaagctgctgatagttagcccgcctttgattgctgagacaatatcagcaaactgccaaggtcttggttgtcacctgggctgaggggctcatgtgttttctgattaagcatttgtatattctcaggcaagctaatgaaacccactattccctttgacaatgcagacacctagtattgccataaaggtgagggtgaggtttctttctggatttactctgccttctggacagaagctttaaatagaccagaggcagaagaagattgaaggaggaagccccatcctaatgtttgtagcatctttctttaagggcttgctcctcttaccccacactggtccaccttctgctctgtaaccaggttaaaacttcccagaattataacttctatttgctgcctgctgagcctccaaaccttgtctggctgtttctcttagagaatgaagtttgcagttcctaggaactcacacattctagcccagtctgtcctgtagacgtggtctctctttttttctttttatcctccctatttctggcattaagtaggtgtgcagtaaatgttgttgtatgatccacccaaatatgactattgttctttcacagacctgctctgtactttaccacctttgttcctttcttactctatcagagttgtcccttggtatatagaggggattggttccaggcaacccacatatccagaatctgcacatattcaagtcctgtagttagccctatgtcacctatccctgttagactgttcttgtgttgctataaagaaacaactgaggctgggtgctgtggctcatgcctgtaatcccagcactttgggaggccaaggcaggcagatcttgaggtcaagagttcaagaccagcctggccaatgtggtgaaaccccatctctactaaaaatacaaaaattagccgggcatggtggtgggtgtctgtattcccagctacatgggaggctgaggcaggagaatagcttgaacccgggaggtggaggttgcagtgagccaagaccatgccactgcactctagcctgggcaataagagcgaaactctttcactgggggtgggtggggggaaacttaagactgggcaatttagaaagaaaagagatttaattggctcacagttctgcaggctgcacaagcatggtgccagcatctgctcggcctctggggaggcctcagggagcatttacttatgtcagaagggcaaaaaaggagcaggcacatcacatggtgaaagtaggagcaagagagagggtgggaggtgccacaatctttaaacagccagctcacatgagaactcactcagtattgtgaggacagcaccaagccattagggatccacccccataacccagacatcttccaccaggctccaccttcaacgctggggattacctttcaacatgagatttgagtgggggaaaaatatccaaactatatcattcctctcctggcccccgaaatgtcatgtcctcctcacatttcaaactacaatcattgtttctcactagcctcccaaagtcttaactcattccatttttaactcagaagtcccaagttcaaagtcccatctgaagatgagttccttctacctgtgagcctgtaaaatcaaaacgcagtatttacttccaagatgcaatggtggtacaggcatgaggtcaacactcttattcccaaaaggagaaactggccaaaagaaaggtgctacaggcccccacacaagtctgcaacccagcagggcagtcattaagtcttaaagctccaaaataattcttgactccatgtcccatacctagggcacactggtgcaatgggcaggctcccaaagccttgggcaggaacactcctgtggctttgcagtgtacagcccctgcagctgctctcatgggttggagttgagtgtctgttgcttttccaagcacaaaggtgcacatcgccagtggatctaccattctagaatgtggacgatagtggcccccttcccacagctctgctaggcagtgtcccagaggggactttgtgtggggtctccaaccccacatataacctaagcactgccctaatagaacatctctggtgggctctgcccctgtagcaggcttctgcatgggcacccaggctttcttatacattctctgaaatctggtagaggctgtcaagcctccttcactcttgcactctccgtcctgacaggcttaacaccccatggaagttgccaaggtttatagcttgcactctctgaagctgcagcctgagatgtatcttgggccctttgggctgaggctggaactggagaggccacaatgcaaagagcagccttttggggtggtgcagggcaatggtgtcctggccctggcccaggaaaccattctttcttcctaggcctctgggcctgtaatgggaggggcagcctggaagacttctgaaatgccttcagggcctttttcccattgtcttggctgtcgtacctggcccctttttagttatgctaatatctctagcaagttgtgggttcttctcccccaccacccaccaccaccctataaagccttttctttcttttccacatggttaggctacgaaatttccaaatttttacaccctgcttccctctttaagttccaacttttagatcattgctttgctcctccatctggacactttgctgcttagaaatgtcctctggcagataccctaggttgtcactcttaagttaaaacttccacagatctctagggcatggactcaatacagtcacattctttgctaaggcacatcaagggtgacctttaatcaagttcccaataagttcctcattcgcatctgagaacttgtcagactggacttcagtgtccttatcactatctgcattttggtcacaaccattaaaccagtctataagaagttccagactttcccatcttcttctgagccctccaaactcttagcccctgtatgttacccagctccaaagttgcctccatattttcatatatgtttatagtagtatctcactcctggtaccaatttttctgtgttaggctgttcttgccttgctataaacacctatgactggataatttataaagaaaaatggtttaattggctcatgattctgcaggctgtacaagcatggcaccagcatctgcttggcttctagggacacctcaaggagtgtttacttatggcagaaggtgaagcaggaacaggtacatcacatgcaagaggagagtgggagcaagagaaagtgtttaaaaaaagagaaactctttttttcttaaactcttaaaaactcttaaaaaaaacttcttaaaaaaagagtttctctttttttaaacaaccagatcttgagaaaattcacatcatgaggacagcaccaagccatgagggatccgcccccatgacccaaacactaaccatcaggcctcacctccaaaattggggattacgtttcaacataagatttggatggggaaaaatatccaaactgtatcacagcctgtgggaaaaatcagccctcagtatagctgggtttcccattccagattttgttgaaaaaaatccatatgtcagtggacccatacagttcaaccccatgttactcaacggtcaactgcacttccctgctgaatgcctccctttctcctcctctgcccatttagagctcccatttaattgccacatagttcatggaaacctcccagattcttcactaccaaaatgtcatctctttcaccctcaccaccatgtagcttttgtgctcctccttgtagagtcgtcatatatggttgtgcaggttgttttcaatctaactctgagagtgtcctgcatattacctgttggtttatgtggaaggctccctgggaagtgggccattcccaagctcagctgttgtgggtggcagcccagcacagcggcgcatccatgttctgacgtttgtggagttttttgtattctgtcttcctctgactctccaagatcgtaagctgcctgtagagaacactcgtagctcattcatcacctgtatccctgttgtaacttatatgtagttattgcttaatagctctttgttagatattcattcagcccgttttttgtctgtgcttggaagaactaattgaaaatacttcatcaaaaacgcgatgcaaaagtagtagagaaaaaaagcagtatcataagttaatattggtaatagataacctgtattgaaatcttaccatatatcaggtagtactttactaagcactttatgtttattatgttattttatcctcacaattatccagtataatattccttgcttcccattatctctttcctgctttggagatgagaaaattaggccttgagagatgaagtgacttgcttacagtcactcagtaggtactgcagccgggatgccaagccaggcattctggaacatagtccaaactccgaactcttgatacaaagtgtgccatcaactgtttctgccctcctatgctggtggttacagtgataatacaaggaggggcattggctttttgttgttgttacaggaatatctattcaggacccatgattcaccaggttctttgctggatactgtggatggggatgaaaagatggtttctgtcgtctgtggtctcacagtagggacaaggagccagcagtttaaatacgtatcacaatgccttgctacagatggcggatgagcttttcacacaaggtgcagagttagcagaagaaagacacgaggaagtgctcaaagaagatttccaggaggagatgacttacaaagggaattttgaagaatgaacaggaattcatggggcttccaagcagggaagggcattccatggagagggaacagcacaagcaaagatacagaaatatggaaagtatgatgcattagagcaaatataagaagcttggtccatttattattgtcaccccatggctaaaattaagctgcccctctactgtagatgaacatgcaacttgaccatgatataggcttacctttatccattctccgttaataagaatccattatggcaactgtggccttgggagacagtcgtggaaacactgagggccaaatggaccgtctgtctccctggtgactttgtcctgctgcctctgacttggccctcaggtaagccactggccagtgggcaaacacagcattgtcccttcatgccaccaagcatcaccaaggcccagtggcagcttcttatagggcatttagggaagctgtagggaaaatatgcccctttcccctgagcatggtgagcatagataattttatgggaaagttgcagtctttaaaaggcagtgggtcccatggggaaattctgcagtgctgactgctttttgattcgtttattcagtttattacccttaggcacctgttacatgtatggcaggttggccttgagaaatttctttcttcaggtctagacccacccattcagcagcagcactggctttgccacccctgacttcagcttggttgcccaatcccagactcactgtcctcctccaaggtgcctttctcattgtattccctgtcctggagccattgccgctgacccaggaaccccagtgttgccttctgctcctccctcttttttttctcatatctaatatctgttctcctgaaatcctctagatccagcttccttgttgctcttcctgggatagacactttttttttttttttttttttttgagatgcagttttgctcttgttgcccaggctggagtgcaatggcacgatcttggctcacagcaacctctgcctcccaggttcaagtgctgctcctgcctcaacctcccaagtagctggaattacaggcatctgccaccacgcctggctaattttgtatttttagtagagacagggtttcgccatgttggtcaggctggactcaaactcgtgacctcaggtgatccgcccacctcggcctcccaaagtgctaggattacgggtatgagccacggcacctggccaacactgtcttaatcggattctcatttcacatccaccaagtctaatgatctcctaaatgacatgtctacatctgttcccctcatctcccatctatccattcagttcattgattcaactcctactctcttctaggcactgtgctgtagatcatgggcctgtctatttgaatgtatctgatgtgatccttgagcttgctgagctcacatggggggtgtagacaagtagacaggcaaccactacataaggatgagtaggccggtacgtatggctgggataacagttaggaaggacccctgacctagatgtgggtagtcaggaaaggatcctaggagcaaatgatggcggtcctaaggcagactaagagataaccaagtgctgaatgtggaggtgcagggtgggcaagactgtgagctccatgacagcaggggcagtgtgggtatgtctgactcaccactgtgtccccagcatccagctcatcccctgacaaatagggtgtactcagtgaggatttattgaatgagcaactgcgggacagatgcctgcagagcaagctaaatatgataaggcccagggtggagagagagcacggggtagggggcgggaaactgagagatggtctgtatgtctggaacataggacaggtgtggggagtgaccatgccgacggccgagagctaaaaggccagtcatcctgccccccacacctccctgaagtctagtctgttaatttttattttattttattttatttcattttattttatttatttattttgtgatggggtctcgctccatcacccaggctggagtgcagtcgtgcaatctcggctcactgcaacctccaccacccagattcaagcaattttcctgcctcagcctcccaagtagctgggactacaggcatgtgccaccacaccaggctaattttttgtgtttttagtagagatggggtttcactgtgttacccaggatggtctcgatctcctgatctcattatctacccaccttggcctcccaaagtgctgggattacaggcgtgagccgccgtgccctgtccaaactgttttaattaaactttcattgcattctcatgtccttctctgctccaaccctggagccctactaagcccctccgcccccggcccccactcctaatacaccctgggcccagcctttgtctgttgctctcctcagattgcatcccctctgccttcttctcttgtcaaagtcctgcatttccctttagggcacagcttccctctcctcttacacgtccttctgaccctgtcagaattggctgctgctcttactcccgtggaactttgtgttcttttgtagtccttatcacattccgccccgtgcttatatttaactgcgctcgtctgtctctgagcagtatgagctctttgaggtcagcgggccgggtcattctcatctttgtatttcccacagtgctttatttctagtaggtactcattcatggcattacgctttatgtcattatttgtagtagcacaatagtatttatgctagtagttcttgactgacgtattgctttgtatctagccagtagggcgcatctgctattgattattatcccatgtttatttttgatgtgccgtattttgcacttcttattttatttaatcaacacagcagcctgatgagaaggtctttctccacattttccagaatgtagaaatagcagtgcagaggggtaagtgacatgctcaagattcccactcatacatttcagacctgggtttggaacctgtttccatttaactccggaagttttgcccttgcgtaatgctccttggtatttcgggtgctgcctcagtaaaagcaacatcagacatctcagctcctaactgaaagtgttcagggcataatgaagttgtttgccaccagaatctgattttattatcaaaagtattaaagtaaccgcttggttggcacagaatccactttggtctgagttctggccaccaaagctttcagtagaggctggaggccattggcttagtatacaacctggaagtggtctatttcagatgaacaaaagctatagaaatattaaaagtgaggacaggctgttactgggtgatgggagctcccgatgactccatcttaaagcctggttttcttttggagaggaacaagcagaagacagaacttacactgtgctattggagaagtctcttgccagccgcctgcagccagtctaaaaaacttacactacattgttgtgtttctgcgttaaggctgataagtcagatataaaggttgaccaaattgttaacacatgctctacttacggctttcagaaaaaaatgaatcctaataacaggtatggcgtttggcctgaattgggtgtcagtagtgattggtggttggttgtcacttctctgagtcacagaggttgggtgagatgacttctctccttttcagctcctgcagcctcaccagtgagcactgttttcgtaacattccagatttactttcacaattgccgttagaaacgtgccccaccgtaggaactgtgaagagtgtgtttttgcagctgtaattcaaagagccgtacctctccacctgacccttccttctcacactccccacagacggaaccctctgcacttccaccttattgctgactccattgcggagcagatcctggccacgctcttccagacctggatggtgcccgctgtgcgtgtggacttctacaatgcagacgagctcaaggtatgggcaggaggggaggcacttccgtgatctcctctagctggaagcgttattacttgtggttgagcagactgtagcaatgccagaaatctcagctcctaactgaaaatgtgtagggcgtaaggaagttgtttgccagcagaatctgattttattatcgaagtattaaagtaacccctttgagtgcacaaaatccactttggtctgtgagttttgaccaccaaggctttctggagacgctggagagcattggcctggtgtataatctgaaagtggtctatggtagctgtcatctagagagttccattacccagtgaagtaaaggctgaactcagacccccatgggctggggtttaaatttgcctgttgtcacttactgatcaaaagacacaaagtaaaccacgcatctctgctggacctgttttctcatcagtagaaaaggtggatgaaataccaaactcatggggataattaagaggctcaaatgagagaatatatttgaatgtgctttaaaaagacactgctgaataaatattaaaggttatgtcaggctggaggggtttcaaccaaatgaaacctttttggtcatctcttccccttacaatttttttgtggtgccattttgcttgcatcgtgttgagacccacagcccgattaagaagtcctgtatattctggctcttgattctacttccagtcttgtcactggcattcccgtaaaccttcgctattcctttaactctaagtagcagagcacacctctggttccctttgccccctcttctgtgtttgagtctttgcttattctgttccttccatctgatatttccttcccacctatcttgccacaactcctgttcgtacttcaggactcagctgcagtgccaactcctcttaagaaacagcctgacttccacaggaaagaggaagacattttttgttcacttgtctgtctactgaacctttcttaatggggtaggaggagaggagccgcatcttattcttttctatatttctggtgcatagtaggtacccactaatgcttgtggatttaacaaattgctgtgattagaggaacatgtaactttgcagaaatgcactgatgctctgtctctgatcaccttgggaaggactcaacacctaagcatgaggctgactctggcaaattgcttgttccaaacctcataaagccattatcttttcattttagagccatagcatttttaatagatcactgacatgccagccagagtttctgattttcacatatttcaggctctgaggttgatggagatgttcagaatttagcatttggggattgtcttggtaatttgcgtgccattcccaatctattctgagcctaaaattgattaacactcttaaaaagggaaaaacaaaatttagcaaattgctgcgctaattaaggtgaaagcaagccactctgtctcccagggtcttagcgccaacaccatgggggaaaagcaacatgggaggaggagcagcagctggttccgaaggatgcctctgccgctgtgttcaccatttacctttctttgggtaggagtccagtgccatgtcccctgtgagcctgcaccctttactttgtaagaagacaccgaagtgtgctgggcgtagtggctcatgcctgtaatcccagcactttaggaggctgaggtggggaggatcacttgagcccaggagtttgagaccagcctgggaaacatagtgagacccccacctctacaaaaaaattttaaaaattagccaagtgtgacggcacacacctgtagtcagtctaagctgctctggaggctgagggcagggggatcacttgatcccaggagttcgagaccagcctgggaaacatagtgagatgcgtgtctctacaaaaaactagctggatgtggtgactgcacctgtagtcccagctactctggaggctgaaaaaggaagatcacttgagcccaggagttcaagactgcagtgagctatgatcgtaccactgtatgccagcctgggtgatagagctggcatgtggtacaattgtagtggtatgcattatgatgtggtacaatcacagtggtaagatcatggctaaatgattgtatcattttttttcctcaaaaaagaaaaaaaaacggaaaaaagaaaaagaaaatacaaagtgattgggaaaaaactaatttcaaatcctggtttaccgccgaagaattctctaactggttttgaaccttggttctctcagctctcagatggcttgggactgagtcagccacaaaggaaggggtgaaataagatgggtcagtgtacacgacatgacagcttcttaaaaatgcttcattccacttgtagccaaggccagaatgacttaaaatgcactcgggtggtgtggccggttgtgaagtccatcaacagctaagaagttgaaggagtaaggtaccatggactggaattccctcctggaagccccttccatgaggtctcggatgaaaggggagaaggggaggaaacactgatgctctgactctgtcaggcctactttaatccagggagaccaactgtctattattttacgtgctggctttatatatatatacatccgaaataaatacttcatggcttaaaaaataataatttagaaaatacaatctgatacgttcaaaagaatattgtctctagagtcctgtcctctaacccgatgtctactatcgaagacttcatcaaagtttcctgacacctgctttttattcccctaccaattaaccacctgtctctctcacattcctgaatcccatgagagtgttgtcagaatccagtacaacagtatgaaagtatttataaaacgtaattttttcataatactagtaactgtggttcatgacaaagccaggatgaaaacccaggcctgtctgactccatgatctattagtctgtctatgttttagtttatacataacccggatcaacaaccccaaagccatgatctgcctactccaccagcctgacagcccctctgtagtggcatcaccatctgcttagttgctgttctggaactgagagctcatctttgtccctttctcttgccctgggtctaaccacatcacaccctagcgtggctccacctcccctacacctacctagtccatgctttgtgatctttccccagcacaatggcaagtgtttttcacactagtctcttccttccactgctcacctctcctcccccatatcttttctctcagtagcaaaagtcagctttccaaaaacaagcgcagtcatgccactcttttcctctgggtaaaaccttttctggtttcctactgctctgagctagaggccacagtttttgtttgtttgtttgttttgcagacagagtcttgctctgtcgcccaggctggagtgcagtggcgtgatctcggctcattgcaacctccacctcctgggttcaagtgattcttctgcctcggcctcctgagtagagtagctgggaccataggcgtgcactaccaggcccagctaatttttatatttttattaaagacggggtttcaccaagttggccaggttggtctcgaacgcctgacctcaagtgatccatctacctcaggtgatctgcctacctcagtctcccaaagtgctgggattacgggcatgagccactgcccccggctgaggccacagttcttaaccgagtcacatctctctgcggacgctggctcctgcctccttccaagttgttcttgcaccacttgcgtccttcctcactctccagtcctgcagattcattttgctccttctttcccaccagagcgttctatttattaaactgttgcccaacctccttcctttcccccattgctaatgaataacaagttcttttgctaaagttacgtgtactcagggaaactttccctgtctttatcatttcataggggttgctttgttacatgttctcctagaatcacatacatttcttcagtaaactcaacacagagggtattctttcatgcttttgtgtgatgagctaatagatgtctatctcctataccgtaagctcccaaaccaggatcacgtctgtttttcaccacctttgtatcccaaaggcctgacgtgaggcttttaaagatgtttgctaaacatttttaaaagaagctttatagatgtgtgctaaaactcataaagatgcttgctaaatgactggcttataaagatgtttactgaatgactgatacacaatgaatttagagctgggtccctaagaataataaaaccgatggcagagtttctttatcacggtcaggcccaggaattcacgtttctttatcactgtagagcccagggtcaccacattcctaatgcctatttgtgtcccagaggcttgtgtgggtagccaggagtttgcccaccagccaccctgaagtcgcatagataaggcagcaacatttgcaccagcccacctcctaagagcagctctgggacaggtgagtgagtgtctttccatgacaggtatgctaggaaggaaacacattaaaacaccatccagtagacgaccttagggaaggaggaagaacaggagagaaatggacttgcgccgtgttccacagttgcattcaggaagcatgtcagatggtaccctcagcagacacccgtgacggcctcccttgatacagctccaagaaatcactttgtacagctgttggaaatggcatttctcagaaatgttcctgtgggccccttatgatatctgttagtgctgtagaatgaagtaataggaaacaggacatttgtgagggattggtgcatgattaaaaacgaactgtgggaaattcgcagtggactggtacacttctctctgtaatgaccaattagtggggatttgcaaatagtgatggctcagcctgcctatctctatggcctgtgaaatgctcattggtcttcccaatgtttacatggcccatttgtttccggcctccaactcctggtaccaacaggctaccaggactgaaggtacctctgctctgaactccactcactcaaaacatgcagctcctgtctacaggaggaaaacttatttttgcgtagagctttgtcaatgatgcgtgctgtcactcatctctcatgatgaccctgggggttggaaagataagtatgattacctccacctcacttaagttaaagtgtggggttgaagagcatttgcttaagattagactgctaacaagtgctgacgctgatatttgacttttcccttcccaaaagaaatggtatgagatagaggattgtataattcagtagacatggatgtagtggagatcttaagggaatttgaaagatatggaccacagcccctggggaatgactgttggttaccactgttgagttgcacttgaattcaaaattcctcttttccatggctttggatcccacaggctgtggtctaacatctgttgtttaagaatcacttactcaaccattgtggaagacagtgtggcaattcctcaagaatctagaaccagaactaccatttgactcagcaatcccattactgagtatatacccaaaggattataaatcattctactataaagacacatgcacatgtatgtttattgtggctctattcacaatagcaaagacttggaaccaacccaaatgcccatcaatgatagactggatcaagaaaatgtggcacatagacaccatggaatactatgcagcctttaaaaaggataagttcatgtcctttgtaggaacatggatgaagctggaaaccatcattctcagcaaactaacacaagaacagaaaaccaagctctgtatgttctcactcataagtgggagttgaacaatgagaacacatggacacagggaagggaacatcacacactggggcctgtcagggggtgggggcctgggggagggatagcattaggaaaaatacctaatgtagatgatgggttgatgggtgcagtaaaccaccatagcacatgtatacccatataacaaaactgtatggtctacacatgtatcccataacttaaagtataataataaagaatcatttacttcatttctcatgttttacatggttctctcatggtctgtttctcaacaacacctctatggactaggtcctgttattattcccattgtacatacaaaggaactgaggcataggggagttaactaactacaaatcatgtaaccggtacatggcagagccaggatgaatatccagaactgtctgactccagtatctgtgccctttctcctatgtcctgtttccctctctgtggcttatttcagctaagttactgtcattgtgtctagacaaggactctctgagcttttgatgggggcaggttccttctctgggtgttcctgaagaaccagtatattaagcatggctcctgcatggaaggcctgctgggaatggtacttcctgtaggggatgaaagggagcccttctaaggatgctgctgaggagggggatggctctgtcacttccatccaaggatcctgttctaaactaacagtcatcactctagacagttggctttaaatcaggaaaacatttcttgccagttttcagacaaggccctacatgtctaccagcctttgatcttgctccagctggcccagaaagtcacccccatgccatcactggggtgcgcgtgatcccgagctcaggaagggaagcggcagggcagtggctgtttcatgattcacctgtctagctgggagccctaatttttctccttttctcttagacccaatgcccgcttgttaccaacatcagaaagatgatgaagtgagattcaggactgtggctgcagaaaatattgatggtggactctaaaaactggcctcctactcatccttaattgcctttgtgctggtctctatggaggatggcagaggttgtctttagagaactgtaatcttccagccccctgccgtcctttaggaggcagactcattgttcctgtcatgtagggggtgggtaaactgctgctaccctatctgtttcctgggaagctatgcttcctgaatactggacattttcttctgggagagactgaagagagcatgaaatcataggattctagggtgggaagaaggcttaatacttacaagttttttttttttttttttttcatgaattaggccaagaagtgcaactgaattgcccaacaagagatcacatatgtttctttctaacatatagcttttcccagaatgggatctgggttttctggctgctgggcctggtttatagttcagtggggaccacacttaacaatggttgaacttcaggtgctgtgacgaaatgctctcataaggctggagcagctccagtgaagctggacctgcagaagaaagagagaagacatagatatgtctcatggaagggcattatctgctctgggatgtcctgcagaaacatgagaaatgaagtaaggtgtgtgtggccttctgaatcccccagttcactaataatgtgttaatacccagagcaatggacagaggtgaataaatagcctatcaaaatgggtatttctggctctcctttattggtgaagattgattgcagttaaatgagaacttgtaatggaaagcaatgcttggcacataataggcactcaacaaatcttgctttcttctttttgttcctaatgtggctgcctttcatatatttaaagatgactgtaattaacttcttaaatcttttctaagcccaccatgtcaacccttcctcttctcctccaacaatgactgccgacctgtcatcagagggtctacattttggcttatttttctagaatagttgatggatgtatgctcttcttccttctttcctttgtggtcctgtgttattcggcagggtgacagaggttaaatattatgcgcaggtctggaaaaattaccactttcccattttctttattgttttattggttcttggattatctgtgtggtttctgaatacgaaggctggttctgcaaggtcagcagtgtacctctggcctctgtcatgggcttttctgtctcacacaatgagggcaagatcacagaatggacatggaaaagcataaagcacttgaaagcatacctttgtgtatttataagactgatgtttgactgtgaaatgttggacatagaaaattttagacaatgaatgcaaactctaatctgcattataaaataatctttttatgtcatttgttcaattcactttttacacaggcagatttttctttatttaacagtcttctaatgaatggttcttgtccccttttgagaagcatagaatcttaattagaaaggaacttggcagtcatctagcataaccttccactttcttctataatattctatacaaatggtcattaatcttctgcttttgaatacttccagagataagagatcattacctcccaaaggaccctgttccatatttagaaactctattagaaatattcgccttatgccttactgaaatcttcatctttttcattctcctcattggtccacctgagcattaatgaagatcaggtgcaagcctgtgtaccatttgtctgttccctcatctgccttctctactagacagagggaacctagagggcaaggtctgtaacatttatgttcatgcccagcctttggcatgggcatggccagatttggacaaaatctggccaatcctggcctccagcaaatacctggcttctatgttttgagctacacagtgtgcatcaaccagttgtttgaagacctgacacatttactgagtcctctcttcttctcagtaatcactactacatttcttcaactgtacctgaaatgacagtgtatggagcctaggtgacagttgacccttaaaacatgtcttctgacctgcttgtggaataaatgccttccaggttgctgacttgcttaaatgtgctccccattgtgtctccatcccatagacagagacattctctgtggttctgcaaatcacagcacttggtctagatctgcatatgtgacatgccccaccttgagctacagttggtctgagctcagagtcttaaactcatttaaaagcagtgaagtgtcccaactcaccttttttctcatcctgagcattgtttccttctcattcttatttattgtggtcttctcattcatacttcatttaactgataaggaaatgctttatctgtatcaaaacatctcttgtaccccataaatatatacacctactatgtacccacaaaaaataaaaattaaaaaaaagagagagaagtgctttcatatacctactttcattctgtcctcccaagaactccatgccacagagaggacatgtgttttattatgttttatttctaaggaatttgccaaaagaattaaccaaatgctgctaaagagagcagcatttggatggagcggatgccagaatctcgttcttgtgagccttccctgcagtgctatctcatgcaccacaagtcttacctaccagaaacttctgttaagaaacaatttcagcggggtatggtggctcaagcctgtaataccagcactttgggaggctgaggcaggtggaccacctaaggtcaggagttcgagaccagcctggccaacatggtgaaactctgtctctactaaaaatgcaaaaattagccgggcatggtggtgggtgcctgtaatcccagctacttgggaggccaaggcaggagaatcgcttgaacccaggaggcggaggttgcagtgagctgagattgcgccattgcactccaggctgggcgacaagagcaaaactccatctaaaaaacaaaaacaaaaaacttcattgattcaagagtgtggttataatgacggagttgggatcaaaacaagaaagaccagaggtgtttgacaaataatgagaaagcaatgggcagggtaaactggaaattatgatgaggttaggaaatttgcactgagcacagagtctttgtccaaatgttatgaaaggataaaaggctagagttgaggagtgagatgttagagatttggtattttcgatgaggccctttttggggttctttttttggcatgttagcctgggattgagtggctgaggtgttgttggaaaaagttaatgaaaactatgggctctagatactgcaaggcccagggtgttggctgcttcatccctaggatgatgaaactcaaggaaaattgtcaagcaccaaaaggaattgtatacctgcagatcaaaaggagcctcgacaactaaggtaaaatcagtgataagttgcccacattagtgtacaccctagaaaattatttgaattgcaaggattaaaacacaatccttcttttaggaatagtaattcccattattaagagttgattatttgccaacctaatatgcttaacttgcataatcttcttttatccctaccatttcctggcgaggaaactgaagcttaggaaagagacttgttcagattactcagcgaatgcattgtggaaccaaaacatgaattttgggtagtctgactcttgagcagcgctacccgatggaaataaaacagcaactcatctgtgtgattttaaattttccagtagtcacattctgaaaagcaaaatagaaccagtgcaatacattttaataatacatctcatttaattttatttatccaaaatagtatcgtttcaacctgagatcagtattttgagaattactgagatattttacagattgtaaatattaagtctttgaaatctggtatatattttgaacgtctcactttggacttgcgtattttaagtgctcagtaacacatatggttgttgatggctgtggacaaggtatggaacttggcttttaacactacgtggtaataccagggcagagggtggagacaagcttattatcttggaagaataaaaatcccgcctcagcttctgtgctgtgagagtaggtgtccaaataaaatgtctgcagagttttgagcaaaatagacagagacccaagaataccaaccaagttctctcatgttaataaggcaacagaaaaaaaatgataggctttgcaggaactcagaaaatatacaccaataggccaggtgcagtggctcacgcctgtaatcccagcactttgggaggctgaggtgggtggatcacttgagcccaggagttcgagacccacctgggcaacatggcgaaaccccgtctctaccaagaaaatccacaaattagccagtctcataacctggtctcaaaataaataaatagacttaaaaaaattttaaaaacagaaaaaaggctgggcgctgtggctcacgcctgtaatcccagcactttgggaggccgaggtgggcggatcacaaggtcaagagattgagaccatcctggctaacacggtgaaaccccgtctctactaaaaatacaaaaaattagccggatgtggtggtgggcacctctagtcccagctactcgggaggctgaggcaggagaatggcgtgaacctgggaggcagagcttgcagtgagccaaggtcacgccactgcactccagcctgggtgacagagcaagctccgtctcaaaaaatacacacacacaaacaaacaaacaaaaacagaaaaaaaaagaaaatatacacaagtgtattgttcttgaagaaactatagcttctttgcaagccacccaaaaaagtgatcaaaatgaatattcaggaatgaaaaggtattgttataaaggggcagacagtgtgtacagagttacacatagagtgatatgtaaataattgttttaagtcagttgcaaggctgattgcaaatgccgaaaagtatttgtcttcagaacatacgcaaataataagctgatcacagccattttaaaacacactggagagtatgagttgggtttaaaagctgttaaatatagtggattttgtggggtaacttaggtggtatcttttaactctttactttgattatcctggaaaaaagggtaaggtgtttctgcaaagctcagacatgaccccaatgaaataagtagaattagatctaatttattagtgatgattatttcaaatgaaataaagcctaagtaagaagcaaagaagatgagacagaaaaaaataataataataataaaatgaactattagatagccacatgggaaaaaattaatcttgctcctcacttcattccacatacaaaaattaacttgaaatgaatcttaacacctaaatatgggagctaaatctgtagaacttatagaggaaaacaaagaaaattatagggacttcaagttgggcaaagatttcctccctccctccctccctctgtcccccttccctcccctcccctcccctcctctctcctcccctcccttctcctctcctctttctttttttcctttcttttctttctttctctgggtctccctttgtcacccaggctgaagtgcagtggcagaatcatagctcactgcagcctcaaatacctgggctcaagcaatcctcctgcctcatcctctagagtagctgggactacaggcacatgctatcacgcctggctaatttaaaaaaaaaaaaaaattttttttttttttttggagagacgggtcttgctatattgcccgtgttgatcttgaactcctggcccaagcagtcctgctacctcggcctcccaaagtgttgggattacaggtgtgagccaccatgcctggcagagagatttcttaaataagacataaaaagcacacactaaataagaaaaaaattgataaattggacttcatcgaagttgaggatttttgttcttgcaaagacattaataagaaactataaggataagctacagactgaaagaaagaatttgccaagcatctatctgatgaaagatttgtatctgggatatatggagaggtcttacaccaataataagaaaacaacccaatttagaaatgagcaacatattttaagagacatgtcagccaaggagagatggagtggccaatgaatccctgaaaaatgcaaatcaataatgacatcattagtcatcagggaaatgcaaattaaagaccatcctgagataccacttcacacccactacaatggctaagattaaaaggactcacaatacaaagtgtcagtgaggatgtggaacagctgcaactctctgacatcactgatggaagtgaaaaatggtataccacttcagaaaacagcttggtagcttttttgtttgtttgtttgaggcagagtctcactctttgcccaggctggagtgcagtggccccatcttggctcactgcaacctccgcctcgcgggttcaagcgattcttctgcctcagcctcccgaatagctggaattacaggcacccaccaccacgcccagctaatttctgtatttttagtagagacggggttttgccatattggcccggctgatctcaaactcctgacctcgtgatccacccgcctcagcctcccaaagtgctgggattacaggtgtgagccaccacgcccggccttggcagctttttaaaatattaaacataactcacaatatgacctagtggttccactcctaggtgttcaaccaagagaaataaaacctatgtccactggaaaacttgtatgtggatattcgtggcagctttattcataggacttcactgactgtcagctgaagaactggtaaacagctgtggtatgtctcagcagtgggaaggaatgaactgacggcacatacagcaatgccagtgagaaggtttgatgttaagtgaaagaaagccagaccgaaagactgcatggtaaatggttccattgatgtgacattcttgaaagcaagacagagttaataggagccagagggtggtgtggtgggactgcctagcaagggacaccagggcattttcgagggcgatcaaattgttttataaagtgactgctgtggttgttgcaaactgtatacatttattaaattgaactgtacgtttaaaagaggtgaattgtgatgatgtaagatttttttctcgaagaatgcataaacatactatcacagaagtaaaatcaaacatcaattactttaataaacgtaaatgctttaaactcttccattactggataacaactttaattcttggttaaatagcaatatggtgtgagtgtgttaattttagactaaatcaaatacaataaaatatatttaattaggtacaactaataattttaaattggtaagtttaatacccataagaggatagaatagccgagttattttccaagtagaaaacttccagatatactaagcacaaaacaaaaattgatagaaatatatgttgggagagctttggccacagaaaagaaagatgaatcatcttgttaatgacagaaatgatttttaaaacataatatcagtagttattgaactgcctatcatatggaataaaaatgagtgaagtgttcatcaaaaaaattacacaaatgatagataccataaaaattacacaggccctactcttgaccacagtgcagcggaactacatatcagaaacaaactattaaatgggaaattcaaacttcttggaaactagaggagggtaaagattcttcctaaatgctatttaatccaaaaggatataaaaactaaaattatagtctgttttggtatcaacagaagaggaacatttcatagtaaagtttatggaatgtggccaaagctgtcactggagatattttaatagcctccacttctttcattattcaaaaacaaaggtaatgataaatgaatcttgcatttcatgcagtaattgaaatatgaacaatggtgtgtccctaaggaaagcagaagggaagtggagttcacagcagaattctgtgaagtaagaaaaataataaacagaaaagtaaacaaatattaattttcattaatttaaattaatgaaaatattaatttttaattaattaatttccatatataagaagatggcaaacctctggtaaatttaataaaacaatggaggaaatattaataaacagaacaatgagtaaaggtatacaacaatataaatttgcaaaatggtaatcaaaatcaatagccaacatttacttgtcacttatcatgtatcagacatagtactaaacatttagtgttatctcattgaaatctcatgacagatccttgaaattagtgctgtgataatcttttacagaggaggaacctgagagtagaggcagctagaccaagacttcttagctgtggagtggtggaaacaagaattgagccctgcagcctagccgtgggccctagcctttcctcctcacttactacagttgaactctatgggaaattccatgcagatttatgaaagcctggaggtgtaatgttgtgtttgcctggaagcagatttgcatttattgcggctagttgcctgaggccctgtcagtcctaatcactttgaattaaattctgcatttgaggtctgtcagacaccagatagcttgagtccagacaacacaccactgtgtgatccatcttgagggtgctaattctcagggaaggcctcccacccccactttagtagtcatccagataaaaatcagtgtgttttctgttcctcccttctgtgtgtgggggtttgtttctaaatcacctttatactaagagtgtaggattcgggtcctaacttcatgcaaaggttctctctctgactccctcttaagccaggccatgggcctcatcttctccctcctgcaccctcacagcagtgaaagcagaaggtcaagagccattcccctcaaagcaatactgagtttcagggattacttatattctaattttccaacttggacttgcttttcatttttgtatttttgctgtgatgccaacttaagttttatatgcgtgcgtgcgcacacacacacacacacacacacacgcacacatatatgttccttgttaacttttcaaaatgttttcactgtgagggttttgaggttgtctagttcactatgttacctgaaataggaatctcccttcctcatctttcttctagagctcagttagcatctcaaggaaagtgttctgggcctggcattctgttcaaatttgggttccccttctataggttatctttccacctgttacttcattttttatgacattgatccttgtgtacttatttgttaaatacctttgatgcatgggtattggtggatgtatgtctcacttgccactgcagtgtggagcctacgtggatggacccctcggctcttctttctgcttcccaattcttagcatgtgcttgctcatagttggctctaaccaggtgtttgaatgaagaagtcttggtaagaattttgaggctgtttcattcagcacggaggattcccagtaacgttattttatctgccgtgaacataaaaagagaaggccgataacttaagttctgggtatccatggtctcttgctcaagaaagaatttccaacctgtagagaatgaatggattttccaacaaaaggcattaatgtgattgaggatttgggaagtgatcaaataagatatcaccagattaaaaaaataaattttgtattgattgaaagcttgaatttaaaaacagaaacattaaacaaaactagaagaaaaatatgaaaatgttggtctaagaatgaggaaggtttctgtgtgcctaaggaaaatgaaaaaaaaaaaatcttaaaggaaaactccagtagatttgattaattgcaatggaaaaaatcaaggggaaaattctgaataaactgaaacaaaattaaaggacaagtaataaattggaaaaattgtacttgaaacagatacagcatgtaatacataaggagctgttgcagataaataggaaatacagactcgcagaaaaatgggtaaagaataagaataagggaactcgcaaaaaaatgcaaatggtaaaaatatacaaatatattcaaagaaagaagaaaataagattttatataggagtctttaaaaatttttattacttattaatgggaagtatctatgagggccaacccttcttaaattgtctattgtaagtcaacatcagaataccctttttggatattttggcaatatcaagattcttaaaaattatatacaggttctgtgaggcagaaattctttgctccaaggaaataaaggtggaatcaaaggattttcatcatggtattgtttgtttgcaatagtaaatcttagacacaacctaaatcccaacattcatgaaaggttaggtaaagtatggtacatcgttgaaataagatagttgaagcttttccaaatcatttttaaataacattttattgatttaatagcaacgttgaatgttgcttcaataagtggaaagggaaatgctcatgatgtaatattaagtttaaaataagacacaaaactagttctcttcaaagtttaaagatgtctgtgtagttatataattatttacaaaggcagatcatatgacagtgtttaatatgttacctctgggtacatgtattctagttttctcgttttcattgcattttgcagactttctgtagtagcacaatttttaaaactatatttttctctcgactgtgaaaggagcagagggagggaaggaaagagaaggtaattaatgacttcacatagataatgggaatagtaaccttgttgttctcagctgggcgcggtggctcacgcctgtaatcccagcacttcgggaggctgaggcggacggatcatgaggtcaggagatcgagaccatcctggctaacatggtgaaaccccatctctactaaaaatacaaaaaattagccaggcgtggtggtgggcgcctgtagtcccagctacttgggaggctgaggcaggagaatggcgtgaacccaggaggcggagcttgccgtgagccgagagatcgtgccactgcactccagcctgggcgacagagcaagactccgtctgaaaaaaaaaaaaaaaaagaaatcttgttgttctccctgtttgggggcagcatggcgtattcacaggtgtaagggtgcagcataccatggggtttggctcacctgcatatgacttgtgactatcatgggtgtcattgtctctgtaagaaggacttgcaagggataatccaggtagaagagcacccacaaacttatagaggctttgtgtgcatgcgagcgcctaccctttttacttaggtcattttggaggtgtcttttgggaacacgtaaagagtaacatcaggttttccaagccagctggtttccctgtgctacggaaaaaaatgaaaactcaactggcagtccatccatcttaatcctgaaggaactgggaccttccccacttacttaactaggtgactcagaaaatcctaacgtgatccaacccaaactccaaactggctaacttagaagtaacagatgaaaaagagagagtgggccgggtgcagtggctcacacctgtaatcccagcacttcgggaggccgaggcaggtggatcgtttgaggtcgggagtttgagaccagcctggccaacatggtgaaaccctgtctctactaaaaatacaaaaattagccgggcgtggtgagcataaaggaacctaatggggagaggtcacgaaagactcactttacatccctttgtgcagctacagtgattcctccctgcattacctgtgtgatcagtttcctgatcttttatgttgtgatctaatatataacctgagtaaagtgccttaaacaatctactaattttgtgtcaaatatcaagaagcccttcgattggcagttccaagagtggtggttattatcttgggaattttcgtgggctcctcatggtggaggggtgagaataaatccagaaatctgctgcctacaggactgtagatgggaagagggaaggcaaccttattctcatatgcactctgtctctcattaccaaacagggaatcttctcccccagatttcctaggagactttgcttcatgtacattggccaagatggtgtctcaggcccatgacctgtcttcagggaagactgaaaaagtgatgattctttgtgtctttgcctgtgtgtgcgtttctatgtgtgtctcagtgtgtgtgtctgtgtgttttcagccttctcagtagggaatctgaagtgtagctctctggataggcaaccaaaagaatctcccccgtctcctttgtaggtttgctgtgagaagaaaatgcttatctcagaagcaggaataattaatgtatataagtgagtttctctctcctctcacactcctttttctgtggtgtttgtttgtttgttttgtttgttttttattgagacgaagtcttgctgtgtcacccaggctggaatgcagtggtgcgatctcggctcactgcaacctccacctcccagattcaagctattctcatgcctcagcctctggagcagctgggattacaggcgcgcatcaccatgcctggctaatttttgtatttttagtagagacagggtttcaccatgttggccaggctggtctcaaactcccgacctcaagtgatctgccagcctcagcctcccaaaatgctgggattacaggcgtgagccaatgcgcccagcccactttctctttttcatctgtgacttctaagccagtttggagtttgggttggatcatgttaggattttccgagacacccagtacgtatgtggggaaagtcctgcttccttcaagattaagatggatggactgccagctgagttttcattttttttttttcagtagcacagggaaaccagctggcttggaaaacctgatgttaactctatttaataggtagctgaattctcatctgattaggaggaaacaactcaggtctgtacctagatacaaatcagtcagtggataaggatttgctgaatgcacactgttccagaatacagatgaggaaaagctcatgtcttctccaagaatttagtgaaaactaatgaaatagggaagagtgtagtaccaatcagctaccagctggatagtcagggatgacttcacagaaaaaggggaaccctgagccgagccttgggggccactgtgatttccaggagtcggggggaagtgtggtgttcccatgctaggtacatcattgtcgagaacacagaagctttgaggaggaggtgaagaggaggcgtaagagcattttatcttgctctttgagttaatgacaggctttcgttgcccaaagaagagaatactttttcccaagcaaaactcctttacctgctttttatctgctcagcttagctataaaagttaatactcttattaaactttttctattagaaaggaaagaaatgcacttcttttctctgcctgacacttccttctctttttcacttatgaagggcatacctttttgataattgaggaaactaataaaccagatctcaaactaacatccaggactggtcaggatgcccacagcggggaaagttgggccaatttttatttctgaggtttcagtatcagtatagtcagtatgtccacattttgattaaaagaaagcaaataaatggaatgcctatatatgtgtcttggaaagtgctaagggagcttccaaggtaaaaatagtaactatctatcacaaagtgtgttcttatgggggagatatgtgtgtactgaagtgcattactgaagggatggacaaggcgagggaagcacacttcatactggatgggggggacccaactgtccttatatttggaaaattgaactttcattttatagtgtacagattccattttaaaatcaatgtccctgacctattcagtgggctcaggggcagaagatggagctgaatgggataggcgttgttaaatttctttccgaggttctaattttcttatttatcgggtaacttgcaacaggttgccagctatataccttgagaggcattgattgctactaagtccaaaaccctgaccttaaggttttcaagtccagtgacctagtgacaatatggatcctgagggcaggaatcttggtagatgagtagaaaatcaagagataaaattgatttattttctccagacttaatattttgccctgtgatggttctcaaaaagaaggtgttttggtgaaaaactacctccatgcactgccttcatcctgtggaggtgactgcattgagaggcagattcatttttacagctgacttgacagggagggtttgacatggtggctgtgacagaaaggtagatctgggatgtgggggagatggatcatgtctagctcctagaattctggaacaagctggtgggtgcatggtggtaggaagatggagaaaactgaggaaggattgagctttagcaggaagagcaagagtcctatttgtcatctagacagggtataatatatgtgactggaactgtccaaggtagacatgtgctcatacttaatgtggtttgtttcccctgaataataacatagtacagtatccgcagggggcacaaatgcccattctttaagcatcctgcaaagaggtgttcctggttgaaagcacagccaggtacaccttggagctactatctagcagaaggaattcactctcctcttctttttgtacaagacaagcatgaggatgctcttgacctaatgaagttaacatttgggctcagatgccaagagtctgaactttggtggaagtattcaggggaatgctgagtaacatcagctgtccagcacctggagcttggagcccttggttcagtgtgaagttgggttttggatgaggcgtacctgctgggtgaccagggtgcctaggtacagtggaaaggcgtaatccctcttgttgagagaatggcagccaatggctagttcattgccttcagccaagagagatgtccctgaatcagtcactggacaatcttgcttatctaaactttatattctttcatgtataagtctcattcaattctcttatatgtagtggttaaagagttgtcacttttctttctttaaggattctgaggacttcaaactcatctttttttttttcctctttcaaggtctttcctacttccagataatgcaatgttttccattaggtcaaaacttagacaaaatgtgtactctcctgtaccaggacaaagacttttcatccacatccatttttttctgagtttcagctggtacttctgagcaaggtgcctcaaccttagcactcatgatgttctgggccagatagttttttgttgcgggggctgtcctgtctgaggatgttgagtggcattccttgcctctgccccctggatccagtagcaccccagtgcccaagtcatgacaaccaaaagtgtctccaagtattgccaggggtcctttgggggcaaaattgcccttcatattagaaactgacacaattggggtgaccccacgctctaggcaggtgctgactgtgaaggtgatgggatagaaaatggaagtactaaagtcagaggccagtccaatggatttgtgtcattttattcccagccatgtgaagctttaagatgtatctatcacttggtgaccccatggtgatgtccattcattactctctttcctcatttgggacactgatgggtcagattcttttttttttttttttttttgagacggagtttcactctgtcacccagactggagtgcaatggcacaatctcggctcactgcaacctctgcctcctgggttcaagcaattctcctgcctcagcttcctgagtagctgggattacaggcacgtgccaccacccccggctaatttttgtatttttagtagagatggggtttcaccatgttggtcaggctggtcttgagctcttgacctcgtgatctgcccacctcagcctcccaaagtgctgggattacagatttgagccaccgtgcccagtcagattctctctgtcttctaactgaagcatggaaaacaagccaggtcaacaaaataactttatttatttctaaacaaagttactttggataggaaacttggaaacatttcaagttttcatccctggttgtaccatttcaccaagctgattttaggaaaaggtgcacaaaggtatcaaaatgtgaattttcttgctgagaacagtacgtgatgcttcacagtctcttaattccatctgtttcccatgataaagttccagcattaggtactggtgttagaaggccctccacattatgacagtgattttcctgaaggtcagaaggggcaaattttaactctcccacttactagcagtgcaatttgagacaatgatgtttctaagtcttagtttcctatgtgtaaaatagaggtatgaatcccttacttgcttaattcacaaacttatttcaagcatccaatgaaataatagatggaaaatttcattgaaaatgagaaaatgctgcacatgcattcttattacttttgtcatcatcatcatcattcctattatcatttttgaaagatggacgtcttacaaactgaccggttatgtatgcttttgtatactcaactcccttggctaaaaactcatctaactagaatattttcattggatttaaccactcagccaggctgaattcaagaaccccagtgggttttaaatctgctcactactggctaaataacatgtttgaagagaaaatagcaagcaatgatcaacatcttattcagaggcataatagcactgctgaaactcccctttctcatcccctgttattattaatgtgctgctattacttattgtacattgtgtcccagagtgtgtgtgttgcccttacattgtatatatacataagtcccaccctccaaaaccagccgttataaaggagagaaaatcacaactgatgccatgtggtaaaggactagcgtctcgagctcactcactgtgatcaggcctttattccacctgtcacataatgaaatatttcttccttcttgattcagaatgaaccagcagctcgattctgtaaggtcctctgctgggtattttcctgtacatcatcccattttcaggctgacagagcaataggtggccttgtgtctgcttttttttttttctttttttgtgacagtttcattcttgttgcctaggctggagtgcagtggtgcgatctcgactcaccgcaacctccgccacctgggttcaagcgattctcctgcctcagcctcccaagtaactgggattacaggcatgcaccaccatgcctggctaattttgtatttgtagtagagatgggatttctccgtgttggtcagggtggtctcaaactcccgagctcaggtgatctgccccccttggcctcccaaagtgttggaattacaggcgtgagccactgcgcccggccgccttgtgtctgctttacagatgcaaaacctgaaattcagagaagggaattgccacactccagcttgtattgaagacagtgctcgtgccatcattccatgttgcttccagatcaaggacgcttaaatattcccaggggattaaaaaatatgtatactatgtaggaactcagcaattctgtgcaaacagaaaataaagttacagagctgtgctattaagttgggtcttgatcttccgcagttagaattaattgattggctcacttcccaattgttgtgtacctcaggcttgattgcacctaagaatcacttggtactgttggtaacacaaaacaacaccaccaaaacaatgctaggggccactctggatgacactttagcatggcttgtgttccaaacccaaacaagcagcaatgccaggccctaccactagatgtcatagtttagtttttctggggtaggcccagtagtgcgcccatgtaattccaaagtgtggccagccctgggctggggctgcagcaggtctttatcagtgtcctgaaggaggacatccaggctccacttggctcctgctcaggaccctccgtaatgtacaaatgctaaccgttagttttagaaggctgagactttccctggcacactgtattagtccgttttcatggtgctgataaagatatacccaagactggacaatttacaaaagaaagagatttaactggacttaaaattccgcgtggctggggatgcctcacaatcatggtggaaggcaaggaggagcaagtcccatcttacatggatggcagcaggcaaagagagagcttgtgcaggggaactcctctttttaaaaccatcagatctcatgagacttactcactgtcacaagaacagcacgggaaagacttgcccccatgattcaattacctcccaccaggtccctcccacaacacctgggaattcaagatgagatttgggtggggacacagccaaaccatatcacacactctaaagtacagaagttaaaaatccattgtaacaatcttcctgggtctggacatatgtttccaagcttcccttcctgctttgtattttggtgttaacagctttctcagtagagcgttactggccacttgcagtcctttagagattggagaaacatttgttctgagaaggtgtatgactctattataactgcattggaatgtttgtttctgctaacagtatgagctcaatctagtagtcacctttgtctttcctgattttacttcccatttctgagtacaattaattttgctatgttctaagaatgttggtaagaatttatatacagatttcactgtgtaataatcatgtgagtatcatatttgaatccatttccaaaaacgattaaggtttttggaaagaggcaaatctgatttttaatcccagctcctataattcattataattgggtgatttccttgatgtctacatcacacacagtaataaaggttattgggtgaattaaaagatacttgtaaattgctttagtatactgtctgttacatagtaagcattcaacaaatgcgattgttattataaacataataatattttctcccatttaatggtgatcttctaagaaagaggaacatttttcatttactcctctttccttagtatctagtacagaatttggcacacacaatgagtgtttagataaatgactcactttcggaattaggtgatttttttaaaggggatttagagcattaggaattcctttgatcagtagccaaatccccaagtggaagtaaaggcacaatggaattaccttgtaccttgtaccgtcttctatactactttttaagggtgacatttttcccttctgcattctcatgtatgataaattctaaatctagaaaggttagacagccatcctcacaatctggttgccttgacaaccatcatattaaacagtaaaggcctgttgttggcggggggaggtgaatgtcaatattaccacggtctaaatcttctgaagcagggcttgaaggtcaaggttaaaagtattcaaaattgcaataagacctttggttaatgtttgttagatgtattacaagagctgagtgaagccatcatcttttcagggtgaccagtgaagagattcattttggctgtcagccagaagacatttggactgccattgacaaggttttccttttactacaccaagagacttttgccttctatgtgtggtgaaagaaaacagtttttaaaccaatcagaaattaataaagggacaactctggatcatcctcctcaactgtctttgcctgcttgtaagttgctgtccgtgtgtttaaactcacctgcaaggtgtatctccgcagctagtaacagagattgtcacaggcaagggtgtcacctacaaagtgctaaagagccctctgaaaatgaaaagcaaagtgcctcattaatgtagagcagtgtggggcttctttaattgcagcctatgtggctgccctttttagatggctccatgggaaggcggaggtaagagtggaagaaggtatggttgtgagagcgagagaaattgctccccaaatatccagatgaacttgacaacagagaagtgtgttttctgattcagctgccttctgattaaattcagaaaggcaagaaagaactgttggattcagcagaggctaagatcggggagcaggtttttgagatgtgtatgcgtgtgcttttgcatacttctctgttttgtggctattttagtgttgtaagatcctggagggtggtgtttcttaacctctttttaaatattatcactcccctctcctatgtgcctttttatactttttatttccctgattaaacctctaacatgagattttaataccaaaccattggaatatcttatttttttttgatccccacaagaaccaacttttgtgtctgttaagaatgcatgcagtagagtaaatttatggtaacagaaacaaaatctttttttccacttgcgtttaatagcagagtgattatctctcttcttagcactttgaacaggaatgaaatataactaaatacaccacgcatacatagtcacctatctatatctgtgggttctgtattcttgggttcaacccaccaagacttgacagtattcaggggaaaagaatagatgggttacacctgaactgaacatttatggatatttattttcttttcagtatgctctaaacaatactgtataacagccatttacatagtatttacattgcattaggtattaataagcactctagggatgatttaaagtatatgggaggatatacctatgttatatgcaaatactacacttatttacatcaggggacttgtgcacctgaggattttggtatccttgagggtgctggaaccaatcctccacagatagagagggtatgtatacacacacatgtttatccatgtgctttcgcggtgatatctgtatatatgagcatattcacatacataggaagactacagatagacaggttatggcataccctgataaagcaccgtgtcatctaacttaaaactagaacaatagcaccaaagccacctggatatcttcaccatcccatgccccacctccctcactcccacctcctgtcagggtaaaccaccaccctgacagctgtgaccatcctttctgaaattatttgttatgtctccccaaactgcactgttatttcctcaaagcaatcatctggcacagagctttacacttagaagtcgctgaagtgttgaatgaatgaatgaacgaagcaggtgcatcagtatatccccatcagaagcaatggttctcaataagtgttttctgtgtaaatgcattgtttcactttttcaaaactattcattgagtgccttctatgtgtcagacactgtgctaagtctacatacataaatacatactgtgcacggtaataagaattgcagcttctaaaattattaagatcaggctacgcagcagctaatgcaattttctcctcagtgcattgaaaaatctattagtgaagaaggcagctatatttcaggaaattaagccactgtaacagtccagttcacaaatcagaattcccagtgctttgaaatgctccatttcataacataaagtactgaaggatgttcaggcagtctgtaaatgctccagtgaccaatcccctcaagcttcgcaaagctaaatagaggatgcttcttgctgggcgatgagagaggaaggggttttgtgccaccgataggaggagggacgtgtctgtagatccacgatcacattccccttggttcacttctcctttgtcatcattctggaattatttatgtttgcagaagatggttgcttagtagacttctgaataatgagcatttttaggtgcaagccagctaatcttattttgggctagggttgtatgtctgaataaatgttcattgatgcttacgggagattgctgtcacctgcaaagaccagcttccaggctctctcaacatttccttctaagttgctaatataagaaggcatgaaatatgtaattcagttctcctgttgatgctggttactaagaattttgctgtagctgacctagagctgcttgtatttaaacaggacttctaaatttaaaaagaagtacagccaagaagccttcctggcctcactgtcataaactgcctatgaggtatagagatagctaaagaactcctgatcttacatcaacacttccttttattaatatttgagaaaggtcttctctccccataaatccaacaaagtattagtttcaggtggggcacttaagcttggggctatcttatgacttgtttctgaacaataagttggttgttgatccagtgtaaatgattcagccaagaagaccttgagaaatagcattttctgtctcctaacttggtgtttcttagagggtaatctatggagacttgcttttgaatcacccggggtgctggttttaaaatacggatttctaggccctaccacaaatctaatgaattgtaacctctcaataggatcctgggaatctagattttcaccaggcttcctccaaggttctgatgcctctcagctgccttctgttaatctttcctccataaatcattagagtatattccaaaaatatagatgagatcacatctcttagctcatgaaaccccttttgtttttcccactgtctctgggatattatccagtgctcttttgtatggcatatggtcctggtcttctccaacatttgatcctgtcctacctttccatatccatctctatcattttcaactctaagctttttcattaagtgtatcagactatagttattttacacacacacacacacacacacacacacacacacacacacacacacacacaattgtttatatctctgtgccttcgttgtcctatcatgcttttctcccaatatttgagaatctcaattttcaacccatttttcaagaccaaatttaaggtttatttcctccagacatctctatctgattgttgtccctcctttcttatcactcccctttaattgtccttctactggaccactgctatacgtatctcaaacaaccaagggctgaaaacacttgaaaaaaaaatagatggttgcatctatattgaacatgtacagagttttttcttgtcattcccaaaacaatacagtataacaactgtttacataatttttacattttattaggtgttataagtaatctagagatgatttaaagtatacaggaggatgtgcataggttatatgcaatagggcaccattttatatcagagacttgagcatctttggattttgatctccaaaaggggtcatgtaactaataacccacagactccaaggatggctgtacttggaatttatcacagtccagttcataacattctataattacagatgtggtagccagtttccaagatggcacccagtaattcccacctcctagcattcattcactcccatgtctagtcccttcccacattgcataaacttacctatataaccaataagatgttgcaggaatgatgccatgttacttctgaggccaagttttcaagataaccttgcctccaccttgctgtctttgggaccactcactttgggggaagccagcatgttgtaaagactctcaagcagacttctggagtggcaaaaacgtgagccttcttattgatagctggcatcaactgccgggcatgtatgtgggagccagcatagaattagatcttacatcccagagcaagtattcagatgactgcaacctcatgaggaatcctaagaaccacccagcgaatatactctgagattcctgacacacagaaaccatttgagttaataaataactggtgctgttttaagctgctgcattttgaggtaacttgtgcagtcatggatactgaatatccactagaccatggactccttgagaacgtcagccatgtttccttcatcatggaccctggtccctcgccctcctcagtacctgccccatattaaggtgttccataaatgtctcattaaatgatctcaactgagctaaactggagtttctctgtgctgccaagggtgaatactcacaaatgcagatgactttttttgttttgttttgagcagagtctcgctttgttgcccaggctggagtgcagtggctcgatctcggctcactgcaacccccacctcctgggttcaagtggttctactgcctcagcctcccgagtagctgggattacatgcgcacaccaccacgcccggctaatttttgtatttttagtggagatggtttttcaccatgttggccaggctggtcttgaactcctgacctcaggtggtccatccgcctcggcctaccaaagtgctgggattacaggcgtgcaacagcaggtgcctttaatagatgtgaatattgtcttttgctcttagtatcatcagtcataatattaacagttaacaatatccattgcttagatatagcaccagaattttcacaatcccatggagtatgtgctgtaagtagccccaatttactgatgaaaactgaggtacatagaggtttaactgcttgcccagaatgactcagatagtgaatgatggagccagtattcaaacccagtcagtcagtctccagactatgtgttgttaaccattttattttatttttatgtatttaattttttttgagacaaagtctcactctgtcgcccaggctggagtgtagtggcacgatcttggctcactgcaacctccacctcccgggctcaagggattctcctgactcagtctcccaagtagctgggattacaggcatgcgccaccatgcctggctaatttttgcatttttagtagagatggggttgtaccatgttggctggtcttgaactcctgacctcaagtgatccgcccaccttggcctcccaaagtgctgggattaatggcatgtgtcattttaaacactcatatcgagccctgatgtggcaagcattgtgctaggcactttgactctcctacctcatttaatgctttttcaaacctcatgcaatgtgtattgttttctctattttatgggtggggagcttgagacttagagaggtgactttgccaggctggttgtggtagagtcaggattcagaattgggccagccagactccaaagctcgtgctcatttcacgatcttcttccaaggcatctgccagtgtctctgtcccagcatctcaagccccgccccacttctgtttcttaacaattatactctgaacatataggttggttgccaagacaaccactcagaaacaacatgaaaggcaaatgacttttcaaacattctgcagctgggatgacttctttttttaattttttaaaatatgtcaaggtgatttgtaatccacagcaaaatgttaatatgggtaagcaatctattttgagcaaaaaatatttccagtatggcagaggagagcttacagattacatatatagtaacgccttaggaaggaagcaggatatactactattaccctttttacaggtgagaaaattaaggcctggagagatttggaagccaggaatgcccagctctaaagacattgtacctaattgtttgaaaaactgcttggagaatgaaaatgtgtctggagggaggcagaggctcagtcctgaccctgcagtaaatcagaagagtgaagagcacattgaataagccaggtccagtgggaagggagggaaagagagaaacacatcagttcagagtagagtatctaggactgggggactgaaagttgaggtaaggaaaaggaccaccaaactttgggtactaaataatagacaacccttaatcttggtaggaggagtttcaataggtcagcccatataaaggtcttgccacaatgcctgacacccagcacgtgctaggcatattttctattattatctttactggggtatctcaatgactcctggaaatccacatcttggagaaggagtgagcatcatttcctgacaaaaccagtctcttttcctgtttttcccttatttatcaaaggtcagaaatgtgtcatcaccattgagacatggctttcctccatcccctgtgttttgggcagtcacctgtagaggtgaggtgtgtccactgtccagctctctgcctccatgctcatactgctaatctggtcaacttctctgtggaccacctggcatcagatataccctagaatcacttacaccgcctcatagatgctcccctttgggtctgcctggtaattggcagcttcttcaagaaggcagatttccctttgagagcatccccaaccccccagtttacataaaacccttaaaacctggggttgcctgtgctccctttacataagtgaattaggtgataatcttgggcatgactgcatttttgctgattgaagtttagaccatgctgcttagaattattaacagccattgcaaggataatgatctgcccattaaaataaactaactctcatttttattatcattttaattacacgaaccctttggcgtgttgatagtgatgaacaacatggtgggatattactctgccaggtgttgacttctctatggggtgctctcgggaaaatttgcctggtgccctccaggtttcctcagcctgccttcgagggtgctcttctctccattgaccccatgatgtaagaagttcctggttggactgaagtgtgttgcggcatggaaatgagattaataccagtgtggattgcatggagagactgccccaaaaggttgcatggctaatcactcccacgcacttttcctcctcctcaaacccaaagtgtgctgtccagttttggagatctaccagagggagggactttgcattttccagatttcagcttgtgattttttttttttttttttttttttgaaatggagtctcgctccattgccaggctggagtgcagtggtgctaccttggctcactgcaacctctccctcctgggttcaagcgattctcctgcctcagcctcccgagtagctgggactgcaggagcacgtcaccatgcccaactaatttttgtatttttagtagagacagggtttcaccatgttggccagggtggtctcgatatcttgacctcatgatccgcctgcctcattttttacagaaacataggacaaggtgacaagtgacttatttcccctgacaaaaccatctgcattcctgacttcccctttactttcaaaggtaccagaatttgctgcttttatcatgccccaaattctgagtcatctgaacttcggtattgctgacaggcattcactgagaggagaagtgggcttagaggagacctgttgcttgccccgcatgaggctggatgctgtgccttctcctgtgaatactataacattgtaggcccccattttccagatgagaaaactaagactcaaggaggttaagtgagttacctgaggtcacacagctcattaaaagtagaaccagttctatagcccaggcttcagggctcaacaaactatgcctcttctgttgttctgtcctgaccctggattttagcaatcatgaacacttctgctcctaggtgaggaaaatatcagagaaaaatgaactcaggcctggctgactccgtagtcatgcacattcatcaaacagtttttgaataattactgtgttgttaccacagtcaaaaagacatcgtccctgcctcaaggagtttcagtcaagtgcaggagaggggcatggaaaattgaacccagcaggataacatgctgtgctggaggaagggaaacagcttgcttcttgctttgggagcccctaatccagcctggggctgtgggggtgggggtggctggaaggcagtgatttctaagttgagacttgaaagagggggagaatgtggatggaggtgggggaagagtgctagatatcatgccgtctctaagagggtgagctatttgtaataaatgtacctgcttcttaccacttgttctttccccaccaccaaatttcttaattttccaccttttcctggggctttctttctgaatacaaactcatcccattgcctcctttacaactaattgaacacttggacttaattgattatgtattaagttggggacttggagtgacattcaggactgggctcatgttgagattaatttattcctgtagtcttcctgttttgcagtgtaactgagtgcctcacatgtgtgttaaaaataaaacggagagtcagggcaatctaattagacagcttaacccatcactctcgtgttcagtcttcacccagctctcctgctttgatggtaaccaaaatagatgaataagttaatcaaaggtctgattaaatagcacagctctgcagcatggactaatgattgccaagcctcagttcaggcagattgctagaggagagaggaagctgagctgagctccaaaggccagggctttcatgaggaagatgtttataaagcacatgggagggaattcctcactgagtcctcggatcttaacggtgatggctcactctaaaggaaggataatgtagtttggggaaagaacacaaaccttctcctggcaaattctgactcttagagctttgcatcttgctggctgtgggattgtagacaaatcgcccgccttcctatgcctgcctgccatccatcatccatccatccatccatccatccatgcattcatccatccatccatccatctgttccagatatgtgttttgtacctattatatacaaggcattgtgcttatttttttttttttttttttgagactgagtttcgcttttgttgcccaggctggagtgcaatggtgcgatctctgctcaccgcaacttccgcttcctaggttcaagtgattctcctgcctcagcctcccgagtagctgggattacagacatgcaccaccacacccggctaattttgtatttttagtagagatggcatttctccctgttgttcaggctggtctcgaactcccaacctcaggggatccgcccacctcagcctcctaaagttctgggattacaggcgtgagccactgcgcccagccagggcattgtgctttgattttgttgttgttcatttaatttgcccttgtgttaactgtatgactcggttgtgtgaggtttttccttctaggtcctctcttgccgtaaccctcactttatgctccatgaggctgatgcataaagcatctctagtctcgctttcgctctggtttccgttagggttgactggagggctgccctcccgggagactggtgggcaggagggaagtgaggttgagatgttttttcctgttctggcttatgcgttgccacaggtaggctgtgtccctctgctgaaggtcactgcctcagccaggtggccttactcaaacagcaattctctctggattccagcatctgctggcctgggcccttttggccttggggtggtaatggccccaagtactcttcccctcctcaagtaactgcacggttcttgttactgcccctaattctgcatatacttagattaaatagtccttttattaaatcttccttagattccccaggagagtgtgctgtttccacccacacactgcctgataggatgaagtaagtgtagcaacatggatggagctggaggccattatcctaagtgaactaactcagaagcagaaaatcaaatatcacatgttctcacttacagatggaagctaaacaacgggcatacctggatacaaagctggaaataatagacactggggtctccaaaagaggggagggtgagagctgtgtgaggggtgagaaattgcctgctggatacagtgttcaacattcaggtgacaggtatactggaagtccagtctccaccattacacagtgtacccatgtaacaaaaatgcgtgtgtacccccagaatctaaaattaaaaattttttaaaaaagaaatcatgacctttataaatagcagaaactcagaaaagctgagcaaacctgtccaaggtgacatggcgattaagtgatgatactagaatctaaatccaggcatgcctgaatctaccacccagggtgttttgctctcctgcatacatcccacagacccttaccttcatctggaagcaccaaaagaggcactgatagctaaatacatggaataagatagagggatcaggaagaagggcgggagcttattactgagtatattttgtgtaccacgcccttgagtcctttaatataatttaatttttataccactgtgtgaagtaggcatcgtctccattttaccaacttttaaaaatgagcaactactcttaaaaaaaaactaagtaaccacatttttttctaacatcatagtctagtgatggtggcacacaggaggccaatttagggcagctatgagacaggttccccatgctgactcatgagacccattccatctctgaaacacactccattttacaggtaaagaaaccaaggcttagagagatcaaatgctttgtgtggggctagagcccagatttgaacttctgtcctttttccccacctccatgatgcctgggtgtagggtgacagggactcatacacagagttggggatgctttttttgaaattgatgagaggtgaagccagctggacttcctgggtcaaatggggacttggagaacttttatgtctagcgaaaggattgtaaatgcatcagttagcactctgtaaaaatgtaccatcagtgctctgtgtctagctaaaggattgtaaacacacaccaatcagcactttataaaatggaccaatcagcactctgtaaaatgaccaatcagtgctctgtaaaatggaccaatcagcaggatgtgggcagggagaaataagggaataaaagctggccaccccagccagcagcggcatccctctcggcttcccttccaagctgtggaagctttgttctttcgctcttcacagtaaatcttgctgctgctcactctttgggtctgcgccacctttaagagctgtgatactcaccacaaaggtccacagcttcactcttgaagtcagcgagaccaagaaccccccggaaggagccagctccgcacacagtttgatgtcttgctgctatttttttcttcctttgcatagatttgggtgaatgtgtttcatttggtttgattacacgtagttgtttttaagtaaaagcagttttaaagcttgcttttttcccctttaacatcatatgcaggtttttagaaattatatcttgatccacattgttttaaacaattacatagtatgctatcagaaaaacaagagtatcatgtttgaattaattgttccattttggggcattttgatggctgttctttggtaacatggtgatgaacatctttgggaataaaactttggtgtctaaaacaaaatttttaaatttgaatttttttaagaacatctcctcaacatggtatttgtaaggtcaaaggagatcaatattttttggaatcctgagaaggtggccatgttccctgttttaaagggttctattaaaagtgttaccctcttgaaaataagtgtgctttggctcccatggaaactccccatggcagctaggttggggcctctgcccacagtgatcttcataaatgactgtgcatagatgagagctttcatcacactggtgcttttatttttatccttgcctttggacacaaaatggcacccgtgtgtgtacctcgctgatgactctgcccacctgcaagccattgattgttccattatgttatgtgaggatcataatgtcagtgctccatgggtggttcatttctgtcctatgtgtgtgtcctctattgctgtcaggtgaagagtgtcgcgtgatgactaggtcctccttgactaggaggtgaagagtgtcacgtgatgactaggtcctccttctgtcctatgtgtgtgtcctctattgctgtcaggtgaagagtgtcgcgtgatgactaggtcctcttatttatctgagaataaagagaaggcagcagtagtaatctattcaattacagttttaaaagaataagcataagctttaacaatactactgcccactaatctttaatgacacgtaaatggaatatgatttaaagaaatatacgtacataggaacaatttgatactggttgcaaaagtatttgtagtgggattcaatttttggacctttatgtttttgcatatcctttttttctctagtggatctatttaatttctataataacaaaagttttatttaaaaatctcaacataggatttgcagtaataattatttcataactattacttttcctctcccttaattcagatacattttcctccagaaaacttcacatgtcaaaatgcaaattatataaatctttaaaagaaaactcattcatttattcaacaaatttttattggatactttttgtgtgctaggcactatttataatgtttaagcaaagaattaatatagcaattttttttccctttctccaactctctctctgccttgttctgtctagtctgaagtttcctggatccccaataaacattactctgggatttatggtctgatgaagcttgtcctgaccaagactcttcctgccaacctggagagagtcatcgtccttgacacggatatcacctttgccactgacattgcagagctgtgggctgtgttccacaagttcaaaggtaatggtagcccattcgttttttccccgatatccttgtaggtatcagcatgccaagaataggggttgacttttttaaaaaggtgaggtctcctcgaatgaggtcgtgctaatgcagtgggtgaggaattacaaatatggttcaatatcaactctgcttggatttgaaaaataatagagtaaaacagaaacttgtttacatgtctttagtaaatgaagatgtttttaacagataaatatcaaatgtgtgtattttgtatgcagatagcggagtgttcacatactggtcgggacgtgtgttcattggttttctttttatcgaaggatagtctaattgccaagaaagcctgtgaggtagtagagatgagtattgattctagagtttttgaaaatgttcatatggcttttgctttcattaacgttgtggtttatcattttaaggagatgtatgtatttggctttctttacaagacgttctttctagtctggtgggtttctttatagctattattgtaactctcgtcacggcctcaaggtatatgagagtacctagggggaaattgtgagctcagtaggtgtactaactgtggcatggatatgtgagagaagtggcaggttagcacaaatcttaggctgttattttaatacccctctcccagatgtctttttaaaaattatattattttaaaaattcttctatactggatgagtacaatgagaaagaaattcgacagtgaaatttttagttttatatatttttttaattgcacgctagccccttctgtgtttaaaatcccttctgccattcctcttagctccatatcctatgaaagcaaaatactacttaatgattttaaatcccagcattttcataaatcacaggatattcctgttggtttctgtttctattcatgaacagagagtaaatttccttgcttgccctggtcactccctgcttccttctcagggcttctgagctctgggctaattgaggaaagtcttcaccaaatcatgggaatgacattttgatccccgggactctttcccttatcaggatcaaaatttacttttcttattcgtgtcaataatgacactaacaatgacatcatttaggacagctgttgaaattgagtatggcacagctctctaatcttcatagaacgtgtggacgtgtccttttgtttcataaagaaagaaacggaagcttagagggatgcaggcttttcccagagttgagatcagagtgcccgtgtcttggcttccatccgctgctcttttcaagttcccctatcgtgtctgtttgtttttctcttcctgatcacagtgaactcacgaggggcagtttttctataattacatggtgttttattcattttcttatgctgatgttgagtgttcagtgatgcatttcttcaactggcgtttatcgaatccctactgggtgtgaagcagtgtgacgggctctgcaaatgaggagatgagtaatgaggggacagtgagagttgtcacctctcctagagggggttagagaaggtagctgggaaggtgtcacggaggagctcctaattgtgctctgtctcatcagatgagaatggtggtcgtatgtactagactcccacattttcctttgggaataaaggccttattacgccagctggtgggagcagtccctgcagcgggggctctcagaaaaggcatcagccctttttgcagttgcctctgttgaagtgagtggccatgcctgtggccacaccccttcgtgggacaccccacatcacggaatggctgatgaacatgaggtcctgcaggatcatctgccacactcggatactgcctcacaggctgattttcccctctgcctagtcctgctttctccccttccctttcataggtgctgttctcaagagctctctctaataaacctcttgtatgctgacatccatctcggggtctttttccaaagaaactcaacccacagcatatatttagagctgtaagtctccgttggataagtataaccaccatagtcaccagaacaggtcatcagagattgtagagctgtagctaggaaatcacgtttattctcttgcagcttgcaatggctatagtgctagtggcgctctgtagccaataacaacgtgaattgtcatggttattttaaatacgctgatatcatccgtggaagggaaggcaccagagctcttgctgctcccatagctggcccaaggacttgatttggaggactctcagattcaaggcagctcctggggttgagtagggtatatgggccaaggtcaggacagggacaaggtaaatttgaatgcaaggagctgagttaatgggctgcattttatttgttcattcttttgttggtttatttctagcatttgttaggcccccactgtgaagaggaatagattagatgctgttgttccctaaagctgttgagaacacagcacctgccttcaaggaactcagaaacaaggcagagtgcattgcgtttttatctatcaccagcaaaggagtacaaaacatcagaagttttcccatgcccaccctaatttttctggaaaaatacagaggtgaaaagaaaataagtaaagctcatctcttctccatatgtccctattttgtatcacttttgtatgtgtgtgattgtttttctaaaccaaactattagaagccaggtcatggaataggaagaaagcctgttaagtcaggcgcataaatgtagaatgttctgatccaagagagagtgtccttcataaaggcaattgtcgttgacatccttcactgtaaacggttggagtgatgttgatacaatgtggcctggctaatttttcactttttgagaacagctggttgtctggggctgcagtggctcttggtcagattgcgcttgattcctttgtggcgctgtgaaagccccttgttcctaaattcattaccgggagaattacaaagaagcctttttcaggagttagacccatcctcagcctctaccagaagaagcctcttagagatgtccccatcttccctgagctcgacttcagctaagtagcagatacctccctcctatgtcagcggtttgcacctttacccagcctgcaccaacagctggaagattttcagaaccaccaattcttagcagaaagaatcagacataccattattggccagggtcaggagccacccattcggtcaatatttactgagctccttctaggtgccaaatagcttactgttgggactgttgcaagaataagactgtttggtgagcccgtagctacaccggggtgctagtaccagagtggctagcagccctgtcctaacagaacattcaggggagctggacatgggtatggtatgcttctcacgagatacttctggtatacctggcaggggtccctcacatgggaaacttattttcataggcagatgtccttgcagctcttgtctgacctgtgttcagtttacacctgtctgactaccaactactctgccactgggagcctgaccttgtcctctccctggcgtaccagagaaaaccagcctggggcagcccctggttcttcaatggaaggcgcaaattcaacacaccattacaatggtggagctggtgaggaggcaggtggctaaatgagtgtttgtaaaacagagggaaagctaactaccatttcttaagcacgtcttaggttctaggcactgagctagaagctttgcacacttgaaagttaaataaactgatggctcacgcctgtaatcccagcactttgggaggccgagcccggcagatcacgaggtcaggagatcgaaaccatcctggctaacacggtgaaaccccatttctactaaaaatacaaaaaattagctgggcgtggtggcggacgcctgtagtcccagctactcgggaggctgaggcaggagaatggcgtgaacctgggaggcagagcttgcagtaagccgagatggcgccactgcactccagcctgggtgacagagcaagactctgtctcaaaaaaaaaaaaaaagttaaataaactgggctcaagagagattaaattacttttcatgctcagagagctattacatagtgaaactgaaccccaatccatacggctttggagtctgtgctctgtccactgacccaggaggctgtactgcacttagaacgggtgtgactgctgagtacgtgtcaccttggacccctgcatgccttagtttttactgcacaaaacactggaaataatatgtgattgttgtcatttggggaggctgttgtgaaggcataaataataaatacacacccataatctgaagcttttggaagaaggccgtgctgaatattcaagatagtgatttgatccataagcacagatgcctcccctctaagaggatcttagtgccacagagtaaaattctcaccctacagcaggtatggtcaaactatccagcgtacatgggcactgccttcctcaccctcacggcaccgcagatgtgccatgccactgggtatcattcagggcctaatagactctgtgttgttccttacaactaacatgtttaagcacttagtctgtgccagccactctgttaaggactttatggataaactcatttaatcctcacaaccctcccatgaagtgattactgttgatgttcctattttagagatttgggagctgatgcttagggaggcatagtttacctggagtctcacatttcttaagtcatgaaaccgagatttgaacccaaacagtctaactttgaatccagtcctctttactctgcaccctcctttcccttgaagaggagtaagagaaatcattgtcatgtgggtggagttaagagtgtctttggagagaccgaagttagattcgtgaaagaactcaaagtgaccatatacaccaggttgtagagggcgggcccaaggcgatctaggcattcagagaacaaaggcagggaagcaaaattagcatagaaaagtgtagttttcacaggattcgagaaataaaatctcagtctccagaattctggcccagcatgtgacctccgagaacatcatctttaagtagctgtagttggggtccaagagctctacccagagactcagcatgtccagagaataaggcaggatcaccctgatgactctgtcagcgtgggcagatgctgtggcctgaaggtttgtgtcctcgcaaagttcctatgttgaaacctaacccccagtgcaatggcgttaagagtagagcctttaggaggtgattacctcatgacagctgtatgaatggggttagtacctttatgaaagaggcttgacagaccttgttcatcccttatatgtgaggacacagttaaagggataccatcagcagggtgtggtggctcacgtttgtaatcccagcactttgggaggccgaggggggtggatcacctgaggtcaggagtttgagaccagcctggccaacatggcgaaaccccgtctctactaaaaatacaaaaactagctgggcgtggtggtgtgtgcctgtaatcccagctactcaggaggctgaggcaatagaatcacttgaaaccgggaggcagaggttgcagtatgccaagatcacaccattgcactccagcctgggcaacaagagcaagactgcgtctcaaaaaaaaggtgtaccatcaatgaagcagagagttctcaccatgcatctgatctgccggagccttgatcttggactgcccagcctctagaactgcaagcaataaatttctgttgcttataaattacccggtgtcagatattttgttatagcagctcaaactgaataagacagcaggttatcttagttgatttaggctcagagaaggaataatgctaacggggtctttgtgagaattgtacaagataatgtgcattatttttccacattccattttctctaaggactcctgccagagtgaatgggatgatggcagacatcgttaatgtgtgtctgctccatttcctcacagttctgtccacagagccattggggctgtacaataatgtagaaaagctgaacatgaagaacattgaagtattacttttgaaaagacatttgtagaaattttatgcttataatcagttgcctcgaaggagtttttaatgctctttgaagtttcttcaggtcttgtctttctttgttaccttgccgccctgcctgtctcctctgatggaattggtggagtcagaagagcttagcaaaaaagagaccaagcttcaagtccctgctggtctactttatcagcagggtgatctaagggaggtcattgaaccactcttgacctcgcttctgcacctgtagaaagaagatactgatatctgctcacagtggttgtgtgaaatttgaggaggtgattcagtgatcctggtacctgacggacacttggaccttgcgtgtttctttcccctttccttcctcctctctcctgtggttaagtttggtgttgtcccattggcccctttttatttgactttaaatctcctttcctgccttcccttatctccaaatgaagctcagtgtcccccgccctgttagcccataggaaaggaatcaaagaagacctttcaagacaatcccatgaccttatgccagtcagattttcctgattaaaggcttcccttcttggctggcccagtgtgcccccttctagggctcaacatggacagatttccacgcatctcacattcactcctgacagttcctaaacttgagagactgttttgccccggggaagaaaaacataaattttaaaagatgaaattctcaaagtgctttaaaatgacaccaacagctggtgtctgtagaggtgatgtgcttctagtacagaaggcgctggaattcagctgggaaagggcgaggcttggcctgttcttggtcagcaatcatacagttttgttaaaagtcctgggcatttctttttaatctgtacggggcctttagaagttctcctgggccgggcttagtggctcgtgcccataatcccagcacttcaggaggctaaggcgggtggatcacctgaggtcaggagttgaagaccagcctggcaaacatggcgaaaccccatctctactaaaaatataaaaaattagccaggcatggtggcagtcacctgtaattccagctacttgggaggctgaggcaggagaattgcttgaaccctggaggcagaggttgcagtgagccaagattgcaccactgcactccagcctgggcgacagagcgagactgtctcaaaaaataaataaataaaaagttctcctgcactcccagtattgataaagttccctcctcactaccagttttcatggttttgtttaggtctttaacgtcctctagctcctagttgattttccacttggaaaattttgatgacctcttccattatttcctccttgtaccctcctgctttctctgcctctcttaaccagcctgccttctactcagaatcagaaactagcgctttgattttcttgatagacactactggttcttccattggtccagccaagatgtacaccattgaagcaacaccaaggatttttttccctggcagaattgggtgaagaggttttaattattttcagattaactttgaagcaaatctgccttgtcttatatattagaaagatcatttaacttctcagagcctcgtttttgttgttgttctataaaaatgagagaatgatacattaataaccgccccatagggtttattttggtgattaagtcaggtaatggctctgtattgcacaatacctaataagtgatagttcccttcttttctttgtatgtctcagggttgtttgtttgttcgtgaaacagtctcactctgtcgccaggctggagtgcagtggcacaatgtcagctcactgcaacctctgcctcccgggttcaagtgattcccctgcctcagcctcccgagtagctgggactacaggcgtgcaccaccacgcctggctgattttttgtattttactagagacagggtttcaccatgttggccacgctggtcttgatctcctgacctcataatctgcccacctctgcctcccaaagtgctgggattacaggcgtgagccactgcagccagcctcttttttttttttcttgttcttcagcctgaaatttcagagagttcacagaccagaaaccaaccctaacctctccctaccttcctgagttcctttctccctccttccctccttccctgcctccctacctgcctgccttcctgcctgcctgcctgcctgcctccctccctccctccctccctccctccttccctccctccctccctcccttccttccttctttccttgccttttgcacccattcagtcattcattctttcattaatttactaccttctgaggctcttggcctgccctaggccctgggggtaaaatattaactgagacagacctagctctaccctcctgttgctaatatctattaaatgtgttttatgtgtcatgccctgaaccatctcatttagccttcataaaactctttaagtctgttgcctgaaatcactaactacaagttagtggcaaaacctgggctgaagccaggctggtctcagagccgacacttaaccgctagattctagatacatctgaacacatggttacatgcaagtgtagaaagtctcttgaaagggaaaagtcagggtgaggtcgaatcacattttagggaaagcattgctagtgagggaagttggagggagtcaggagggcttctaaagggagagaggtggatgcattggcctctggtctcacttagagggagcagcatatgtgaagccctgagatccagagagagattagagagagtgatacagacagaaactgaaataaacattaaatctacacttttttttttttttttgagatggagtctctctctctccacccactctagagtgcagtggcgtgatctccactcactgcaacctccacctcccgggctcaggcagttctcctgtctcagcctccagagtagctgggattacaggaatgtgccaccacacccggctaattttttgtagttttagtagagatggggtttcaccatgttggccaggctggtctcaaaatcctgacctcagtggatcctcctgtctcggccacccaaagtgctaggattacaagcatgagccaccacgcctggcccttcaatctacttttcaaacagaccagacaggctcctacctttggccctctgctctgatgttcctgtacctggaatgctgctcctccagatcattccctgtcttgctaccataatcccagcccttcgagtctttgcccaaacctgagcttctcagcaaggctttccctgactgtcccattgaatcctaaagcctgagacaccatcccatttttctctactgctctttcatattttttttttcaagaggactcatcaccttctaatgaatatctaattacttatcaagagggctgctctgcctcaccccatagggaggacagacccaggtaccaggatacagctggctccatctggttattgtgtgttctttctagggacctcccacggataccaaaatctgcagatgctcaagtccctgatatataaaaaattgcatttgcacatcatctgtggacatcctcctgtatgctttaaatcatctctcgattatttataattcctaatacaatgtaaatgctaagtaaatagttgttagactgtattgtttagggaatagtaagaagacaaaaaaaatctgtgtatattcagtacagaggcagttttctttccaaatattttcagtccaggttggttgaatccacagatgcagaacccatgggtgtggtgggctaactcagtgtaagcaccaggaaggcagggatctttgtctgttttatgcctgatatgtcccagcacagaacagtgcctgacacatagaaggtgcccgataactatttgtcaaatgaacaagtaaagcggatgtttcttggtgaagtgagtggtggggaataaggtaagagaggtataaagggtcttattaagtgttagctttgggtcttctccaaaggtcattgaaagacagtttagaagatttgaaaagatccctttggctgatgtgtgggggtgatataaaaagtgcgacaggaaaacagtactttcaaaaagagttggcagcaggtaggaggcttcagtctcagcaaaagaccactgtggcccgtagcgggatgttagccttggagtcagagcaagggatgcagattagagatgaatggggacgtagagtgaatagcactggacggcgagttcggttttggacatgcagagatggggtaaacaggtctagatcttacaagaagggtcggggccaggggtctcttcaggtgtttgttgttgttgttgtttttaataaacttgaaatagagctttcttggtgttaaaataggtattctcaccagattgttacagtttccttttctgaatggccaggtgagccccagtgtagaatccagttgggcagctctgtagtgcgtggtcctgcagggacagcagaggggatttgatgaatctaacacagggctcattggatgggggcaggatgaaatcagcaagcacaaagactgggcacggtgtgattggcaagctgtgatttgcgagggggagcaacggaacggatgctgagcagaactcatgaggagggatcactggactcaccctgattgtgtcctgagctcctccttgtacagcccacacccagtgaatgatgttcactgctgcctccagctgccgctgcgttgaaaagtcagccatgccctgggtccctagctctgtgctgcttactgggtgggagtgaggagcctcacggatccatcaccaggattccatggacctctctatcagttgtgggtctttcttagacacacagggctcagactctcacggaggtgagctggaggacccttttaggctcctcaccaagggggaggaaagacatctctggaggtagatgtgagatgtttctttccccactccctttcccaactcaagtatttactctcagtcaagggcccttccttggggttgctttgcatcctcttgccatctttgcaacgtcggggtgttgctcaactctaaacctctgtttcctgtgggcaagatggggagaatgatacccatggggtattggcgtgagggtaacgtgacatgatacatttcaaagtcttagtgctatacctgacacagtaagctcttgacagtgttagcttctgctgttattaatattagagctattttgttttgttttgttttgtttttgtgacagggtcttgttgtgtcacccaggctggagtgcagtcgtgggatcatagctcattgccacctgaaattcctggactcaagggattctcccacctcagtttccagagtagttgggactgtaggcatgtgctaccacgtctggctattttttttttttaatttttatttttgcagacacagggtctcactttgttccccaggctggtctcaaattcctgggctcaagcgatcctcccgcctcagcttcccaaagtgctgggattacaggcgtgagccactgtgccccgctgagtcattttattgtaatcacaataagatggctgtctacatacctctaaacagttcaggatgggagaggttcttaatatcagaggagacaatgcaaggccttggagtaaacacatttccaaaaataatctctgtcaagatggggaaagaagcctgagaaatggttatgtaaaagcataggagttgggggtttgctcctaattggaaagagctggccgtgtatctcagtggggaaagtacaggctgtagagtgggatgattccaagacctgggtttgaggccccacgcttccaggcacttcgcaattcagcttctcattctcaatgggaatattatgttaggagcaaaatatgtaattcacctagtattttgcaggtgttttgtcatattatctcagttctatgatacaggactttgcacattttcccatttccgaaactgagatgtgacttacaaaagcaacttgacagatggtctttttctcctggcaaatgttttgatatatcgtacaatcagcagcctcttagaatccagaaaatatgttgtgattatttttattagcaatatctctctagcttttctttttatctttgagttgtacaggggagaaggagggcgagtaggactgtagactaaaggagaaagagctgagtcagtcaaagagaggatttgggggtcttagcagactcttccttgatcaacttttattgtttgaccacagggtcctggagcatctgcaccattgctatttttttttcttttgtaaataaatatcgtgcttgtgtctcccgtgttgagataggtgccatctcttggtaagccctcccatgtggagactgactgtctgtttcctggaagcaagtgtttgtataggttgggggcaaggagagaggggaggtcaagggacagagttgtggtacaaaaacatctgggatttctttgagaatatcaggaagaaatattgaaaagcagaacagcattaaatccagaactccaggaagcctgctctgccatgatgtctcttcttgctcagacatttataaatatttattgagcacctacttgttaccatatgcacaagttatgctctttaatgctcagtccgttagaaattcatatgactgacttagccttccttgaaaagatctgatatttctgggaacattttagtattacccgtgattaatgtgaattttttagctagatcacttttttttttttttttttttttgagacggagccttgctctgtcgcccaggctggagtgcagtggcgcgatctcggctcactgcatgctccgcctcccgggttcacaccattctcctgcctcagcctcccaagtagctgggactacaggcgcccatcatcacgcccggctaaatttttttgtatttttagtagagatggggttgctagataacttttaacatcagctgctttgagttcaagagattttgattgcagacacagctattgtggatgcgtagaggggacagggctttccaaggacattctggacaaagagggtgagtgagtaggttaggacctaataaaggcaataaacaaatcccttgaggcaagaaacaaatggcttgttgaatgaatttatggagataaagtccacacctttagaatcatgtgctaagaaaagaagccagtttcctttttcttgtttgttctagatgtatcttgtctgggaatcccacatgaaagtcagggttactcctactctccataagcaacaggccaaattgaactaatagccatgtgaaggctaagcagcagcctcatgatcattgacagctctgccttttgaacagtaattctgagccatggagaggagggtagctgaagtactggaattacctgtagggtcttttcaaattgcacaggttcatgtccactcttatctctgcacagtggcctgctcatcaccagtgactggagaatctgccttagtacggggtttctccatgttggcactattgatattttgggctgtatatgtctttgtgtgtttttaacagttgtacaaatgtatggggtacatatacaattttattgcatgtgtagattttgtagtggtgaagtcagggcttttagggtatctattatacgaataatgcacattatacacattaatttctcatcatccacccctttcccatccctttacccttctgagtttccattgtctgtttttccactctctacatccatgtgtacacattttttagctcccatttataaatgagagcatgtgatatttgactttccctgtctggcttgtttcacttagacagtaacctccagttccacccatgttgtttcagaagacatgattttattcttttttgtggctaaatagtatttcgttgtactgtgatatgcatctgtataccacatttgcattatccattgatgggcacgtcggttgatttcatgtctttgctattgtgagtagtgttgtgataaacatcagtgcaggtgtctttcttatataatgatttctttttcctttggttagatatctagtggtgggattgctggattgaatggtagttctattgttagttttttgagaactctccatactgttttcttctaatttacattcccaccaacagtgtataagagttccgtcttctccacatcctcactaatgtctgttattttttgtctttaataatggccattctgactgagtttaagatgatatctcataactttttgtggtggaagggctgtctttcacactgtgggatgttcagcagtatccctagcctcttccctctatcctatgcccctccagctatgacacgcaaaaatatctctaggcgttgccaaatgtcccctgaggaaaatgtctttccctgttgagaaccacttccttaatgacccactgttactgatggaaatgtgtagggtcctttaggaatatgtagtggacttggtagttttaagtggttaatagcgactggcccaagaaatgaaatctaaaccttccacaacttctatatatatatacatacatacatatatatatatgtgtgtgtgtgtgtgtgtgtgtgtgtgtgtgtgtatactttaagttctagggtacatgtgcacaatgtgcaggtttgttacatatgtatacatgtgctgtgttggtttgctgcacccattaactaatcatttacattaggtatttctcctaatgctaaccctcccccatcccctgaccctgtggactggattaagaaaatgtggcacatgtacaccatggaatactatgcagccgtaaacaaagggtgagttcgtgtcctttgtagcaacatggatgaagcaacagaatgatgggaaaccttcattctgagcaaactatcgcaaggacagaaaaccaaatactgcatgttctcactcataggtgggaactaaacaatgagaacacttggacacagggctgggaacaccacaacttctttttcagttcataactcatagtccacgatccatgtgctctttgacttgacttttcttaaactcctattttatgtgcttctgacttgctttcccttcttatttgtaatccacactagcctcaaaagatgcatgaactgtgaattttcacttccagggccatggatagttgaacatctagtagtgaatttcctctttcagaagataaataaattcattcattcccctggatctagaaggatacacaataccaagagaaagtgtgatcgaattaaccagactcaaaagcattcacatccacaaaagggcacagattcagttaggacccattagaatttatggtcttccctcgaaattacaagagggaacaacttgcagctcatctgcatatccgtgaagagaggaaccagtgtatgccattctatgactatcaagaagacacaacttttttttcctcctaaatgcatatacatagattattagaagcatctaatatatgacaaagacatatgtggcctgtcaatgaagacaaatatgctggtctcttctctgcaccatgcactgggcttgcccatgtggaaggatgcagcaggcagaggtatgtatgcagggtccttattgagatgaatggagggtccttattgaaatgaatggaggggccttttaaaggaacactgtcaaccagagtaggtcctggtggaaattaccagcttccctagaagcaaagggatacttttttcattaataaccacctccatcagaaaaggaaggtctggcttttattttcttatttgcctcctgatgaattttagggacaaagaaggcatgtggattttaggcttctcttcgttactgcttagatgtcaaaaatgaccacaggtcatatcccatggtagcacaaattcttatgagataaaagagaagattacccaaatccagccaataatcctctttttaaattttatttttgagacattgtatactacaatataaataacaaagggagcctgtattagtctgttctcacactgctgtaaagaaatacctgagccgggtatgatggctcgtgcctataatcccagcacattgggaggctgagacaggcggatcacctgaggttgggagtttgagaccagcctgaccaacatggagaaaccctatctctcctaaaaatacaaaattagccaggtgtggtggcacatgcctgaaatcccagctactcgggaggctaaggcaggggaatcgcctgtacccgggaggtggagattgcagtgagcagagattgagccattgcactccagcctggacaacaagagtgaaaagtccatttcaagaaaaaaaaaacggaatgcctgagactgggtaatttatatgaaaagagatttaattggctcacagttctgcaggctgtacaggaaacatggcagtatctgtttcttgggaggcctcaaggagcttacagtcatggcagaaggcagagcgggggcaggcatcttacatggcagaagcaaaagcaaaagagcgtaggggaaggtgccacacattttttaaaaaaccagatctcatgagaactctatcaccagaataccaagggatggtggtaagccatttgtgaaggatccaccccagtgaaccattcacttcccagtaggccctacctccaacgctggggatcacaactgaacatgagatttgggtggggacacagaacccaaaccatgtaagagtccttgaaacatctgccttatattgggagttggggggtggggtagggttggtcggcagtgatggactctttattttctttattaaaaataacttttttatggcaacagttttagattacagaaaaattatgaagacaatacagagagttctgatataccctatagcctgttccccttattattaatatggtacatttttttagagaacctgcttttttttttttttttttttttttttttttgagatggagtctcactctgtcgtccaggctggagtgcagtggcacagtttcagctgactgcaacctccacctcccggattcaagcaattctcctgcctcagcctcctgagtagctggaattacaggtacatgccaccatgcccagctaatttttttttttaaagtagagatggggtttcaccatgttggtcaggctgatcttgaactcttgacctcatgatccacctgcctcgtcctcctaaagtgctgggattacaggcgtgagccatgagaacgtgcttttaagaagcctggtatggtctagaccaggggttcccaaaccctgggcgccagaccggtgtggtctgtgtcctgttaggaaccaggcgagcaagcattacagcctgaccttcacctcctgtcagatcagcgctgggattagattcccatagtagcgcaaaccctgttgtgaactgcgcatgcgagggatctaggttgcatgcaccttatgaaaatcgagctaatgcctgattatctgatatctaaggtggaacagtttcatccccaaaccatcctaccctcccccccaccacccttcatggaaaattgtcttccgtgaaactggtcactagtgccaaaaaggttagggactgctgtacatacagtttaggtatcatacatacatacattagcttctttcatcttcacaaaagacctggcatataacagttcagtccacatcttagaagagaaaaaaaaatgcttaaaaaggttaaataatactaaatactaaaatcttctaactggcaagtggcagagccaagattacaaccatctccactattacgagttgatttattccacaggttttgaagcactgttcctcatcaatctctaaatcagtaccgagtttgtaagaatggataagatgggccaggtgcggtggttcacgcctgtaatcccagcactttgggaggccaaggtgggcggataacctgaggtcaggagtttgagaccagcctggccaccgttgtgaaaccccatctctactaaaaatacaaaaattagtcagatatggtggcatgcacctgtagtcccagctacttgggaggctgaggctgagaatttcttgaacacaggaggcataggttgcagtgagctgagattgcaccattgcactcccgcctgggtgacagagtgagactgtgtctcaaaaaaaataaaaaatttaaaaaaagaatggataagatggttcacctgccttcatggaggtcctgttctgagaattccgaagggcagtcaaagataaaggactatggtgagagaaaagggggcatgtgccaaacataatggtgttgccatggagacagtcattaatttcggaacctgggaaagacatcccccataacctaagagaaatcggtccttgttgattggctggagatctccacctgggaaaaggggaacaaataggccattccaaacaaaaggcacagaatggaccaaaggcaggaaggcatgataaagcgtggtgtgttccctatgtcagttgcattccctaaggaatcaggtggttggtgagatcggagggtttgggaaggtgatggcagatcgaaaagtaggtaggagctaggtcatgaaggatttagcgtgctgtgccatgccaaggagtttggccttttctggaaggcactgaaaatccactgacagtctcataaggagaagactgaccaggtcatactaatcagtcctcagtgtagaaaggtgagtgtgcgcttgtcagagaaatggtttggaggaaccaaaaccgagcatccaattaggaagccatgtcaataattcatgtaaggaatgatcatggcctgaactaaggcagaggttgagcacaacagcagaatcaaatgctattaaagggttaaaatgggtgtccagggcacctgccatggctcacgcctgtaatccaagcacgtcgggaggccaaggctggtggatcccttgagctcaggagttcgaaaccagcctgggcaacatggcgaaaccctgtccatacaaacatataaaaattagctgggtgttggctgggcgcaggggctcatgcctgtaatcctagcactttgggaagccgaggcagacagatcacttgaggtaagaagttcgagaccagcctggccaacatggcaaaaccccatatctgcaaaaaatacaattagccaggcatggtggtatgtgcctgtagtcccagctacttggaaggctgaggcaggagaatctcttgaacccaggaggtggaggttgcagtgagctgagatcgtgccactgcactccagcctgggcaacagagcgagactccaactcagaagaaattgtgtgtgtgtgtgtgtgtgtgtgtgtgtgttagctgggtgtagtggtgcacacctgtagtcccagctacttgggaggctgagttgaacacaggaggctgcggctgcagtgagctgagatcataccactgccctccagcctaggcaacagaatgagaccctgtctctaaaaaaaaaaaaaaaaaaagaaaaggaaagacataggtgttctggtcaggtgtagtacaaaagaaaaaagatttgtacatgacctactttcccagtttgcagattaagtagggaatacaaaaggaagcgcagatttagagtgagagaatgaattcgtctcttctatgtctgtgatttttctttttgttgttgtggttttgatgtttcactataacacgtgcttcctcatgatatactgtgtttgtgttctactgtggtagttgtggtgttctgcctgctcagcatacgtttcttccttccagtaacatcagcagaatgactgtttttctgttgaacaccatatctctccttgcttgtttcagttggtttttagtgtgtttgaggggtgttgatctcatccctggctgaagggataaggacatgactcagtcctggccagctgcaagaccacagacatctccctggctatagggattggtttagggcagatttgtgacccaagctgaaccaatcagaactagtaagcattacgccaaggctttttgctagtgctgttgggaaaggtactcgttgttgttgttgttgttgtggttgttgttttgagacagggtcttgctctgtttgcccaggctggactgcagcggtgtgatctcagctcactgcaacctccacctccagggttcaagtgattctccttcagcctcccaagtagctgggattacaggcgtaccactacacccagctaatttttgtaattttagtagagatggagtttcaccatgttggccaggcaggtctcaaactccttacctcaggggatctgcccgcctcagcctcccaaagtgctgggattacaggcgtgagccaccgcacctggtagaaaggtactctttccactctatttgctaaactgtgatgaggcaaagctggaaccaccatttgtcattttgacaccgccaggagtttccaagaccacccctaaattcactggtttgctaggaggactcacaagactcagtgtatgtcatactcacagatatgatttattacagcaaaaagatataaggcagaatccacaaaggaaaaaggctcatggggtgaagtccagaggaaaccaggctcaaacttcaagagtcctcccccagtggagtcacgcaggacatgccaattcccccaacaatacgttgtgacaacacacatgaaatgttgcccaaaagggaatctcatgagagactcagcacccaggatttttattgggggctggttatgtggacattctctaggacataccaaaattctagactcccagaaggaaagcaggtgtttatggtaaaccattttgtttgcacagtttagacacagtgagctcttagagaatagcaggaagcttcccaaaaccccagttctcagatgccagccaagggccagtcttgcaagcagttcatcgttctaaggacagcagtgtcaagcctgccgtgttacctctttcctagacagtcagtttgtctgagagggcaaacagatctgagagcttgaaaagagaagacagattttagattacattgtgttggagtctctagttccagccatgcctgaagcaaaatttctctttttaaaaactgcttaagtctcagtaaagtctctgtcacttgcgaccttaagaagcatgctggctgacagaacccatgctaagtaaataaaatgttttcttctgacttcttttccacttactaccatcattgtttcccttcttaaattgtcagagcctccttattgacagggcctttacccccatagcctagcatagtacccagcttatcataggcatttgtaaacttttgatgcgtggatgagttttctgtagccgtttagaggattaatctgtttagatggaaaaggtggtatctgcagcctatttatccatgaaagtgacctaaattaaaattctgaccaagctgaattatctctttgatcttcccttttacaaattcctcttcactgagaaattggccaccgctcttattaagtagtactacttgggctcaccatcctgggcctttttttttttctttttttcttttttggcctaattaactgtgtcaccattcaagccaattaggtgtgtgccttactgggagatcaattaaaaaataaattagtgtcaaagtggaaagggatgtgtcgaaagataaattttctttccagtcttgtacagaagcagcgggaaacagagcattttgtagctttacttacatgcacacatgtaggaaagaaggactggaagggatcttagaggtcatgagttagctcagtgccttttgttgcaaaggtcaagaaggttctaaggtctttgacttggatgatgcaatttcaagagaacttcgcttggacagaagtctgtgtttcatctttactagctgtaggcgagtccctctacctttctgatcctaagctatctgttcagtaagtgcttcactgagtgactatagaaagcatgaatgattagtaaaataaatggatttgagtaggtgggcccagtgtctctttcaggtctatggatctgatgcaaattcacactgtcaggggcaaagccagaaccatataaaagcgggcatctttggtacctctcttgtcctcataccctacatttatcttccagtaagtcctgctggctgtgccttcaaggttctatatacctatccaagcctactagatactaaaatattagttattgaataaacaaaattaggtctctggcctctgggctctttggattctacgatatatttttctcccttctgttcctttaaaggagcaaataagagggaccctgaagtcaccaaggggacttgagtcactgagtttatatccggcatgaaacactgtccaaggcaggaatggagacacagagtgaggaagaatgacgaaatctgccccaaacagggttcccatgagagttcaactaatgaacagtgacctgctggctcagcccagggagaatctcaaaacataacatttggcttccaaatcatgctagattgtagtctatatctctggagacagatctggtagcagttacaatggaagtgggcttttattctttttttttttttttttttttgagacagagttttgctcttgttgctcaggctggagtgcagtggtgcgatctcggctcaatgcaacctctacctccttggttcaagggtttctcctgcctcagcctcctgagtagctgggattccaggcagccgccaccacacccagctaatttttgtattttagtagagatggggtttcaccatgttggccaggctgttctccaactcttgacctcaggtgatccacccgcctcagccttccaaagtgctgggattatagacatgagccactgcacccagccttgaatagctcttaatgtttctcatagacacgtacagtaggggctcaaccccaaatgtttgtttccttgacttaagattttagagataccctgatatcccatgacatcagcactgccttttttttttttttttaatttttggaaagaaaatgtgttttccttgtagaacagtaagacgatgactccagacaggatgagggcagtcagcacaaaaagaccctctgggcctcattgtaatagtgaaggaaaaaacaagaattgactagaccttttcaagaatggattgctctgctggaggcatcattaaggttctccagactgatccactttatacatgtgtgtcatgaataaaacaatgcatgtccgtatcagcacaaaggtaaagaatgaaactcaattgtgtatatttctactacctacagtcagctattgttaatatttcagatgcttttctgtgcatataggatggattcttttataaaattgggatcataatataatcctgtttgtataccagtctttttcgtcttaactttgcatcacaaccatttttctttgttatgctaaaacataaaagtcaaaaagtcggcttgccctgtgttcaagtcccagccccggctccgtaatcttggtgatccaattaacctctccctgccatattttctttttttttttttttctttttttcccccactttttttgagacagggtcttgctctatagcccaggctggagtgcagtggcacaatcacggctcactacagcctcaatctcttgggcttgggtgattctccccctgcaacccgccccccgcccccccccccccgcaacccaccaccccagccaccatgagtagctgtaactacaggtgtgcaccaccacacctggctaatttttatatttttttttaatagagatggggttttgccacgttgcccaagctggtcttgaactcctgtgctcaagcaatccgcctacctccgcctctcaaagtgctgggattactggtgtgagccgctgtgcccgtctgccatactttataggaaaactgggcaccttctcttctctgagtgcagttgttgtcaacactgcctttaagttataatcatctggggagcacgtgaagaataatgatgcccaggtctaccccatatcagccaagtcagaacctctggtatgggcagtggcctgccgtatttttgaaagctccctacataatgctgaagtgtggccagggttgagattcactgccctaaggttgctatcccaggatctgctggctactgcaacaaaagagacactgtgtcttggttgttttgccatgggggcagtggggcagggtactgtttgggaggagtgtttggagacgggattaaaatcctggcacttgtccctcccagggaaaagggtcatcctgtttattttgtgtcaagagctcaaacagtgatcaaaatccaatccaacatcataaataccagaaaaggtcagggctgggctggtcataggatcaagcacacacagccgagctgaggttggcacttagtcaactccaaactcttcactagcaaacagcacagggggggacttggcaaggcccggcctcttggcgccccagtcacagaatggaggttcacatggctctgttgtttttgtcgaaggaggagaaatgccattttctcagcagtccttctccttgactcattagtgtagttggcaatgtggttactttttaacttctctgcaaatattcatagaaagagaaggggagtagaaggcaggagctgttaatgtacaccaagctcctattttttgcaggcctccacagggtaaaagggactggcccccgtgcaccaggccactgccagtggtgcagatgaaggacctgagcccccacaggcatctgaggtcacatggtcagtagagctgggaattttatcccgggtcagaagaacttcaaagcccatattttgtcttattactacacatcttaagagattagagggccgggtgcagtggctcacacctgtaatcccagcgctttgggagggcaaggcaggtggatcatttgagcctaggaatttgagaccagcctgggcaacatagcaagacctcttctctacaaaaaaatacaaaaattagccaggtgggtgtggtcccagctacttggtaggctgaggtgggaggatcacctgaacctggaaaatttgaggctgcagtgagctgtgatcgtgtcactgcactccagtataggtagtggagcgagaccctgtctcaaaaaaaaaaaaaaaagtttggaggatttaattagatcatttctagatattctgatcttgattgtgacaatctaaaggaaattgcattgtaggctatttaaggaactttccacataagtttgtcaagccagcctagctaatagaacaggatatgtttgagcaagttatttaccccattgggcctatgtggaatcccactggctcctttaataaaagaacatccagtcctcagggttggtgataagatgagtgtgaagtgcggatgcccatgggcatggggaatttatttaccagttcttttattaaaagagctggcaggattctgttaccaggacttgcctttttttttttcttttaatcagaaaattttgacaaagaatctatgaagtgcagatgtagggccaaccatacttttcacacttttttgattgtatcctacagtcagaaatacatttttcatcacaatccaaaagacatatgtgtgtatgtatgtttatacaggcatatatacacacatatatgcagatgagcaattaaaacaatattttcgtaaaacaatacttgaccttactatgttcagtgaatttttatatttcttttctaatctatttaatgtattttaatttttaaaatgcttgctcagatccactgaattattttcacaaccttcaaatgtgttacaaaccctagtttcaaaaacactggactggaagatatcctaaaatgccttttaactctgtattaagcattctgaaattcagcaaacttgccagcaatcagagaggagatcagaagctcattttctagaacccatttgctggaaggggcagtgagtaatctcttgtagacggcttccttgtcctccagtggccttccccttcattgagttactttgtgtggccgtgccaagcatggtggctgccacgtggtggggggagccttacatctcattttccttacttcccaggcaggtgccctgttttatttatctctgtattccaagcatctagtaaggctcaacactgggctcagtaaattgatggggaaacaaaataaaaaatgtggctccattttcgtttttcattaaccttcagggaagattgcacaatgtaccttcgtaatgctattcattttttaactagcttcaattcagctcagaaatatgtatggaaatatgcctactatgtgccaggtaatgttggacacagaagacactaaagaatgcgcaagaaagagaagtgattcttgctctgaaggaaatcctgtgtaaatggagaaggggaagaaaaaagcaaaaataactacaaagtaatatggccattgcttgtgcagagagtttccaaaagcatggtgcaggcatagttgaaggagagttacttccacttggggtaggtgaggttgaggggaagcactagagctgggctttgaagactaggcagcagtttgtgagggtccaaatagcagggaattccaggcaaaaacagcaccttggaaaaggcatggaggcatgatcctgcaggagctgtttgaggcaccatgacctgtggatgtggataaagctgagagttcaccggaagcaggcctgcaaggggttgggcactctgcctcagagacataggacttaggttggaatcgcaggtcctcctctttctacctgtgataggctggataatggcccccaaagacatcctcagcctaatccatgcactagaacctgtaaaaaagtaccctgtatagggccaggcatggtggctcacgcccgtaatcccagcactttgggaggccgaggcgggtggatcacgaggtcaggagtttgagaccagcctggccagtatagtgaaaccctgtctctactaaaaaatccaaaaaaaaattttgctgggcatggtggcatgtgcctgtagtcccggctacttgggaggctgagggaggagacttgcttgaacccaggaggtggaggttggaatgaaccgagactgcgccattgcactccagcctgggtgacagacaagcctccgtcttaaaaaaacaaataaacaaataaaccctgtatagcaaaagggactttacataagcgattaagttaatggtcttgagatggagggagtatcctggactatacaggtgacccccaaatagaatgagtgttcttggaagagggaggtggaggaagatttggctgcagagagaagaagcgatataatgatagaagcagagattggagtgatgtacttggaagatggagttaagggccacaagccaaggaatacagacagccactggaagctggaaacagcagggaatcgaattctccccagagcctccgcagggaaccagccctgccaacatcttgactttaacctgctaagactgatttcaggctttctgacctccagaactgtcagagaacaaacgtgtgatttcaagccacgtcatttgtagtgaaatgtggtacagaaggaataggaaaactgacacacttctttaaatggcctttcactgggcgcggtggctcacgcctgtaatcccagccctttgggaggccgaggcaggcagataacctgaggtcaggagtctgagaccagcctgaccagcatggtgaaaccccatctctactaaaaatacaaaattagccaggcgtggtggcgcatgcctgtaatcctagctactcaggaggctgaggcaggaaaatcgcttgaacccgggaggcagaggttgtagtgagctgagattgcaccatcgcactccggcctgggcaacaagagtgaaactctgtctcaaaaaataagtaaataaataaataaaataaatggcctttcaactttattccacctctgtaagcctcagtttcctcatgtgtgaaaacggggatagatgggagtcatcatgcctgacgtggcagcctcatcgggtaaacctccttctggtaaggacggtgtacgtgtcctgaaacatgggccttagcccactctgtgacgcatcataaggccaaatttattcatgaaagtagataaagatgaaacaggagagataattatgttttattgaaaatgcttgttgacttgtctttgtttctggcaaagctacaagtgtggagtggaaagtgccttatctgtctggtttatcactctctcctcagtgcatagcagggtgctcagcacgttaagccttctgtaattaattgataactgattaaatgcgtgctctgttgtatttggagatcccaaatcatgaaacatacagaaggccatttgtagagagagattacaggaagggaggccaatgtgaccaccacagtaatcttcatgagagatgatttttcatatctacttaaaatccttcatgttgcacttttctgctcatgccctttcgttctgttctcagagcaagagaacagctgcagattgtcctcaaatagtctcgtctctaccattaatttgttctccagccttctctttccaaacaaaatgacccaaattattttggctttcccttgttcagagtgccgtattgtaatgccctgcagatgttgcaagaggatggcccagaggacaaagtgggcttgcacatgtgttttaagtgaccatgcggacttttttgtttcatgcgaattataaaacatggcaacttgaacacatgagctcatttccatggtctctcaaagtccaccaagatggcaggaaaggaataaaagaaggcgtagttcacaaggactaaggtactggaagaggagaatacagacaagggttgccggcaaatttcaggagtgaaaatacagatgggacgggggaaccgacatcacagatcagcgatcccaccgggcaacaaggcaaggagtgggctgattgactttgctgatcccagacagggctcagccgtgagaggttccaggtattcccaaatgccacatggaatggatccccagccctatgagggggttggtcaatagtttgtataagaaatagttagaacccctacctcttctccagtttatacagccagggagatattcctctttggtccctgcatattgctgcattttttttctttttttttttcttttgtttttggagttttactctcatcacccaggttggagtacagtagtgcgatctcagctcactgcttcctccacctcccgggttcaagcgattctcctgtctcagcctcccaagtagctgggattacaggcgcctgccaccacatccagcaaattttcgtatttttagtagagacaggttttgccatgttggccgggctgatctcaaactcctgacctccggagatccacccacctcggcctcccaaagtgctgggattacaggcatgagccaccgcgcctggcctgctggaggttttctcttggacccacagcatcagcgtggctccggacacacgcacttcattgtgcacagatagggttgcagcagggtgctggagtgaaaccaaggagatgaacagaaggcgtacgccctgacgggggaggcccctcagcccctcctctactcagaagtcagaaggcttgaggccagttttctgtcctccagacaagagattgtatgattcctctttggggaaacagcccagcccaagattgtgataatgatgcttgggatatgccaagtgctcatgtaaagtcgtattaagttattactctcggcttcaacccaccctactggaccctgctctgagatggtggggatgggactctgcatttcagcactgccagtatcttttgggggttttacagatggagcgccatgggaagactgagtccagaggggaagaagagacttgctcctgcctgtctgcttcctgttttttgtaaaaatcagcccagcattgcaacctcacctggttgtgttgttgattctagttgtagtccatcctctccccaaacccagaaccagcactggggcagccccgcctcggaggcctgggtcccagcactgtggggctccaaattctaataatccacactctttctgtgttaccccagccctaggattgcagttgacacttgcagtcgccatttgtgtgacaggtcagcattccccctttgctcttacatttcccatgcctggctagcagctctttatgaaggttccgctagctggggtttcttgactggaccctcactcgtggatgcagtagaagtcagtgagtgacttcatccctctttttttttttgtctgtttgtttttgagacagagtcttgctctgtcgcccaggttggagtgcagtggcgtgttctccgctcactgcaagctccgcctcctgggttcacaccattctcctgcctcagcctcccgagtagctgggactacaggtgcccaccaccacgcccggctaattttttgtatttttagtagagacagggtttcaccgtgctggccaggatggtctcgatctcctgacctcgtgatccgcctgcctcggcctcccaaagtgctgggattacaggcgtgagccaccacgcccggctgacttcatccctctttagtgaaggcctgcagtcaagaagcccacccacacactcaaagctgcccacctacttttaatgcctcactcatccgcattatgaagagtcagtaaacattggaggaaaagctctaataaaaaagtcaggttagttttgacaaaatgaaaaaaaaaataaagaaatggataggaaacagtcaaggcagagaagagcggaaaacgtccaaaaaaaaaaaacctgaaattaatgtcctaagaaagatgaaacagctatttcacccatcaaatatgaacaagatcctacattttttttaaaaaaggcagctttgaaaaacaaggaagagctttaggaaattaaaagcatgagtgttgacatttttaaaaatgggtcaaaaattagaagatgaagtggggcagtttaccatctaggttcttttagatgactttagactcatgagaaataaacacaaacatacatttattgagtgcagttgctgggctaacgtttcccgacttgatattagcccatttattactggtaaaaatccacaaagtcggggcattttacatctgttggattaaacaactaaggctgagggagccctgcctgattttgcagcttctattagcctcatcgcctcgagaaagagaactgtatgccaatcgaggcagcctgccgcaaagtttccaaggggccgtatggggagacagcatcttcattgtctagctaattgaaaaaaggaaggtgctcgaatggaacccagctgatatgaatagtctcaagtgaggactcggtctttcaggcatggacagggccacccagcagctgacgacgttaataaaattgtcaggcagctattagaatagcttaaaattattcaatttttataggtacctaaaaaagccgaacaacacttgtctttgctcataaaatgaacatctgttagctcccggaagactggtacccattgttagtggctggccctttgtatgtcactcagcccaggatgctcataatttagcttgggttttactcccttctttaacatgggccctgcagtagacatgcatatacttgatgtttcttttttctcaattttgtttttacttttctcattccttccactgaaagaccatgaaatcaaacatttggattcaacacgcaccactttgagctgtaacctaccacgtgtcttgctctgtactggccctttggggcactagctcatgctctcagtggccatttcaagtaaacgactaactggacatcatcgatgagcaggttccagggccgttgcgcctaacactacttggcactcacaaaggaatgaacacattcttggtgtatgtataggggaaatggatcttagggctgaattcttgcttgcattctgacaaatcagcacagtctgaatgttacgtcttagaaatgtcaacagaaggacccaagaagcctaaaactttaagcatggatgatgatgataagaataatttgcaagcaagaactatgccacctctcaccctgagttggtgacagccagcctctgttagccttagtttttatatctgtaaagtggggatgaaaatctctgccttagagtgttggtgtctggatcatttgagataatgtatgtgaaatatatggattagtgtctggcacagagttggggttcaggaaatggctgttctttagtctcccccttgtcagggcttgcacatctagagatttccctgctgcaggtacagacccaacctagatcctgtggggacagaaacaagtataaaacagaacatttttcctcaagaagctttctgtatcacacgtagcctccaaaaatttctcaaaggtggttagaacaggtgttttaggtggggaggaaataaaacgttaaaagaaattctgaagcccaagatttctttgtacaaggaaacaaaagttgggagagattattagagttagcaagtggtgggaatgaaataagggatagatttggtcctcttcatccctgttctattcatccatttatttagcaagtgttaattaaatgctcactctgtgctaggcacatcagagtggtgcaccactacggcatctaagttgattgcaaaaatgtactaaaacagctttctagatcatctaggcactcctgaggcttcaggcgcctccttgcaatccccaccttgcaggcatgcagtgtctgttgcatggaaccattggaaggaagctcacccggcaagataatcttctcttgttccgggcagcctgagcaaaccttgcatcctaaaccattctttctaacttcctctcccttctttgagtttggtccttgagaccctacagctgaggctgattggttgtactgtgacagtccttcaggtaattgaagtctactatcagagcctcctgggcggtttccctcctccatgctgcatttctccaggtgaaggattccaagttcatcaggatctttgtcttaagacagcagcacacaattacaaaagcagcatcggtgcaacatattcatgtttccttgtgccattttctagctgtgtgatcttcagtcagtaaattaatctgcattaggcttctcaaaaggaagtgtggaggtcacagtggtgtccacatccaggtagttggagagataattgatataattcaaaagaatgctggccaggcacggtggctcatgcctgtaatcccagcactttgggaggccgaggcgggtggatcacctgaggttaggagttcgagaccagcctggccaacgtggtgaaaccctgtctctactaaaaatacaaaaattagctgggcatggtggcgggcacctgtaatcccagctattcgggaggctgaggcaggagaatcacttgaacccaggaggaggaggttgcagtgagccgagatcgcgccattgcactccagcctgggcaacaagagcaaaactccatctcaaaaaaacaaaacaaaacaagaatgctgcacatggagtaggtgatccagtttgtctataagtatagtactactggcttgatgttgtcaggtgtcaggttatggatggagaggccaaagtacaattagggcaagtcagtcaccaagactctcacatctgttagtgtgaagatgaggagtgagaccagatatcagtgccctgtccacattgaatgactgggtagagagtcaagctctgcaattcctgagtctctggtgtgtactctatggtacttaatggccagtcaataagatactgttcttttagtagcaaagaaaatgactagataaccaaataattacatcggagtccagggtgcatcatgtaggctgctatttctcaaatttgaatctgcatgacagttcatcacacagggagcttttagatcctggtcctcatccctggagactcaggctctgcagggactgtgtgataggccttgtacttgtgaagctgatgcatgatcctcatgggacatggtcctcagagcgcaactatgcctagcttctaaatgcctaggtgagctgaatcttgtaaggccagagaaaacaagagtgcttaaaggagaaggacgttttctgcctagttgttttgttttcgttttaacttaccaggaaaatataaaaacagtatcattaggagacttatctgatggctaaaaaaaaaaaaaaaaaagcctcagcaagagtctttccaataggcaatggtgtttgctagctttcagtgagttttcttaacgtttccaaattctgggccagatgttatttatataatctcagttaggagagcttttggctgcaagtaactgtgctgtaagccataaggaggtagagagtgtttccaaggcccctgattctttccatcctttttccattcttagcacattggatttttatcttcatgctttccacttcatagttgcaagatggctgccatagctccaggtgtcttgtcttcagagtcccaaacaggaagcaagagcaaagctaaaatcccttcttcccagaagtctgcctttttatttaggataggaacctccaaagcagacttctctttacatctgatagtttagaaattagttataagctgaaccctagaccctatcgctgctagtagggaaggggattaccatgtctggtttatagagattatgagttattccctgaggataggaagaggcccacctttcctgaaatcagcagtctcccgctgctgccaaaacacaaacacatggttctgttagctggtgagaaggaggaagatggttgggtagatattaatagcagtgagaatccctcatgaagctcagaaaggagaaataatcttccgagaacacacagccagcaaagacagagtcagttgtcaaatttgggtttgcctttgaagcccgtgtgcttcctattttaccatcctgcatcttagaacatgcagccttctcatcaaccagagatgctatctgttccagcaaacctcagaaaaagatccgatcccctgccttcgtttcacagatgggaaaataatggccagcatgggggaagtgattcacctaagttcactggcctatttggcaggctgtgagcctcgtcatctttccttttggcatttagtactttctgacccggttaatagctaggcacgttggggctgcttttgtcttgtgtatactttattgtctgctatcattttttgctttagcatccccattggtaagtgctcttgcatggattcccagtaggtaatggggcaaccacagtaaattaggaaggtaattcgagctgtagcatttgatgcaccccagtcacaactatgttgtgctggttcaacctgagggacacatgagcaggagggaggatagagagctcagggcttgggctgccaaggcaaggggccatcatggtcctcaaaggcgatgagccagggattagagagggctcaccatttctactcctgaaaaaaaagcaagataagctttaaagtcccttcccaattctttatagagtttcctttggctaaggcataagctgataggaaagatactgaggaaggacaaaagagagaataattagaggaaaaaaagtgctattccacgtgtagggagtgagataagggaagtggtgagttgatgagtttctctcctataaaagatgaggctgatgacatgaactgtctttcaggcttgttctaagaagagatgactccatacgtgcaaaatgcatagaacaatgcctggcgtatagtagacactcaataaatgttaagtactaagaaataaaaataaaatcctaagctccctaacaaatcagaccatctcttggtcaaggagaccccagagtaaccttgacaactaagttgtcggccgtgatgggttgggggtgtcagtgtcaaacatacctcgttatgccccctccctcgctaaccaccgttaggctttcttctgcaagggattgacaaaaaccagccctctcaagagactgatatctactaacctgctgatgctgcccctcctttttcacctgatcagagatcacccaacacagagtggttctggccagtctatggagaatgtgcaataagagtttttgtgtcctttgcttcaccttttgacatcagaggatcaaaacctccacccttggataatgctaactctgccattttttgttcatgagacacatgaagggccatgaagctcagttgctcatgggcacgtgtctccttttataaatattcatgactcctcctatagcttattgaatatgtatatttggtcaccctgatcagcataaatttctgtttcctttttccctctggtgaagtgtctgtttctggtttctgacggagtctacagtccccagcctgttagaatagccaccatgcaggctgcgaccctttatgagaaataaatctctcctttccaaatttatgaacttcatcattctttagctgacactactgtattatccttaatattggacattttgtgagattttaccccgccccgccccccccgacctctgccagaacccacagtttgaagaacaaagtgggtatgtctactctgtacaaggatctgttgctagaatattttactcatatgggtttttttctcgtttaatctttccagcagcctgagagatcaatattaatattctgatgttacagagcagaaaatctgggggaccctgaaagattaagatctgttcaagtccaaaaagacattggcaccaaagttgttctgcttttccatgcaggaactccacctctgcctacagccagctgagtcctgctctaggagcagatgtggtttgtcatttgggaaccactgtttacacctcctccactgtctcctgggccctttctccccctcccttctttccttttgttattatggtttgttctggtcaaggggccagtcactttctctttgtgctgtcaccttcctttaatgggttccacatctgggcagatgattctaccttccctctaaagagggtgtagaggagccagagaacctcagactctgggtggggtgggtgtcacaccgatgcaggagcatgtcaaggagaaagacagcaagagggattaaagttggcactcatctttgagagagcctctgaactgattgccatccgagtgccacccaccaatgaaaggccgttcagaatttctgtcccctgggaacataaatccgatcgccttggctctgtgtctccactgcatcatctcactggccctttgagctccttccacgtggtaatgccgttatctttgtacgtgaaccacctgcctcagaaccatttggagtacgcttgggaaaacagagttccaaatctagctcatccgacctataggggtttttatccttggaattcgcttcttttttgagacggagttttgctcttgttgcccaggccggagtgcaatggtgcgatctcggctcactgcaacctctgcctcccatgttgaagtgattctcctgcctcagccgcccgagtagctgggattagaggcatgcgccaccatgcctggctaattttgtatttttagtaaagatgggatttctccatgtaggtcaggctggtctcgaactcctgacctcaggtgatccacccgcctcggcctctcaaagtgctgcgattacaggcgtgtgccactgcacccagccggaatttccatttttaagcaactcccgtggtaacgcaggtgctgtcttcaggccatgctttgagaaatgctgtagtcaactgtgagctgcaggggagcatgtctgtgactctctctttgtattcacaaccccttgccttgtgtatttttttaatcaaatggtggattaattgagtatttgattaattagtgtacaaagagaacagaaggaagtccgggaaatggaaagttttagtttctcaagagtaaaggaaaacagaataaatcaaagttaccctggaagatcagaacagcctttgcagttgatggacttgtgttctgtgttctctctctgaactcttcccagcgcctgtccagcgtaggctctctgctgagccatgtgagagcacacggatactgcactctctgaatcttgtacactacagaagtttcattacaagcaaaacccttagtccaggcacctagctgaaatgtgaacaggtgcccattctaggattcttcatctgataaatgcctgcaaaggctccaagtccagcattgaatactgccttttctctgaagcctcttctctcccctcaagccacgtaaggtccatctctcttttctttaagtgtcatctgtggcgaaaacaggcctctttaagtctctggcattgtacctatttgttcacttgtgtgtttccttcattagactagaaactcttaagacaggctctccactaatcctctgtagaattttttttcatataaatatagtttttttctcttataaatacagtcgtaaaacattgctatcttttgtagcttctttcaacctaacataatgttttcaaggttagtccatattgtagcatatgtctgtagcacattttttatggccgcattatactccgctttatggatatataccacatttgtaatgctttcatcagttgatagatacttgggcagttttcactttttgactaccatgagtaatgttgctatgaatatttctgtacatagtttgtgtggacatacattttcagttctcttgagtatattcctaggaatggggctgccgggtaatatgttgactccatgtttaacatttcgaggaattgccaaaccattttccaaatggctgcaccatttgcaaggctgtattttacaagtagctgttcatatgctaagaataccaatccgctgtgtcttcactgaatgccagctaaccagacaggtgaaacacaggtgatgaatttggagtcaagacctgcagaagcttcccgtccccgtagcctctctgagcactcattcagaaataatgagtggatccagtatgctgggggggaaacataggggacccaggacttacgggtcacctaggaacagatgaagttgtttaaccatgagctaaaggcaggatggtatttaatagatacattttcatatctgggacctgcatcttgattatagatcaaatatcacttgcatttgtttttctttactctcagtgacatgcaacagaagacaggctttatttgagaggctgtttcatgcagctttcagcttgtttcagtctctttgtctaccttgcccagtagtcacaaccaagattctgaatacctccaatttcttcttggagatcatacttcttatgctgcaaatcaaggcagtactatgggcctggggtggtagtggaatttgcagcggaagcagtttcattgaagacatattttctttgagcctcaatcttgaaggattaagctgagcatattactgtcagaaggtcaagggaccctctgttctctgtggcagacctgcagaatggagtcaggtttcattctcttcctccttcctccgtgccctaattatcacttgacttgagtaagccatgagttccatcttgatgacatcaacacattgcctgatggaaagatgctaaacaaaagattaaacatttacaccttcctaaaccagaagacctgtgtgctaaagaaatagtagtaagccatctcagtgtttggcaaccttattggatttcagacaattctctggaatctctcttgcctggtttctttaccaaaacaaactacttttgccatctggagattaattcagtagataaacatgggacagaaaggaccttctttgcagtactttttcccagtgggctgtactttgcttatagcttctgtgggacttagttttttttgtttggtttggttttgctttttttttttttttagctttacctagaaagttttggcagatcagccaaccaggaagagtgacgtggttttctcacaccctgggggagacttgttccactttctcacactcatgttggagtgggaaaagagggcttactccaaaccctccaggaggaaaatcattgtctggtaccagatgtaatttcagaaaagggtgggttggagcgaatgggagagcatgggaaagtgatgaggggtgagacgttatgtggccccaggattgagttggacatttcttttgctcaagtaaacaaattatgcatctgatcctgtactaagaaacttattagagaagattttataagatgacaagagggtaaattagaaaatagattagaaaggtgataatattggtgagtgccaggagttagagatgtggggagcctggcaaggaaatgggcttgattttattattattattatttttttttttttgaggggagtctcactctgttgcccaggctggagtgcaatggcgcaatctcagctcactgcaacctctgcctcctgggttcaagcagttctcctgcctcagcctcctgagtagctgggattataggtgtgtgccaccacgccctgctaatttttgtatttttagtagagacagggtttcaccgtgtcagtcaggctgatcttgaactcctgacctcatgatccgcccgcctcagcattctaaagtgctgggattacagtcgtgaaccaccacacccggctgggcttgatttttatagaggtgtagatttaaggagattttagtgatgatggcacagttctctgttttgattgccatgatggtttcttgaacacatacgataaaatggcatagaactatacacacatattgtacccatgacagtttcttcatttggatattgtactagttatctaagataccaacattggcagaaactgagtgatggatacacagaacctctctgtacgttttttgcaatttcatatgcatctattgttatttcaaaataaagttatttttaaaacctagaatgaggacaggaaatagtaacacaaatagaaaaaaaaaaaagaaatgatatgatggacaatgcagataatggcatagcattaagcaggtgtaacctctactgggctcctgacaaatggtgacatttaaaacagggcaaccacactgcatctaatgtggtggccttcattaagattttccaagaggaaaatgtttgcgattcatgtcacagacaataggctaatctcaaaattagatacaaagaacccctagaaattagtattttaaaagacaagtaaccatgggtacagagtatcaacacacagttcacagaggaggaaatgcaggttgttggtttttaaccacagaaagagaagcaacttctgcctcgcaaaaataaaaagaaaggaatgcaaataaaaacaatagtgagggctgggcagggtgtctcacgcctttgggaggtcaaggagcactttgggaggtcaaggtgggcggatcacctgaagtcaggagttcgagaccagcctgaccaacatggtgaaaccccgtctctactaaaaatacaaaattatctgggtgtgctggcacacacctgtagtcccagctactcgggaggctgaggcaggagaattgcttgaacccaggaggcagaggttgcagtgagccgagatcgcgccattgaactccagtctgggcaacaagagtgaaactccatttcaaaaacaaaacaaaacaaaacaaacaaaaacagtcacccaagctgaagtacagtgatgcagtcttggctcaccgcagcctctacctcccgggctcaagccatcctcccacctcagactcccaagtaactgagactacaggtgtgtgtcaccatgcctggctaatttttgtttcttttttttttttcttttttttagatagagtcttgctgttgaccaggctggagtgaagtggtgcaatctcggcccactgcaacctccacctcttgggttcaagcgattctcttgcctcagcctcccaagtagctaggattgcaggtgcatgccaccacgcccagctaatttttgtatttttagtacagatggggtttcaccatgttggccaggctggtcttgagctcctgacctcatgatccacccaccttggcctcccaaagtgctgggattataggcatcagccaccgcacctggccttttttgtattttttttagagacaaagtctccctatgttgcccaggctgctttggaactcctgagcttaagcaatccacccgcctccacctccacctcccacagtgctgggattacaggcatgcaccagagataccatttattaactctcagattactgaaaatctgtaagtttggtaacacattctgttggtgatgctggtgggagtgcaaatgagcacatcccctgtgaactgcctttcagcaacgtctacaaaatgcctgtgacagaggtggctaactcttcaccaaaaatttgtcttgctcttcctcagtaatacagttacagctggcaagtagctcagcagctaagggcttgatatagtttggatgtttatcacctccaaatctcatgttgaaatgtgatcctcagtgtttcaggtagggcctgatgggaggtgtttgggtcaagggagcggatccctcatgaatggcttagtgccatccccgtggtaatgagtgacttcttgctccgagttcacatgagagctagttgtttaaagaagctggcacctgccctttctctctcccgctcctgttcttgccatgtgacttgcctgttctccctttgccttctgccgtgattggaagcttcctgaggccctcaccagaaatagatgcaggcgctatgctttgtatatagtctgcaaagctatgagccaaaataaacctcttttctttataaattacccattctcaggtattcctttatagcagtgtgaatggactaacacagagctacacctctcagcttcccttgcagacattgctagtactctgcattagaatgtgagtagaaaaaacgtggtgtatgtatatgtgtttgcaaaaaatggccacaagtttttcccctgcctacatcggttactttcaccaagactgtgtagctcctcccattaagaggaggcatctatgtccacttcctgaatctgggccggtcttgtcgtttgttttgaccaatgtaatggtatgagcatgacacaagcagagacctgaaaagtacttgagcactggggctccccctgccactctgggagcctgtctgccctgttgtgaacaaacccgggctagcctgttggaggatgagagcccatgtggagagaggccccatcatctgagctatcctatgctagcaggtaaggccaccctatagtagccagcccagctgatccaacagctgtacttatggctgcagaggcatgagcaccgtagcccaaaccagaacagcccagctgtgtcaggccagcttgcctacttgcattttaagccactacatgtgaggattacttgttacacagcaatgctgactgatacagtgtgctacttcttggagaaactttttaagaaccacgtatttcttcactgtgttctctttttactgtcctatagtcattcctgaaataacccatagttcccagccagtgggacatctcattttgcaaccaggcaacagtgccaaaatacactcatccaggctcctctttggcaagcgctggggactgaaaatcagtgccctggcctcaaggagctcacctgccagcaaagacagacacatgtaaacaacacaatcaaattactacttatttttattactaatagatacattgatttcaggtgctgatcagtgcaatgaaaatacagctggaagcttgttatgccttaaggaagtgagcttttgggaatcagttcacggagccactccacgctttctttttacattgaaggaagagaggcccacacagaagtcccaaaacagcagctcgtgttttgcacggaatcccatgaatttctgtcagatcatgtctcatagagcattactaaaaccaggacagaaagacgcagaacacttccgggagtcaggcagagcagactgggattaggattcagatgtgaacagaaagcagctgcaagctgatgtggctcagctcaatgcccaggtgggcagtgggggcaggtgttggtggggaagtgagttagagatggcccagctcagcactgctgtgttctgcagagagttcagagtcccctcccgtgcttgtcagagagcagaagcttgctgtctccctgcgggattgtgggatttggagaacagccacccccatgaatctcaggtacaggatggtttaagaagcactgaggccagacacagtggctcttgcctgtaatcctagcgctttgggaggctgaggtgcaaggattgatttagcccagggtttcaaaaccagcctgggcaacatagtgagaccccccatcagtacagaaaataaaaaattagccaggcatggtggcacacgtctgtagtccccatttcaggaggctgagcgatacaaaaagtagaaaattagccaggcgtggcagcacaggcctgtagccccagctgcttgggaggctgaagagggaggattgcttgagctcaggagatccaggctgcagtgagctctgatcacaccaccgcactccagcctgggtgacagagtgagaccctgactccaaaaaaaaaaaaaaaaaaaaaaagagaaaaaccactgaaacagatagacgaacagtctcttagcctctcagcaagaggaagccagggagtacaaacttcttaatcctaaggaaaagaaaatgctacttaaactaaatatcaagaagagacaaattcccctgtgcttaagaacacgacttggaaatgttctctttttacccagcgtcataaacagaatgtgggctggtgatgtggccatgtagatcagcctctcaaagaatgaattgttttctttctcttttttttccttgtttttcacttctaaaatactatgtttcctcttttggttaaatgacagacttgcttttaagaagagcagtcaaggatgtaaaaatagtgatttcaaagaaagctgggagagaatcatcatttacgtgtttttgttttttcaatttgggaataaactcccagtgtgggtggggagtgtctggagcctgagagggaacctgggtgtcttcgggagccagtgcaggggctggtactttattttatggggacctgtggcctgagatgcgttttagaggtaacagtgcccccttctggtgcaaatgaataaagagttgaggtttctgtaagtataatttagatatccccgtggcagagtggagcttttaaactcattgtctctggggcagaaattatgccttggctgttcctccctccaaccccagggagcccccctgggtctcctttgaggcatgctcctctctgaggcatatgtgaccacacacacacacacacacacacgcgcgcgcacgcacgcagctcagggacctgcagaattgccagagatcattgcagtgagtcaggattcctctgtcttgacttggatcttcattcttcagcttgagcatatccatgagatttttttttaatctgcagaaagccagagtgctctgtggaatcaagctgcctgtgaaagtgtttcttttcttttcttttgcctaaaacaaattccaactagctgtcttgttttaggtaagttccaactagctgacttccatctggtcagctagttgtacagtcatatgtgtacacatccaggggcagaaacatctaggatgttggtccctggatgtgcgggtccctggatatatgtacacatgaccgtctcttttgatgtatgtcaggatgtgatcagaattaacacttaaacccccacggtcagtaccacacccctttctctgccccactccagtcccctcagggggtgcagttacacttccactcctgtcctagtgaattctccttggcctggtgacctgggagggcctcattggagaacaagaatattggacactatcatgatcaacactaggggagaagggcccagactccagagccagtcagcctgggttcaaatcctgtgcctgaggccgggcgcggtgggtcgtgcctgtgatcccaaccttttgggaggccgaggccagcgcaacacctgaggtcaggagttcgagatcagcctggccaacatggtgaaactccatctctgctaaaaatacaaaaattagccaggcatggtggcatgtgcctttattcaggaggctgaggcatgagaattgcctgaacctgggaggcggaggttgcagtgagctgagatggtgtcactgcactccagcctaggcgacagagtgagagtgtctcaaaacaaaaacaaatcctgtgtctgccatttgctggcgtgtgaccttgggctgttgatttaacctgtttgggattcaattttctcacatagggatgatgatcacaatatgtaattcctgggatttgtgtgacacacagatgagttcctctatgccacgtatttagagcagcgctcagcataaaggacttcatgcacattaaccattattctagcttcttggcttaaggtatgaagttgccagatcttctcagctgtatgatttcctcaagtcaaatcctggttcccattgccttgagaagagagggtgcctcagatcccagaaaaatctgtaggagttggagtgatctaacgacagcaaggagagtgaatttggggcatcacccagttctccttataatcttcaggccagtcctgctcactgctgtctgactttgtagcctgatttttccagatgaagctgctcttgttgacccaggtctcccccttcttctttaaggtatattgtatctgtgggatacagacatagtgcaggactgaggccatgcattctccttcctaagagcttcttactccgggtctgtgggtagattccagggattctcagactctctcagaagttgtatacaaaattctctgggcggcccggcacagtggctcacgcctgtaatcccagcactgtgggaggctgaggcaggcggatcacaagtcaggagttcgagaccatcctggcccatatggtgaaaccccatctctactaaaaatacaaaattagccgggcgggtgctaatatttgctaatattggtggcaggtgcctgtattcccagctattcgggaggctgaggcaggagaatcgcgcttgaacccagtgagccaagattgcaccactgcactccagcctgggcaacagagcgagactgtctcaaaaaaagaattctttgtgcattatatgtatgtttttgtagctctactccaccgagttcagccctttttattggacaactttcctagaggttagagtgcgtctttagtacttgttgggtgatgatgggacagagaggggtgtggaggggttgagggatataagtttgtagccactttccaatttttcatcctatcgtagcttctcttagtaatccagagttagctttctagtggctcaggtgtatagctctggaatcatcagttaatacgtattcacagttaaggggaatttgtagggaaaaaaatgccacatgctgcttcccagagctgaggattttcatcagctcttctgaattattcacactcctcgtcccttttttaatgtagataacaaagagttggtagcaatataagagtgcgtgtttgccttttaaggctatagtcaacatataaaaagaaaatgatgtgttcccttgagtacttactactgtctagtaaacaggggacagaggtgcttaaataggaggaagtgggctgggcatggtggctcacgcctgtaatcacagcactttgggaggccgaggtgggcgcatcacaaggtcaagagatcgagaccatcctggccaacatggtgagaccccatctctactaaaaataaattagccaggcgtggtggcgcctgcttgtagtcccagctacttgggaggctgaggcaggagaatcgcttgaacccggaaggcggaagtttgcagtgagcggagatggcaccactgcactccagcctgatggcagaaggagactgtctcaaaaataataataataataataataggaggaagttggggaggcttccaccccatcatcttggtctgtcctcagtggtctgatgggatgcaggaccagctgtataatttgtgaggcctggtgcaaaatgaaaggtggggcttcctttttttaaagaaatgtgttaggagtttcaaaatggtgatagcaagccattaaaccaagcacagggtcttcgtcagcacaaggccctttagatcctgtgtccctaaagctggccctggtgagacatagggatgtgggcctctccccacatcctcacactatttcagcccgctggatgtcttgcctgccttcgtcacaccaggcacacatctgccttgcctgctttgtgcttactgtttccccgcctttaagcctctctccccagatagccctagccctcgctccttcatttcctgcaggtttctgcccagagctcaccttagcagaggggcctccgccatcagtcttctctcaaacagcatccctcacaccctccctgcatcctctgcaacaaactctcagctttcactatggatttatctgtctatcattgattgctcttctcacgctggtgaagcgcaggctcttagagggcctggacacggtggcgttgctcactcccggactctgtgaagctggcaaggtgccaggctggtgctgtgtgtgtggaatacacaggtgggagtgttctttgctaactggggaaggcaagccaaagggtgagaggccaaggggagggtgaggggtgactctggactcgtcacctctcatcctgatcttgtcaggcaggagcaccttcttcctgccagtgttcatcattctggaagccttttgtaagatccagggcgctgaccagggaactttccatgcaccaccttttgggcagattaagtccggggactactgcctcccctgcctgggttcttcagtgtataaaatgagggggtttctggggtagcttttctggctgttttctcgttgaatgtgttgttgatgagtccagagttcttgtttagctccagtgttctgggaaagatcgtcctggctgtctattttctgctccctgtgaaaatgagttcattcattcaacaaacacataccaagtgccaatcatgtgtcaggtacgctaacaggccctcagaatacagcagcaacaaacagcaagcagaccctccggagtttaccttttcatggatgtgatgtctgcagggatgaacagtttgtcatggatagatttgctgctctctttctaggtctctgtgcatcaatttgcactggaaaagccacttgcaatgctgtaaaagaaggagtatttggagcgaaagtctagggaccttcattaaaatctaggtttctgggcctcagcaccaacaagtgtggctttggggtcaagagcttgcggtctggaatcacatcatgcagcattcattcttttttgttgttttttattttttattttttttttttttagctacacctgctgaaatgggaggggttcattcttggctctactgttttctgagaacttgaacaaataaactgctcgatatcaatttgtttttattttcaatagcaaaataaagataggaacattacgtgcctgcgaggagatcctttacctaaagcgcttagcacagtgcctggttcatgctgttcacacagtgctgtgtgttcatgttattgacagcctcagtgacagcctcagtgagcttaggtcactatctttgggccttggctgtccccttctatcaaatgaagtgattgtttcacccctttataggtccgtgtttctgactcactttaataggactgaaactcgtgattgtctctcctccacgtgtagactagccgactaaaagaaggctatatgatatatatatacacgtagttgtcccttcatatccgtaggggcctggttccaggaaccccgtggataccaaaatgtagcaatgctcaagttccttatattaaatggggttgtatttacatacaatctatgcacatctcctgcatactttaaatcatctctaaattacttataatacctagcaccatgtaaatagttattatactgtatgaatttttaaattttgtgttactttcgtttatttttattttcattgttttttcttagaatatttttgatccacatttggatgaagtcgcaaatgtagaacctggagatacagagggctggcagtatacacctgtgatacatatgtgtgtgcatatgtctatgaatatatatatacacacatatgcaggcataactgtgcatcatcgtgtgtgtgtgtgtgtgtgtgtggacacacatagactagccgactgaaagaaagctatgtgagatgtatacacacacagtcatccctcagtatccacaggggactggttcacataaacatatatgcagtctgtgacacttaatgatggggatatgttctgggaaatgcatcattaggtgattgcatcattgtgcaaacatcactgagtgtacttatacaaacatagattctatagcttcccacacatctaggctatatggtatagcctgttgcttctaggctacagcctgggcagcatgtcactatactgaatactgtaggcagttgtaacaaaatggtaagtatttgtgtatctcaacatagaaaagggacagtaaaaatgcaacgtcataatcttatgggaccacaacactatactgtctgttgttgaccaaaacatcattatgtggcacatgactcgtgtgtgtgtgtgtgtgtgtgtgtgtgtgtgtgtacatcagctcttaagtctctagagctttctgtatctggcattgcagtctctcagccagcattccaatccctgagagatgctgctttttcacatgtgggagcgttccgggattagaaaaatgaactcttgtctcttccaactcaagggttctatcagtcctgttgcaatccagacagattttacttaatttcctctcttgcatgtgtttgttttgcttgtgtattgaagagagttgcatctcgctgcctcctggatctgcttatcagcatttttttcaggcagagtgtgttcttgcttctgctggtctccatcattctggataccatttgtaagattcaggaccctggccatataacagtctggaacaggaaccaaaaagtgtttgagttgctgtatgctcaataatgcactgatttcacaaggtttagcccatttagctcacagaggaatctcagccaaagtttagacttgggcagcttttcttattaccttgaaattagtctcgattacccttaaattactgaagattgaccaccatgcaaagtggtttctcctttcattaatcttactaactggctgcattgttacaaatcttttttcctagccagcacaagattccttttctgcaaaagggcttctcccgcggtgcctttcttttacattcctcacttctagtggtttgattaatggtcacaccagtacacatcctgacagccgtgcttccacttgtgtctcaccagcaaaaccatctgggtggaaggtttgcatctctgggatcctcaggcattaggcacctccttttgcataaacctgggttggagtgatgtcacacatctggctcaggcatttaaaaaacaatttaaaaaaaacagtgaatgtgtttgcttattatagagtacattgtgagcatcacagggtatgttgaagacaagagaaaattaggggaaaagagaagaatcatacatctcctactacctgaagatcaccattattttaattatttatttttgagatggagtttcactgttgtcacctaggctggagtgtagtggtgtaatctctgctcactgcaacttccgccttccaggtttaagtgattatcctgcctcagcctcccgagtagctgggattacaggcgcctgccaccactcccggctaaatttttgtattttagtagagatggggttttgccatgttggccaggctggtctcgaactcctgacctcaggtgatcttcctgcctcggcctcccaaagtgctgggattacaggcgtgagccactgcgcctggcccaccattatttgattagttacttgcaatctacttttctgtatatttttaaagactgttgttttcctcctatatgtaattctgacttctgccttttattttcacttaatattatcgatctttgtaactgtcactttcattgactgggtaatgttccatctagtgataaatcataattttttaaaagacattctcctattttgggccagttaggatgtttctggtattttgaagatttaattaaagactgttgaatttctttggcatacaacattccctatttcagattcatttttaatataaattagcatagtatgattcctgggtcaaaggatttgaattctcttaatctacaatatcagtttccttcctaagaggcaagtgtctctttatactgcaaccagaatgtcagagagagccctgtcagaggtaaatttaatattttagctcataatgaagttctatgacattaattttttacaggacttttttaagaacaaggaaaaaaatcatggctttacaaaaaacaactgtatggtcaacctacaagtaaacagttccctttcctgggcctcaggtacaataaagagatgagacaagaagatatgctacagtcccatccacttgtaggggagttagccattgcagttagacagtttgacaaaagccatctctggctgtggaatcaaaggaggaaaggctgggtactaagtagaaaaatgacatttcgtttcgtggaaaacaagcaaccttgacataactcagatttgtcttacaaggatggaatgagcagaacttgccttgccagagacgcagttcacaatggaggtagtcagagataagaagacagactagggccatgcagagctgaatgcattccttctaccaagtccttttccagggtaaagctctccatccctgtcatagggtctgcaaacatcacagctgctggggtagaggaagggtccattctctagactggatcatgagatcagtcccactggttgtacttcttaggtcacctaaaatccatggaatatttgggaactatgattacagagctagacgtgccctggaatttatcatgcaaagctgaatcccccctcactctgagtaacaacacagaaaacctctttaaatgccagggaaatatcacccttgttgtctgtatcagagactaaaagtattcttaatagtttaaagggtactcaataaatattaccacatggggtattaagcttccagattaccccacctcaaggcatacagcagtacacacacaggtacaactcatgtggctggcatcagcaacataaagaaatagcagcagtaaaagctgcgtgtgaagatacctgagtacagctgccacatgtggaaacatctgtccaaatgggaggaaagtctggctgcccccgtttggtctcatcagtcatttaatggcccatcagtaaaacaggaagaaaatcactatgtgtgtgatggattgcccgacaatacagaactgtatcggcacccgccaccttgaattgggttcatttgtatatatgcttgccttctctcaagaacagggaccatttgccagtcattggagagcctggggcatgtagcacggacttcagaaccaaaagctaagccaggctgggtgtggtagctcacgcctgtaatcccagcactttgggcggccaaggtgggcggattgcttgagttcaggagttcaagaccagcctgggcaacatagtgaaactctgtctcaacaacaacaacaaagaaatacaaaaaattagccaggcacggtggcatgcacctgtagtcacagctactcaggaggctgaggtgagaggatcatttgagcctgcgaggccaaggttgcagtgagccaagattgcatcattgcaccccagcctaccctcctggagttagatcctgtctcaaaaacaaaacagaaaacaccaaaccagtttttagcctctgtggactttggtattttcttatcagtgaaatgtgggctatacacacttaccagcggaggtgatagagtatagcagtcattagcacatcctctggagacaggcagcctgggttccaattttacctccactttttactagcacggagacacaagccaattgttagaggtctcctctctatggctgaatttcctcatctgtaaagttcctaactcatatagttattgattaaatcagtaaatatgtataaaatgcttagaggagacttgggacctagtaggcatgttattcgaatttgctgtcatcaccactacccccttacaaggtggctgcagggattaagacttgcatgtttagactgcttcgtgcatggtcggtgcctaataaatgtagttactattattgtgtttacatccctaactcccagtacattgcttgcttatggtagtttattaagtagaataatgagctcatttctcaggtttattctctaatctgttaggtaggtgctggaatattgatttggttttattattgtactcacacattcttgttctttaggtttcaaatgtagatcaaagcaaggtcagagatgagggctcacaggggagcggcgagactttttcccaaatgcaaaattgtcataggttggtgaagcccaggtaaacatgcaccgctcacttttccttcactctctgcgattcatttctgtctaaatgaaagcagacgagagagattttaaattgcccagttaggtttgggcaaaacacagatcatttataaaaacacagaacatttataaaatcttggacgcaatggcacacacttgtaatcccagcactttcagaggccaaggtgggaggatcacttgaggccaggagtttgagaccagattgggcagtatagcaagaccctatctgtaccaaaaaatttaaaaattagctgggtatggtggcatgcacctgtagtctgggctacttgggaggctggggtgggaggatcacttgagcccagggctttaagattacagtgaggtatgattgtgctttgctctccaggctgggtgacagagcaagaccctgtctcttaaaaaaaaaataaaaatccctctttccatagaggactctattaaacatgacaccatttcatccttgcaatggaatgtgtgcttgggacctccaagacaattgtttttgttgcactgcctccattttgcagatgagacagatgagatggggagagggtcttggatcaggttgaaggagagtattgatgaggccagtggttctcaacaggtggccctgggaccagcagcatcagcctcacttgggaacttgctggtattcaaagtcttggggtgcaccccaggcatactaaatcagtaaccctaggggtggggccctcagtgattataatgcgtgggaaagtttgaaacccactgggttaggcggatcattttaggcaggtgatgtcttttggaaggacagcctaaggcctgatatacctgttcttttcctcactccccaagcaaatatatacctgtgaccacacaatcagagcggtaaattgaagccaattagcagctaagtaactgccagcacttgtcaccagggtagttgttagtaattagcactaatgactctagagaggaaaacagttgtggttcaaagacatccccaccatttgaattcactctgggttttttcccacacttccctgccatattttccttttgcatgcaaacaccatcgcagttggatggatgcttctcgggagacaaatgtcacgtgaagtaataatatgcgatgagtttttaatgcttgccaggatgagattgttctgttggggtatatattaaagttgccaatcaaccttttggatacacctgcataattctgataggatgtcatggatgtacgttgtaactttctccaggaagcaaaaagtgatttataagcatgacaaattgttgaatgagatcaccacatgacagttctctgcatttggtgagagtgtcgcgagaaagaagagaaaccaaggaaagagaattttcacatagagagtcaaatatgtacactttagtgttgagttaccaaatgtaggttttagaaaacccttttaagaaaatggtaagggtgtaattaacatgaccctcttacctggttacccatgagtatagtgtgcattggaagaggagaaaggctgcctttgatccatgtgctccttgaagttggcagtgattgtgttttactcgttcccagtgccctgcagtggcccctgtgccttgcccagggtgacacccaccagtagagtcttcagaatgtcagattaaattgagcagggtgggatctagcaccacctggttttggctatgtgaaattctgttgttcggtgtagattctgtgtgctccactgtgatcaaagctcatctctgtgaaagtttttgaggctggcagatgtttagttgtgcaaggtcttgttaattaggagagggagcacattatcaaagggaagtgtggctgtttctgttctgtctcttttcttccttcaacccaaaggtataaaattagggaagttagtcagaaacgcaaggaggaggtaggaattgtgggatttaaaggtccccctcttccagaaggtgattgctgttaaaagatgctagattgtttgtaaagtgtgaatcctcaacagtccccctaggtatgtaattctggtaccacaccagtgtagagcaagctggagttcctaaacttccatagatgagaagagggtggtcatgaatgtgtgtcttccaccagaacaccgtgcttcagaaacattattatggtgaaatatacctaacaaaattttaccattgtaaccattttaaagtacatagttcagtggcattaagtgcattcacgttgtggtacaaccatcgccaccatccatctccagaactttttcatcatcctgaactgaagctttatacctattaatatatataataactgtacattctcccctcccccagcttctggtagccaccagtctcctttctgtctcaatgaatttgaatattctaggtatcccatataagtggagtcatatgatgtttgcgggtttttttttagtgtatgtctggtttatttcacttagcatgatatcttcaagtttgatccattttgtagcatgtatgagaatttccttctcctgggcatacacttcaggactgtcagcatccttagctctgcactcagagcccctctctaggattaactcccagcaccagatgcccattcagacaaccttgtttcatttgcacctttctgaagcaaacagcatacctgctctcgggtctctatgccattgcaaaagctggtccctatgcctgggatgttcatgtcatcagcctgctgaattccatctcattcttaaggcttcccttgactatcactgtgacaggggttggggggtgtttacttggatcacagcatgtgacaccatcatgaccatcaattcccttacctcttcttcccactccctcttcagcctgtgagtaccttaaaagcaaactctcccttgctcttgtgtctcccaaatagctgacatgaagtctgggggtacagtctgctttgttgtctctaatacttctcctgagtttttttgtttgtttgagacagagtctaactctgtcgcccaggctggagtacaatggcgtgatctcggctcactgcaacctccgcctcctgggttcaagcgattctcttgcctcagtttcccaagtagctgaaactacagacatgggccaccacacctgtctaatttttatgtttttactagagacggggtttcaccatattggccaggctggtctcgaactcctgacctcaggtgatctacccgcctcagcctcccaaagtgctgggattataggcgtgagccactgccccaggccagttctcctgagttttaagaagaggtgggcagcctgctagacaaaggccagacaagacagaatcctcctccacttttgacgtaagaaagagaacatctgtgaccatgcagagtcatcatctggctccatgcccctttctcagctcctccccgggtggaattgtacatgctgggttcagcctatgggaggaggaagggtttcctcgaggacacaggaacagcatgtctctgatgccagatccctgctctgggggcgctcatctgtggcctcaagagatgtatggcttctgtgcctagtgcagagttgggattgattgctcagtttaaatggaaaattgttccaaaagcagcagctgcctctccagccctgaatgagaagaatgtatctttctctgagtccaaaaatatatatatatatatattatgtagcacatactatgttcagggcatcctttgaggggaaggtttgaaatgaggcccttgaaatgaggccccattcttcccttcagggaagatctaatctcaaagggaagctgggtaaatgcacagaattcatggctgtgagtcccctaattgagtggcagttgtaaagcctggggaatgctgccactttgatttgcacattggcacctactatgcttcaggactctggggtgtcagggattggcatgataatttgtccaatacaaactatgtggtgctttgtctaatagaacagaacatagaacattctgagagcaaagttgtcagatccatcatttattaagcattagtaagtgagagaaaagaagggaaactgattgcaagtgacaggaatcaagagatgattcctgaaatgacacagtcgcagcacgacaaggaatcctgaaagcctgggatggccactcacctaacccaagtcatcaggtagcctgtgcacagactccccagtgacggggaactcgctacctctcatgacagcttgttgtgtctacaaagagttctggcttttgaaagttcttcatattcagcccaaaatctcctcttgtaacttctccctttgttctgggttttacccctcaccatgcagaataaatctctcttcccagcatcacccttcagatgtgtgaggcatctataatgggccctgtgagccttttcttcttccagggaaacgagcccagtctctgcctcccttctaggggtagggatgacacatgagctgggcagaggattagtaaagcccatttggatcctctcatctctactacgataatggtattagcagtagctccagacagaaacctggcattcccctgcaaacctgacagttcaaagcctcagcttcacccagcctctgcagaggctacaggatggatgtctgctctagcaggccgctctattccactaatcgtggtcctgtcctgagcacaggtctcctctgctcactgtgggacacagggagaggacaggacagtagatagacaagctgttgaagctgcatgcctgttcagtgctcacgagactgtgtaatacgagctctttaggaatcctctgtgtgttgagcggctttaactttcagtactgaggagttagagatgtagttgcctcctcatacctgatgcccctggccatggcttgaggttaccacctttgccacctggaggttgtcacctttgccctgttgctgtatccaaatgaggatagatgctatacactttagcaatacagtgcttgcctgcgaatatgattagttgtgctttcaaatgccacttgtggttttcaaaatcattgtctatttaaggtattatgttttgttaactactatgttattttttttaaatgtgagtatcttatagcaactgtgagactaatgcttcctatgaaatatttcattttatagtcacagcaaccccgtgagttggtgttacgcatcttgaaccaatgcgggaactaaagcttagagagagaaattcatctgatctatttcacacggcttagtaatgagtagaactgggatttgaaaccagcctgccagtctctaatgtctgaacttttagtcaatatcctttttaaaaaagatatatttccaatggctcacgcctgtaatcccagtaccttgggaggccgaggcgggtggatcacctgaggtcaggagtttgagaccagcctggccgacgtggtgaaaccctgtctctactaaaaatacaaaaattagccggggatggcggtgggcacctgtaaccccagctactcggaaggctgaggcaggagaattgcttgaacccgggaggcggaggttgcagtgagctgagattgcgccactgcactgcagcctgggcaacagagcaagactctgtctaaaaataaataaataaaaattcacccatttgtagtgtatagttcatgggattttagtatattcagagatgtgaacctcaccacaatccaactttaaagttttcaactctccctaaagaaatcctgcatccattagcagccagtcctcattttcccattaccgctgccctaggcagctactaatctactctctgtctctgcagaactgcccattgtaagcacttcctgtaaaagtaataatatacaacatgtggcctttttctgtttggtgtctttgacttagcatgacattttcaaggtttgtccacatcataccatgtatggaattcctttttatgccacaataatattccatggtatggctaaaccacattttgtttatccattcatcggttcgactgacatttaggtaggttgttctcatggtttttgttttgttttgttttgttttttggtgtttttgtttttgtttttgttttttgagacagagtcttgctctgtcgcccaggctagagtgcagtgatgcgatcttggctcactgcaacctccacctcccgggttcaagcaattttcctgcctcagcctcctgagtagctgggattacaggcacccacgaccgcacccagctaatttttgtatttttagtagagacgtggtttcaccatattggccaggctggtctcaaactcctgacctcgtgatccacccgcctcggcctcccaaagtgcttaattattgtgaataatgctgctataaacactcacataaaagtttttgcatggatgtgtgttttcattctcctggtacatatgtacctagaacggaattgctggtcatatggtaactctgtgtttagtattttaaggaactcctcgggtgcctgtaatcccagctactcgggaggctgaggcaggaaaattgcttgaacccggaaggcggaggttgcagtgagccgagatcgcaccactgcactccaacctgggcaacagagcaagactccatctcaaacaaaaaaaaaaacaaaaaaaaaaaaaaaaggggaactcctaaaccattttccaaggcaactggaccatttcttggccactgttcttcactgcatttttgagtaaagaaatcacgtctttggtgttgcggataacctttcccacatcccttttattctagttcagcaactcatctggtggttttggacctccttgcacaaaacagccatgctgtagagtttctgaagcatacctgattcgaacctcaacctgaactcaccacctcagtgaccttgggtttttcagctattctttctttctgtatcagacaaatgaatggatgtgaggattcaatgagatatgatgtgtaaaagcctggtacgaggcctagagcatagcagggactctttcattcacccagcacttgtgcttcaatttctgctgtgcaccgtaaaagcatgtggcttgggaggctgaggtgggcagatcacgaggtcaagagatcgagaccatcctggccaacgtggtgaaaccttgtctctactaaaaacacaaaaattagccaggcgtggtggcaggcgcctgtagtcccagctacttgggaggctgaggtaggaggatggcgtggaccctggaggcggagcttgcagtgagccgagatcacgccactgcactccagcctgggtggcagagccagactctgtctcaaaaaaaaagcacgtggcaggatatgcaggatacgcagaggtgggtggcacctatacaacattatatttggaggctggagaaaggcaggcctccactccttcttgcctgttgaacttcaccgctccctgcatgcctgctccgtggttcactttctgcagacaccctcatgtcccttcttttcagagcaaataattctccctccgtctctggccctttacacctgctcttccttcgtactggaactttctttcctctgtttcctaggcgaccatcccacccttgcttgactgatctctgcatgtttttccaacctcagctcaccgccgctgtcactgcctggggagtgtgtcacctgtccagataggttcctacagttttttttttttttttaagatggggtctcactctgccatccaggctggagtgcagtggtgcaatctcggctcactgcagcctccgcctcctgggttcaagggattctcctgcctcagcctcctgagtagctggaactacaggcgcctgccagcatgcccggctaattttttgtgtttttaatagagagatggggtttcaccacgttgaccaggctagtctcaaactcctgacctcaggtgatctgcccgcctcagcctcccaaagtgctgggattacaagcgtgagccatcatgcccacccagttcctcctactttgtacctccacaagcacctgtgtttccccttcatagcacatggttgtcattttacactgaagtgcatttgcatgactgtgtagctaacgtccatgtcacccactagactataagccgttgaaaatcacttgctttgggctcgaaggacggcatcacccacatcatgcctgggtgagtggagagtcatagtccaggccgcctgccgccccatctggatgccaggcctggcgttcaattcaaataagtgttgatggacagccaggtggtaagcaggttgagattaagaacgacttggatcatttcctaacaattccaagaaagaaacccagagcacattgagatcagaatcgagggctgccagtgggcagtttcagggaaaccagcccatctcccactctatattcaagttaattaatcctccctcatctccatcctcctctcccctgtggccaccgccagctactgatcatcgcaggtgtaagtgtccagattcatgccccctagggcctggctccttttgcagcaaacacagaggcgatctcccatcctctccccaagtcagcgtcttctgtttcctgctcctgtttttgtgaggagcagcccctttccccagcccctctgccgctcactgcctttgaagtatacataataaacttttacagatggtgacaagaaaagctacattagcttcgtcccttacttggagagtggctctaatccactctccttctgagtatgactctttaatgtaccatttcaattctttccctctcaaatacagccctggagcttctttgaagtgtcaccctccaccctccgtctttgattcctccttagggtgttctaatcatggagggtcctaggctgtccaggaagccttccatgggcgcccgcacctccacccagtctctaaacccttttcactggtctcataatgatagttgtccctctcccctgagctagcacctatgctgggagtgaatgatcttctatttcttctggggctagcaatccttcctgtagtttagctgtgaatttccattaagccacttgtttggatgggcttctgtgaaagccactgttgaagtaatgatgataatgatccattccatttattgataatgccactcattagattaatggcttcctgtgtactgccttatttaatctcccaacaatcatgtaagcaaaggtgctttcatcatccccattttatggatgaggacacaaagacttagagtggttaagtagtttgcctgaagtcaaagagtcaccaaagagtgattctgcagttagagtcaggcagagggatgctccactgtgcccttacccacgttgtaaaccaggaagctatgagaccaatttttctttaacaaattcactagaatttttatatccaaatagtctcctgcgggagattccacactttaatgatgtttttcttttgctttaattgtcaacatcatggtcctcaaagagtgtttgtacctataattgaacaggtaagattaggagttttcgaagattgagataaagtaagtgccttgctaattcctttgctgcctgaagatgttccaaagcttaaattgaatggtcttttgagaaaatcatctcccacttagcacctaactgttggcaaagcagcgtgctaatcatgggggattcaaaggtgaattagacccacttcctactttgagaggcttttatgtgtaaaagaaaaaagaaacatagaagcagacttacatattatcttatagatgtacatgatacatatatttcaatgtatacatggtatctttatgatataaaattacatattttagtccagtcgtggtgactcacgccttgtaatcccagcactttgggaggccgaggcaggcagatcacctgaggtcaggagttcgagaccagcctgaccaatgtggtgaaaccccgtctctactaaaaatacaaaatgtagccaaacatggtgtcccgcgcctgtaatcccagctactcaggagattgaggcaggagagtcgcttgaacctgggaggcggaggttgcagtgagccgagattgcaccattgcactctagcctgggtggacagagcgagacttcatctcaaaaaagaaaaaatttacatgttttatctttacatatctaatacctattacaacacataattgcgtaagatgctgtaggaactgacagaggagcttaggactcctcatgcctataagtcaataaaatctctaccatattgagttaaataatgaaggaatggattgcttcatttaactgaaaaaacagagataggacaggtgtcacgggaccctggctcacttctccaaggttctctcatccgtgtcctcgggctggctccccttttggtagtggatgatttccatctgcccctggggctgcaggcttccacttttcatttctcagagaggaagagtcctgtgctgcaccatgatcgtgccatctcaggtcacatgcccattccttaaccaatcgttataactaaataagtggataattgccatctgccttagttagacagggcccatactttgaacagggatgaggtcagtcccatctaaaccgaacggctgccacaaaatgagagaagagagtaggaaataggaggaagctgtaagcactagccgactataggcaccttcctttggcgaatcctgttcagggcagaaagccctgggcttgggttccactctgaccctagagtccaccctgctactaagcacagcctcaaggtgtggaaggtagtgggtaaactgcagtgtcaaagaggctgctccagatgtctgtcatcccaaaagttatatacacaattgcctttaaagccacaagagtctctgttttatactgttttatttcaatttttttttaaattttttgtttatttatgtatttatttttttgagacggaatctccctctgttccccaggctggagtgcagtggcgcgatctcggctcactgcaacctccgcctcctggattcataccattctcctgcctcagcttcccaagtagctgggactacaggtcccccgccaccactcccggctaattttttgtatttttagtagagatggggtttcaccctgttagccagggtggtctcgatctcctgacctcgtgatccgcccacctcggcctcccaaagtgctgggattacaggtgtgagcccccgcgcctggcctgttttattttttataaagaacacgccctgctatcctctgttagtacttatcttatttacatgatttggaagtgcatgggaatgttggcttgttctgaaaattaaatcagctctgaaagggaaagatatgccaacccttaggtgtttagaagagtatgttgtaggatctgagtgcagttccaagacattcggctgccgcagtggtgattttaacaatagcagcatcgttaatatatgtatccagcctccttgatgactgttctggagaagaagatgttctaatcacagcttgctttttcctaccaagtcattctaaaaagttgtagagattattttaagagaacagccctgcctgaaggactgttactgttatttgaggctaaaggaaatcttgcaatttgcaaaaaaagttaaatctgaaccctcccctccaccgtgggggccagggacaaggcacaattccatttccaccccccagctttcttattggaaaaataaacacccctgccagacacagtggctcacacctgtaatcccagcattttgggaggccgaggtggatggatcacttgaggccaggaactcgagaccagcctaaccaacatgccgaaaccccgtctctactaaaaatacaaaaaaattagctgagcatggtgttacacgtctgtaatcacagctactcgggaggctgaggcacgagaatcgcttgaacgtaggaggcggaggttgcagtgagccgagatgataccactgcattccagcctaagcgacagagcaagactgtctcaaaaataaacaaacaaacaaataaataaatgaaaagtaagcactctgtaactcttgctttgtacagtgtagatgaactgagatgaagtacgcaaaggctcttctaaaccactaagatgccagtaatatatgattgttatcgttagcatcagttacttatatgaactacagatatttagcagtgttaggaaaaagttagaagtaattaataatatattgatgccttcttctagaagaagagttactgtcctttattgaacatatactggacactttgtatgttttgtcacatcgaaaaattgacaagaatgcagccctaagcttctggcagtgatcttatgtgaatgatctctactgaagcacaagactctttttagacactgtgcagaataattatgatagctgatatttacatagcccttactctgggccagtcaccagaaggcaggcattgttatttttgtccctagtttatagtgatgaaactgagacatggagtggtcatttcatttgcctaagaaaatagcaggctgggtttgttggctcacacctgtaatcccagcactttgggaggccaaggtgggtggatcacttgaggtgaggagtttgagaccagccttgccaacttagtgaaaccctatctgtactaaaaatacaaaaatgagccaggcatagtggcatgcacttgtagtcccagctgtttgggagactgaggcaggaggttcgcttgaaccagggagtcagaggttgcagtgagccaagattgcaccactgtactccacatcctgggtgacagagtgagactccgtctccaagaaaaaaaaaaaaaaaagaaaagaaaagaaaatagcagaactagtttccaacttccctgagtctggaatttgtgtccctacatatactgcctttccaagtatcagatttcttcagaaagagcctatttttatgaacaagatcccaaacaaaaataaacagaaagcaaaaataaaatgaaaaagataaaccaaacaatgttgaatttattatttacttcctgataggcaagagaacagatgcccatgtaaaaatttactgagtgcatcacaaagagaaaaattaggagtttttaagtgcagaagtgggataaaagaggtggaatgagagatagagtctgaaaactgttttctgggcaggacctaatgagttcatagatttgtacaaagttgttgaaaacgatagcgtagttcattggccggaaaagaagagtgtttctttagtcctgtcgtggtccattcaggctgctaacaacatagcgtaaacagaacgggtcataaacagaaatttatttctcacagttctggaggctgggaagttcaagttgctggcagactcagcttggtgtcttggtgattgcccttttcctggttcttggattacccttcttgctgtgtccttacttggtagaagaggcagggtagctctctgtgcctcttttataagggcattaatctcactaatgaggacttcgccctcatgatattatcactcaccgtgatggttaagattgagtgtcaacttgattggattgaagaatggaaagtgttgttcctgggtgtgtctatgagggtgttgccaaaggagattaacatttgagtcagtggactaggaaagacagacccaccctcaatctgggtggggacaatctaatcagctgccagcacggccggaataaaagcaggcagaagaacgtggaaagactagactagtttagtcttctggcctccatctttctcctatgctggatgcttcctgccctccaacattggactccaagttcttcagctttgggactcggactggcttccttgcacctcagcttatagatggcctattgtgggacctcaacttgtgattgtgtgagtcagtactccttaataacttccctttatagaagcatctatcctattagttctgtccctctagagaatcctgactaatacactcacagaggtaccacttcctaataccaccacactgaggactagatttcaacataggagtttggaggaacacagaccctcagaccacagcagatccagttagagtctaccgtgatcatgacccctttatggcttcagctgtttcaaagcagtagcattgaaatacaaactttagtttttttgttttgttctgttttgtttcgtttttgagacagagtctcactctgactcaggctggagtgcagtggtgtgatctcggctcactgcaacctccgcctcccaggttcaagcaattctcctgcctcagcctcccgagtagctgggattacaggcacatgccaccacgcccagctaatttttgtatttttagtagagacaggatttcaccatgtctgtcaggctggtctcgaactcctgaccttgtgatcagcccgcctgggcctcccaaagtgctgggattacaggtgtgagccaccacgcccagccaaactttagttttgctctgtcctgggcaagtgctacaggggatggaaaacttgtttttacactatatagcatgcactgcataaggcgaccaaggcagtcaagggcttgggagagcgtaaataagcaagacaattcagatagcggtcagtgctatgaaagatgtaagactgcaacacgatggagactcaaaggaaagttcaaaggatgagaagcttccgccaagagaagatgctgtggaagtgttctaagcagagggaaggcagatgcaaaggagagagcctgtgatgtttgatggagagaaaggaggcctctgtgtgtccggggggtgggggtgtgggtggggaagagagtgttaggcagtggaatcatgttcacgtgggccttgctgatgaattgcagggagagaatagagggaacgaggaaatcagccacagttccagactgggatagcattactgagtggagtgtggctctccccttgagccctagggtgcagttatctgcatagaggcagcgccaagagaggacagagacttgaggagagttgcctgccctctcccagatttgccctgtgatcccagagagccgattatctttcttcactgtgattttgcagaacctgcaggcagtttggaaacagcactggcaaaggagaaaacgagactcagatttctcatcctagctgtgacagagatgccaagtaacctagtggctttgtgcaagtcctttaatctcacagaacctcatgtttctcatctgcaaaatgagtgtaagattagttaagctgcctacctgttagggtagttgtgaatatcagttgggaaaattggtgggaaaagagcttggaaccatttaaaatatacagatttgtgaggaatcaatgctatggatctaaccaattaaaatagaatatggtggcatgatagctaatcttttaatggaatcattgtcattttcttctaccattttgagcactaactgtgttaaacaccgtactgagcacttccacatacattaatctttgttatattttagaagcagctcagtcactttattcatttacgtaagctgtcaagtagcatttaaccaagggaaacgtcctcagttaatcttcacaacagcacacacaagccatctccattttatgggtagggaaactgaggcacatcagttcaattcattgcccaggacccaataacctataagtggaaaaattccagatccacagccagggctttttggcttcagagctcatcaaagaccatatgcaaagctttctctcagcacagctttatacagctgttgagcatcaatgctgtctataaattagtgttcaaacttggcatctgtgctgaagagcttaaaagttaatttctcgtatttgtccttggacctgtgttagccacggagtgggcatcgccttgcacaaagtagcaccttttaaatgagagccttcactagagattgagcaactgctgcgtactttgcaaatagaaagtgtcttgtgactgccacccagttggaagatgtagagcccttgtcagcacctgggtttggagggtctcttaattatgtcaggagtctgggcacactgatatttattagctctatactatgcagatgtggaccacagaggctgggtacctggagtcattgtttaaaataaaggatcttgagtgcagctgtgtggctgtgaatcccagccccaagacatcccaactaggtcaccttggaaaagtggttcaatccctctgtctgcagtttcctcatctgcaaaatgggtatgatcatactgcctacttcatagggttgctgctgttgtgggggtgggtgttgatttggaactatccacataaataaagcatattgcccagtacttggaccagcactcagacttggctgtcatcaccattaggttgaaccattttatcacctccacaaatgtcagatgtagacacattaaaaaattccatgctcaggccgggcacggtggctcacacctgtaatcccagcactttgggaggccgaggtgggaggatcacctgaggtcaggagttcaagaccagcctggccaacatggtgaaaccccgtctctactaaaaatacaaaaattagctggacatagtggcgcgcgcctgtaatcccagctgctagggaggctgaggcaggagaatcacttgaacccgggaggtgaaggttgcagcgagccgagatcgcaccactgcactccagcctgggcgacagagcaagactatgtctcaaaaaaaaaaaaaaaaaaaaaaaaggccaccatgcttgtagagctatccatttggatagagatggttttagcaggaaggaatttgaaagaggaccctcgagttatgtgccagagcactgctactcttctcacttacacaggcattaaacacaattttgaatttaatgggatactctgataatttctcttttgtcctgaaaatggattgttagagaggaagcatcacagcagagtatgttgcctttcaaaacagggtgcgcattgcccacccgccgcccgcatttccctcctccctccctgtggagattcagcttttatcagatactgttcaaagcccccaggacaaggacaggacgtcctttcatatgaaagtaatttaaaacatgttttgttttgttttgttttcagttagcacacaaccatattatgaggtaaaatttaaaatgtgcacaattgattaaaaattgagacttcaaagaaatcactcgctcattggcaggctaatttgggctgtatattcgttctcaagggctcttaggaattgtgtaagtgaaagaatttgcaaagctcccggagcttgcagcctgtgccttcagacacagcagcacggagtccccactctgcttcctgtttactgtgcaactggagtttgttacttagaggcttagtttcctctgctgaaaatcaagatagcactttccatttcaaagggtttgaggggacaaaggagattcacagatgtaaagggaaagtgtggtgcccaggaggtggtttgcacccagtgtagtccccccactcctttgccttcacttgaaagacgcaaaagtgtcactggcaatgttgtgcacagagcagacgtcagagaatcaagatgggcctgcttcctgccatggactttggaccctgcagccccagcttcttgctctttgtgcctctcagctataggggcttaatctgggagcttggagtgtcaccatgcctcccttgcatctccctcagtgatgcattggctcatctgtcacctgccagtggccgacaaggccccatcagtcttgctgttacctatttatctacctgctttttcttctttctgtcatcactcatttagtaattcaacactattctggcacccactctgttcagaacactgccactgatacttttgtatctttctattttgaaatattccatgaaactcttcttaccatttgtggagccataaggccacatcaaggggtcggcctttcatctcagcaaaaattttgcatttcagctgcctcgggaatggttttctttcccctcgaccttgtctttatttcatagtaatttagccacatcttgaattcctcgtcttttctgtttgagtttgacagttttattttgtttcaactatgcaatactagccttcaagactgataaattcatattattccaaagcttttagtacctacccaatggtgggcacaaaaatggggctgtaagatcgacttatgattaagttccaatttcagattaagtggtttattgtctaggcagagctccttgtgatttctcctttataggcaaagagctgaggctcaggagaaatccaggcaaccaacattttaattaaaaggaagttttgagaagattctttcatcttcagaattttctctcaccttgaagtgagcgtcgagcattgtcttttaaattattgaatctgggctggatgggatagctcagttgggaaaatgcgttcatcttttttaactacttttatcagaggttctgtctgaccctccatgcatgtgggtataatgaccccaacctctttctagctgtatgcagttatatgtaaaaccgcttcctgctctttcctacataaaaattcttgcattgtatttttacattattacatgtagtgggtggccagctatcaggaaacagcattttagtgccctcgagcttttaaaatgtccctaaatttggaggtagacatagaacaacaatactattaacaattccatatactgtgtaccaacactgtcatattaagagatgtatatcctctcaactgccctgaaagcagctttgtgttgtcctaattttacaagagaagatccttgtaaacaaagatgtgtctggctgaggtggtctcacagcaattgaaggggatgtttgggtctcaggctcaggtttgtctggctgggctgctgaaattcttgccactttctctcagagaacatgtaggcaacaataaagagaaaaacaggagtaagagagaagagtacccaggaaactggcgacaatggtaggaagaggtgaacaacagagaaaactcaagaagtggagcagctctgcagctcatggtcaccggcgaagagctactaaagtgtcagtcctgtgggttttgcagacaaagcatctccaccatatttgaatgtggagagtgtcagagatgatgtaaagagtcagtaactacctctaacttggggcaatgccttcaaatgtgaaccttctctttagtgagccgggaagctgtatgggattcccaggtactatggcatccactatcagattgatctgactctagttggagactaaaatcagaagcgttgcagcagtgtactggataatgaatggagtgatgtagttagaaaacagttggcctacaaataattctatttagagtagtaatagtagttatagaaacaacacatgtttactgagccgttttcatgttcttggcactgggctaaacactttacatgcactatttcatttaaattgcactatttcattaaaataacatctcagtcctttgtgagagacgaatgaggtggaaagaaaataaggacaaaatgacagggattcctctttattctctggtagggaagcggggcaaggttcatggttgatgttccatggagcttctggcgtgaataaatgaagatggataagacgcagtcccagccctttagtaatgtgaacttggtaggaataacttacccgaatatataaatatgatgtaatattgcatgatgcagattaatcaagttatttataatttacaatgatccagttgagggagcaagtaattatgcctaagcagagcccccctagctccagagggaaagtgcttctggagtcaggagttggaaaaggaggagaaagtggccagggatacaaggcggggaaaccgtgttctagcaaaacagtaagatgtgcatgtgaagtcactgccttccctgggacaggcaccctctttagagacagcaacaccacccagcccagccccatctacgcttgttcatgtccacttagcacttccattcatctgagcgcctgcagtgtggtgtttgcttcttgtttctctctgccactaggatgtcagctccctcaagccagggctttgttttgttcattgtttctattagttcgctttcatgctgctgataacgacacacccgagactgggtagtttataaagaaaaagagggtttaatggactcacagttccacatggctggggaggcctcacaatcatggcagaaggggaaaggcacatcttacatggtggcaaacaagacagaatgagagccaagtgaaaggggaaacctgttataaaaccatcagatctggtgagatttattcactaccacaggaacagtatgggggaaaccacctccatgattcagttatctcctactgggtccctcctacaacacataaaaattatgggagctacaattcaagatgagatttggatggggacacagccagaccatatcattgtcctcaccccagtgctcagaacactgccctgcgcatagtgaagtgttcaataaaaatttcttgaatgaatgattgacagtttgaaaagacctgggaaggtaacatctaaatataaagaaagttgccctcttccctctccctccacgaccacacattttgtgatcttcgtagcacctatcaccatttgtcattatgtatcttaaatatttacttttctgctgcctgttttctcctgctacagtataagctccacgaggataggcatctgactttgcattctcttgtcttcacctctgtagcctcagcacctagcatcatatgtagacatggaagcacttaataaacatttgttgaatgaatgaatgaccaaatgagactactgctggtggactgagcagagaggaggaggtggtaaactacagttaggttgtgaaggggatcatatgtcatgacaaagactttgataggtactccagggaaaggagtgctttgtgaagtttttcaagttgggtgttgtgattacatttgcacttcgcaaggagcatttggtgtggccccagggagatttagagaggtaggttatgtctagaatgatgactgcttgcatcttggaatattacaaagcgtttccccagattatgatgattagcgcatgatttatttttgggaaactcttccttaagtgctaggttatcagaattagtattgtcagggcaaatgatagtaggtgagccatttggcttaagggaatggattctgtatgactttttaatgtctttatttttatctttacttattagtaaaatataatacttctgaatggtgctgaactgttagtaaccatagctactaaagctgtcctgtaaaaccatccaaataccccagaaagtacttgttaagacagccccaaaatgagaacagcctcactctgttaaccatgaaaaattattgaaaacatgccaacattttattttacaaacctccatggaattgactctcttgccctgttgttcacttttctcttatttctcctcccatgtcttattttccatccctaagctctgtccaacataactttctggactgatggaaatgttttacatctgcactctttggtatggtaaccactaccatgtggtcactgagcacaggagatgtgcctggcatgaataaagaactgagttttaatttaatccgagtttgattaattatttaaatttaaattgccacatgtggctagtggctactgtgttcaacaagcacaattctagacatttggaagtcaacggtgtttgaaatttcaccaagtcctttgggcaccagcaaagtgtttgaccccagaactatagaaaacctcttttctgggaaacaaatggcaaaattcctccccagtacttttactctgaggctaacatgagtagcacaattgaattaaataagattgtggttgataagctgcttcacacactgcctggcttctagttaatgcttaataaatgataacaattatttaatattcatggcaggcttaaagggagataacatgatctccactttgcagatagggaaacagaagctcagagtttcaacatcaagtgcccaagaggtcttgccgtcagtgagcagcagaacagagcttccttgcccatgtcggtgtgtgctttccagtacaccaggccaagaagcagtcttattttctagatttcagtgagttttatcctcttactcagctaaaggaggccatctcaacaacagcacaggctctgcatcctttgtggcaggttcttcgtctttcttgatcagtaagtctactgaccctgcgagatggataggcactttctctgattacccagcttggcagctggaggaaatgcctttacaactgaagggctctccaaaggtcctgccttgagaaactcatgagccagaaaagcaagcagaggagtagatactggggagaaggaccttaggctgctgtcaagaaacccgttagactgatgccaatcagaacaagaggaattggtgattttcatcaccaacatggagtggagatcagggaattcagcagacctgtgatgaggacaggaagcagctttccaactcctgatgctagtgaattgcatctgtctcaccagtttgaatagactctttatcccgattgcctgaatcagtgtcttgttgatggtacaggctcagtaattatccgtcagatggatgaacaggtgaatgaatgaataatttgataagcataagtttactgttgccctgaagcacattccttcttaaggggtttgttggggcgggaagcttgctcctgcaagcttgcagcaatccaaaagggctagagaatagacttaggctgcagtcactcatccagagcgaatgtaaaaaggaatatttgtgtccgcaatttggatctagccttttgataaaagtcacagaattacaataagagcacagttatataacccagtaaacagatttgatagagacctagatatattcttctaaatgtgttgcagaagtttcagcctcagatttctgaggattctgcaatcttcaagccaagtttgggggatgagagccggagacactcatgcaggtcccctctctccatcagagggacatggagaaagcaccaggagtcaatgaagatgactagatcaacagtggattgtgtaattcccattggattcatgaagtgtgacagttgccaaagcggtatttaaataagatttagatgaattctgtgaaaattaactcccctgccttttggtgctctttttttctctttctctctgaagttgcagttaatttccccaatggatttcctcagtctttccctggtgtgcgctctcctctctctctctctctgtctctctctctgtctcttctgtttagtcctgctgactctgccatgccattttaggtgctttccatgcttgatgttgatgctctgtttgagattcctgtgctgattagccaattgataaacttaatgagaaagcaaaagcactttgtaaactgtcaagtcctgcaccagtggaaggagggataggtgatcagattctgctttccgtggctttggtctagagccccaggaacttcatgctgtcttctctgtagaggctgtatgatctcttcgaacaaagagatggaagcgccttcaggcaccacccacacccagccctctcatttctatcagtgtgaaactgaggctcagagtgggcaagccacatgccctggatcacccagagagttagcagcagagctgacacgagagccaagtctcagaatatctttcctcttcttcccctttgctggcagaagtgccagggagcacatctgcaaggccattgtcctgagcgatggtccttgtctctaagagttatttactgttgtgaaagagaagcacctgctcttcttgagataatcagggcgtatgtatccctgggcctcagaggtgtagcagcaaacaaaacagacaaaaatttctgcccacctggagcttatattctcccctggggaaatacataaatgtatatatagtatgtcagatggtgataagagccatggtggaaaataaagctgagtaagtgcggttgagagtgtgaggggagaggtgatactgtgttaaatagggggtgtggatcagagtagcctcacggataatgtggcattggaactgatggttgaatttgggggatgatctaacttggaacctaatttggtagaaatcaggacaagagtttaaaaaacaacgtctaagtgacagaaagtcatggaatattcactaaaatgttaaccatcccaatctctagttaatgggattacagttatttctagtttgcatatttttatttcctaaatttcctgcaaggaatatgtattcctttttttatttaaaaaaatgaactccccagcactttgggaggccgagggggtggcagatcacctgaggtcggtagttcaagaccagcctgaccaacatggtgaaacccggtctctactaaaaatacaaaaattagctgggtgtggtggcccgtgcctgtaatcccagctactcgggaggctggggcaggagaattatttgaacctgggaggcagaggttgcagtgagcccagatcgtgccactgcactccagcctgggcgacagagcaagactctgtctcaaaaaaaaaaaaagactcagaccggacgcggtggctcatgcctgtagtcctagcactttgggaggccaaggcaggcacattgcctgagctaaggagttcgagactagcctggctaacatagcaaaacccagtctctactaaaaatacaaaaaattagccgggcgtggtggtgggaacctgtaatcccagctactcaggaggctgaggcaggagaatctcttgaaccctgaagttggaggttgcagtgagccaagatcgtgccactgcattccagcctgggcaacagagcgagactctgtctcaaaaaaaaaaaaaaaaaaccacctcattatttactttgggtgagtggatatcactctaggacaataagtgacaatagtgacaattgtggcaatagtgtcacaaaaatgacaataaggaagaatgggtaagagaggtcagaggatgtgaagaggaagagaagctgaacaggaataaccagaccgggggcatggctttagtcctgatgctgcacctgttggcggatgggcgcaaaacagtttggaggagacaaagtaaaagcaaccattaattgactcttaacttaaagtcagcaaggcagtagaacccagcgctctcctgtcgtggaagcacctctgtcatggaggccagaattctagttttgaagctctgatctccagaaagagtcacagcccttcaaagccttcttgcaaactgttctgtaacatagctctcactttaagatgcagaaactctaagaagatgggaaaagaggaaattgatcatcctttaacatttgttttccagaaacattattctctttccaagtatgattcacagtaagatttattggataagtcctgttgctgcatttaaatcatgatgacattggttttagaataagaaagattcttatataatcattacattgaaactcctcaaggttagagatctggctcatttttctttgaatcacccatagcacctagccccataaatattgattttatcaagaaagattgtgtgatgaagtgagaggaacattagaactgtagctgacgaattttttaaacccaggaacatcaaactcttccccaaggtgtctgttgtcccaggctctttgtgtatttggtgaggtgcagctttagaaggtgtcacgtgtacagcccgggtagataaatgtatttgtagcaatgaggcccgtgtcgcggcttttcactgtccgcaccccgtatgctcaaggattcccagaaagtctaaacttccggccgtcaaggtcacgcatctcaccttccaaaggatggtgttgaccgcctctgctgccaggccatgcccagcagcaggctgatgagatgcatggggaacaggggccttggggaacaggattctccaccctagcatgccactccttccagatctccaattctttcatccctgtttctgtagaaaattctacaagccagtggcccactttcctgcctccatcagtttaacagagtgaagataatttaatcgtcctttaacgaggcaggatcttcagtgccctgtggttataattaagagcatcagcgatcattactagcattcattaatgcagcccgacccctcctatttcgttccccttggctacttccttgcccacactcacctgtttctttccttaaatgcctagagctgctgtttgaccatctttaacctgcctcttcactgcccttgctcttttacctctgtcctttctgtccctatctgttcaccatcaccctctcagtcctctggacatgggaactcaatagctaattttgcatgacactacctctgcccccaatatcagtgtgtttccaagctttggtggactgatggttgcaaggggaagcatttccattaataaaatgaaatcttggatctccagagtggctctggaagtaaaaataccttcctctctaagagagagagctggatgaaagcccgtattggggtcctctgaatatgaccttctctggtgaggcctgtctgccgagcctccggatgatgctatgtaacccttagtgctgtcactcaagtgtgaaccaaatggaaggcgggccagccaagacttttgaaaagattgaaattttacaagtagaaaggaggtggaagaaaacgataatagtaaacagaacacaagacacataactacaacctaatgaagatacacggcagaggtttccggagctacattggttggtttgcttccaggccacgtaagtcctgtccatcccgcatgcaatctctgctttcctgatttcccagcatcaggtagagaaggtgccatttgtacccccaccttcctggagctgcctcaagtgctcaaactcttgacatttccaggaactatggagccagctttccattttgcttcccaacacctcaatagggacaagagtcttttctttaaatagggtgcctacagtcaataataatttcattgtacatttttaaataactgaaagagtattattggattgtttggtgtttttttttattattatactttaagttctggggtacatgtgcagaacgtgcaggtttgttacataggtggccaaaccatggccagaacgtgccatgatggtttgctgcacccatcaacccgtcatctacatttggcatttcttgtaatgctctctctcccctagcccccaacctcccgacaggccccagtgtgtgatgctcttttaacttgcagtgagacctgcctttaacatgcaggaagtagttttccaaatccagaaactgtgagtcccttgaggatccctattatgttttgttcaaccctgagcccccagttactggaacaaggctcagcatagaacaccatggcttaatgcccgataaatgtgtgagaaatacaaaaacagaagaaaggaaaaaggaaagaggagaaaagcatgaataacaacaccttgtctttgctaatattatagccatcaccgacccattgcaagagggatagagtctccgagaggtttttctaggttatgacctttcttgcaagtcaacttccaagactcctgcttttgacctcaaaccaaataattctacctaattcctgattcaaattggtcataaaatgtagcaatcattttgataacacttaacagttcaagaagtgctttcagttagatttaagagctagtttgtggagtacagtagatatgatgatgatggtaataatatctggtaggtagtgagaaagctgaaaatcaaagaagttgacctaactgtctggtaggtaggaaagaaggaaactctaatgcaggtttcctcactacagattcttgactctgtctgtgacctgtatgtcactcaaaattttattgtcctaaatgaggtggccactgcctgacttttgctaagagaactggtgccggtctctttatgaccaatttttacatcatctgtcaacctctgtttcagttggcagttgctctaacgggcaaggtttacccagggaatatccaccttgaatgttggcagttgttctaacgggcaaggtttacccggggaatatccaccttgaatgaaatctctgctcatccaacagaaaaattagtgatatacctgccgtgaatggtggtgtttctcttatctgctttagtatggctttactggtactgtttgacaagaagacaaatgaaaaattcatagggtgcatgagaagaggtaacaaaacaccattaaatttttgtttgaaacaaactattctagaaaaaatgtgcaccatagattaaaaatcatggatcagtatttcgatatgtaaaatgttcctacaaagcatttaaaaaaataatggcccacagacatgaatgttctccactgaagaagtaaacccaaataagtcatttaacacataaaaaaaactctacttcacaaagtaaacaaaaaattgaaaaccaaagcagtaattaaacactggcagtgcttaaaaaaaaaaaaatgtgtgtgtacgtgtgtgtgtgtgtgtgtgtgtgtatctatagtgccaatgataataaaggtatgaaaaatgtaaatacttctccttgctggaagaagtataaatcactaaagcgttttttttttgcagggcaattttaaagtatgtatctaagttttaaaatatgtatatatttgacacagccatttcatttccaggaaattataagagatgagaatagggagcttttagtattatttatgatgaggaaattttgaaaacataggcaacttccaaaaacagataaatttaaatttaagttgttaaattttggtatatccatacaattgaataacatggaaatcatacataaaatgtggagtgtcgacatgaggaaatgttaataacgtatttatagaacagctgctaagagtaagtaggttatatagtaattctaccgttatcctgtttttgtcaaaatatatctgtatatctaaacacataataaaagtctaagactgcattataaaattatctctaagtgataagattgcaagtaacttactctttttgtgttttttcaagtgtgcacattttatgaaaggaattttttttgttttatcatcagaaataaagataaaatgcatccaaagttattggaaacatgaaatttgatttactgagatttcatttacatgcagcccttggagaatatatacattacttaaagcagggcctggttctcctctactggaagaaggctgctttctggaaaatactccctgggagcacaggaacctctacggggctcacctcccctccctgggcagagaaccagagaaatgagcaggagattatacccgcttgacttcttgttcttatcctttttgattaaaaaatacatcaagacatgagatggatggaaaaacccataaaaattgttttactgcatcataaaaggcttacatttctgacattaggatcatgaagggattaattgatactgtcactctctgtatttctagcagaacacactctagctgggatggcgcagccctgctccgaggtctgcgtgaagccgtccagggtgcctgttccttgcgcctcggttgtcattcactctctgtgttcagtttaggcaccgttgctttgagtagctcctggggggcagggtcagcgtcttgatgtagtcactgaactttgtacattgcttgaccgataagaggcattcttgccgggcacagtggttcacgcctgtaatcccagcactttgggaggtggagacagtcagatcacctgaggtcaggagttcgagaccagcctggccaacatggtgaaaccccatctctaccaaaaatacaaaaattagctgggtgtggtagtgcacacctgtaatcccagatactcgagagactgaggcacgagaattgcttaaacctgggacacagaggttgcagtgagctgagactgcaccactgtactccagcctgggcgacaaagtgagactctgtctcaaaaaaaaaaaaaaaaagtcattacttttgttagtatcccttgcccctcattttgatttacataaatattaaaatattctagtaattgtggggaacaaacagatcaggaagtaatctcagagcaatttgatttgttggtgagtaggaattatttactgctaattttccaaatagtagcttggcttattcagtcattcatcctttcatttaagaaacattgatttagtttctgttatatgccaggcactgttctagtcctgttgactgtagaaataactgacaaagtccctgtttctatggagtttatcttcccatggaattgagaccagatctttccttcctttctcccttccctttccctcttccttctgtttgttcatccaatagtccatccagtcatccattcattttatccacccatcatttgctgaatgctcatcaggtgccagatgctgtgctaggtgttggaggataccaataaacaagaccatgttcctgttctgaaagagcagagggtctaataggggaatgggacaatgtcagggctgtctagtaaatgcaacatcaggcataaccccagggcagcatcaaggggtgcatgggagacctcgccccccagttggagagcacctttctcttggccacagaggaagttggcacctgcttgcaggaggaaagttggcctcaggaattcaggcttaaacaaaaaaggatgccacttgctaccaggaacactcatatgaatggtgaggttccttgggggaaaagctgttgtacagtaaaaatccttggtgtcaactacatgttgagccacctgctccatcctgggggctaaatggaaggtctaagtcccccggtacccaacatccatgttctaggaaatctgtccactggagaagatagttagcgatgccctctcacatctttaagtgccacatcagggacttggactatccctgctacgggaacacagtggaactaagagaagaaagaaagaaatgcttattgagcacctactagattcctcctaggcattgtgccagatgctttcatgtgctatctcatttaattcacacagaaatcctgtgacagttcattatgtttttacagatgaagaaattgtggttcagaggggctaattgacttggccaaggtcacaggtagcaaatagcaaaaggcaaaactgagttcccaaacaaatctgtttgacctcttcatctttctgcagttaggaaagcagcatggaggaagtttcgccctttggctctttatttgaagttctctcatggccattatttcatcctactttgcaatgcggtgttgtttcccagactattttgcagaacacaagatgttaataggtgttctaggcaaaagagcctccatggctaaatacattggggagattgtgggtgaaactggtttaagcctggagctcctttagccttcagtgtacttccatgtgttttgaagctcaaagaagagactatggcaggcacacagtggctcagggcactggtgtccagtggaagcccgtttggaaagtattgcttatttcccaagcatttgatgagcttcttctctgagaatggcccctgtggtccatgttattgctccctctggactggactgtgagcagagatggggccctatcctcctctctcccagtgcccattgaacttgacataattagagcttaatcaacctatgcgtgggtgagtgaaatagggctcacctttaaccctgaagaggtagaggaaagagccattgagttagaggagggcttccaggaaaaggaaggagttagacctgtgactcagatgcaaatagagatgctgcccatttgagaaacgtagaaagaggtttggtttcagcagagggtgagtattttagatcagcgacagtcagggatcctttatccaagcacttgggctatttttactgcaatgaaatggaatttgcaggacatcgaaagactgatggtgaccaaaggccttaattctccatctgttaccgatgaattgcaatgcttagtactttcctgggtcatagccatactggttctaacccattgcttgaaggtggaattactcagctgagctctaagacctggcggagctcactggcattttgtggcgaacgtgggggtgcgtgtgtgcatggctggggggagttgtgtctaaccacaggcaagctttgggggtattctgaacgcttttactacttttcttggacatgaaattaaggtcccatgaggacaggcagttttcatttaccttatttggaatacagattgacacatttttccctgatcttttgttgaacccaaaagaacaagcaagcatagtttctaaacaaagagggactttgacaaagcatctttagacggcataattatcaagtagaaacttttaacaaagagttctttagagattgaaaaattccccattccttataactgacagcaaaccctttcttggaagggacccgttggcctggccttgcttttgctgcagcctgtaattatagtcacttgatctcctgattcaactaagaaggaagaaatctgtacatatgaagtgtcagggtctctcacgccccaggtggggctttttctgagaacattcctcccagaatttcttgtcaccagtggcactttgaaaacttagcggtgagccgccacgcagctctgagctgtttctttttcatctctttggaaacttttcccaggaaagttatttctgtgacctgagaaaagagcactgtgacaggctcagaaggctccccactgtccttcgattccagcaattgtcaccgagccgaagaatcgcagggcagcacctcatgactcacatccgagtcatgtcaccgaagctgcatgttgcgtgcatgaaaaggtcctgtgtgcacgttctgctaatgttagttatccacactctgacatcgccgtttgagtttctctgcttctgccctccttgcttatgatctggtcatgaatgtatacctttggagagcaccttttgggtgtagttaatacctagtattctttgggctggggggcggggtgcagtgggatagggaagagaaccaaaaaggaaatgttacttcatttaaaggacatatgaacccaaagtatctgagagcagtctcaatcaatttagaaagtttattttgccaaggttaaggacatgcctatgacacagcctcaggaagtcctgaagacatgtgccccagggtggtcaggagacagcttgcttgtatacattttacagagacgtgatgcatcagtcaatatgtataagatgtgcattggtttggtccagaaaggagggacaagtcgaagtagtaggcggagcttccaggtcataggtagataagagacaaagggttgcattcttttgagtctttgatcatccattcactgaacacacaatttacagtgagaagagtggtggagaaatagtcacttttgccttagtctggctcaatgaatctgcatttttacataaatagggcagaggaagcaatccaggtatgcgtttgtctcaggtgagcagagggaggactgtctgtcccacacctgtgaagatcagctaatcagctatcaatttacattgccaggtgaagttcagcagaattgttttagaataaagatattgagtttcacagggaatttccttgtggccaaattgtgaggaagatacgtagcttttgttttttctttttaaaatctttgtagctatcttatttaggaatataatgggaagcaggtttgcctgaggcagttgccagcagttcccagcttgacttttatctttggcttagtgattttggggtcccaagatttattttcctttcacagacaatattctctaataacacctatccaaattaggggctctggatggtgtttgggcagcagacatggttaaaaagaatggctgattgtacagtatgctaattatatctcaataaagctgtgaaaaaaataatgagttaggccaggtgcggtggctcacgcctgtaatcccaacactttgggaggctgaggcggggcagatcaactgaggtcgggagttcgagaccactctgaccgacttggagaaaccccgtctctactaaaaatacaaaaaattagccaggtgtcgtggtgcatgcctgtaatcccagctacttgggaggctgaggcaggagaatcccctgaacctgggaggcggaggttgcagtgagcctaagtcatgccattgcactccagcctgggcaacaagagcgaaaccccatctcaaaataaataaataaataaataaataaataaataaataaataaataaataaatatgactcactgatgctgattatcaagtaggtactaggaactggtctaaacattttctctaccttgatctccttcagtttgtcttcataaccatctctatcacataaatcctattattatcatccttatttaacaaataaggagaccaattaagagatatgcaacttgcctttgactggtaaagtgatgcaaataggaagagatgaaacagagattcaaaccctggtagtcccaccccagtattcatcttctatatgggattaggcaagattcctgaaaaagcttctaaacccctcatattaaacacaaagactctgttccagtgagtagactatgccattccctgtccccaaattcagcctggctccccctccctggtgcatgtcctgtagatggtggagtgaaaagaggtgcagtttgacaaaagagggcattccatctccttatcttctgatattactgtcagaaacaagttcctggcctctcacttcagctctcttcttttcagccagttatcccctgaacaaaattgcctcaagattacagatgagcagctgtgttttggatgcaggagcattgccatcttgctgacagctgagttttctctggggacatcagctagcccacagcaccccactctttttccacactccttattttcctgtaagctgtggttggtttcctcttgtgaccacaaatgaatcaaaaagagaactgtttcccagttattccttattatgtcaaagcagatgttcaaggtgaggctccggatgacttatcaaaactccagaggtgatttgtgtcctgataacagtgaggtctcagactcacatgtatgcaggtggaaggcaggcagtgtcaatatgcaaagcgtgccaggcataagggggtaagcgccatgtctctaccattgtcaccaagcacagcacctgtctagttgtattgccttttaaaagacagactaggccgggcacagtggctcatgcctgtaatcccagtactttgggaggccgaggcaggtggatcacctgaggtcaggagttcgagaccagcctgaccaaaatggtgaaaccccatttctactaagaacagaaaattagccaggcatggtggtgcatgcctataatcccagctacttgggaggctgaggcaggagaatcacttgaacctgggaggcggaggttgcagtgagccgagattgcaccattgcacttcagcctaggcaacgagagtgaaactccatctcaaaaaataaataaataaataaataaaaataaaagactagatacattggccaacaatatatgtttgaggccctttgagtgaaaaagattatccagatttagtaaccttgaagttcctgtgaaatatgtgatcctgtgatatcatgattccttttcagaaggcagaccaacctcctttcccctccaaagatgttttggagaatactttgcagaaaatataagaatatgaaatgtcttcaaactgtgggatggtgagaaggtgtgccttggtatcagctgcacatttctggaaagtcgcatactcatagaacagaattaattttagcaactctgagaaaatggcctgttttttctctccctcttctcccattcatttaatatttttttccatcacttttcatatgcccagcaccttgtgtatgtagaaggtatgaaaaagtgctgggctcggtggctgacgcctgtaatcccagcactttggaaggccaaggtggtggatcacctgaggtcaggagttcgagaccagcctagccaacgtggtgaaaccccacctctactaaaaatacaaaaaattggttgggcatggtggatcacgaggtcaggagttcaagaccagcctgaccaacagggtgaaacctcgtctctactaaaaaaatacaaaaattagctgggcatggtggtggcatgtgcccctagtcccagctgctcaggaggctgaggcgggagaatcacttgaacccgggaggcagaagttgcagtgagccgagatagtgccactgcacttcagtctgagcaacagagtgagacttcgtctcaaaaaaataaaaaaaataaaaaataaaaagaactacccgggcatggtggtgggtgcctttaatcccagctacttgggaggctgaggcaggagagtggcttgaacctgggagccggaggttgcagtgagccaagatcacgccattgcactccagcctgggcaataagagtgaaactccatctcaaagaaaaaaaaaaaaagagagatatgaaaaagtgtaggttgtatcattttgaaagtatcatgcatctcaatatgttaatactcagtagagtggctcgctcatcctcatttgcctggaactttcccaattttagcattaaaagttctacattcaggaaacccctcagtcccaggcaagccaagatatttgaccaccccagtgctctagaagacaggacgaaatgatcttgtgcaggcatcaacagaattcctttacacatgacagctacaaatgcagaaagatacaggtgcatcgtttgatgactcagatgctgccagcagcactgctactggtatcattactttacaaaatgacgagcagctcttggtaaaattccaaacaaagtggagtacgatcttccctcaatttacatggtagatgctttgctagaaaactcagcacatattaaaatgtgcagaaacactcagagtttaaatgtaaaatgtggtttagattttatacatagctgcttattgacgtctttttcactaaaatgactatctgctgagacatttgaaagtcatgagaggcaagggactattgtgtgtggtgtggaatttccctgtagagtgcagaatgttgatcatcccttgacctcacctctaaatttagccaatggcatcctctaattatagcaacaacaaaaaacacctgcagaggtttccaaaataccccactaggaatcagtcctgctctcattggaaaccactatactagatatttgaaaagaaagaaatactcaaaaagaggtaagcaacagtaagatcctttctctggcatccctttttctttatctcctctccctctgcatgcctgtctctctctttgtctccttcatcagtacaaactgttgacattttctctgtgtataacatcctgcaaagtgcttgggaaggtctgcaggtaactgccatctttgcctccaaagaccttaaagtatgcttgaaaatatgaaaccaaccaggagaatcagctcaaagttaacccatggcactaaatcaggattgcctgctcagctccagctgtaactgaattgattggatggtcttcccattgtctcccctggctctccactgaggctctactctttttttttgagtcagagtctcactgtgtcacccaggctggagtgcagtggtgtgatctcagctcactgcaacctccacctcccgggttcaaacaattctcctgcctcagcctcccgagtagctaggattacaggcacccgccaccacgcccagctaatttttgtatttttagtagagacggggtttcaccatattggccaggctggtctcttggccaggctggtctagaactcctgacctcatgatgcgcccgcctcggcctcccaaagtgctgggattacaggggtgagccaccgcgcctggcctctcccacttatcttttattgatcataagatcagcccagtgctttcagcctctttttgtactttggcacctggggaggagctaaggcctacacctctctgagtggaagagtttcctgggcagccctgtgtttggtcccaaccagttattcagcatggtccatattggcattattttgggtggggcacaagagttggaaataagcaataaataaaatacaaaaaaattcatgatgagagagaagagaccataagaaattagtgaagagccacatcggaaaattgagcagatgctttgcacataaaagcaacagttataataagaggtattattattatagttgtttttgtactttgtggggttgttcggggctttccagaatcaatatcttgttgttagaagaaagactgggctgagtgtggtggctcatgcctgtaatcctggcattttgggaggccaaggtgggtagatcacttgaggtcaggggttcgagaccagcttggccaccgtggtgctaaaaatctctgctaaaaatatatctcaactaaaaatacaagtatgagctgggcatggtagtgtgtgcccttaaccccagctacttggaaggctgaggcatgagaattgcttgaacccaggtggcagaggttgccgtgagcagagatcacgccaccttactccagcctaggagtcaaagcgagactctctcaaaaaaaaaaaaaaaaaagaagaagaagaaagactattaagtttcatcagtcctacaacgtttataagtcattttacaaacattatcatatatggtcctcacaacaaccaacttaatatccctatttgacagaagtctaacctgaggctcagggagacttagatttggttaaggtcccacgctgtaaaatagctctctcagattcatgcatggtgtttctatgagactacactgccttttactcagaggaggcatttgaactgaatctaaatgaaaccttagatggtgtgggccagaccagaatggggacctgcattcagagaagcaagtgctccccacgaagaggtcaaggtccgtgtagaggaagtggaactcacaaggtgagggcagcttatggacgagaggaatgaggggcccttccggggaggtgagggagagcatgtgcccacacggggctgagaggcttcagttaagagaccaggcttgtcaggacagcatgcactggtgtgttttgacagagaggagaacgtggagcaaaaggaatagattctaagatctttgagggcaaagactgctcattcctgtttattattcccaatacctgaaatagagtaaatacatcataaatgttcacttgaaagttgtgtggcaggttgaagccaagccaaggagtttagggttgaagccacagcaagagagggcttgtctgcctttttagagttcaataataatgccatgatgtatttaacttttattttggtttcaggggtacatgtgtaggtttgtgatataagtaaattacatgtcatgagggtttggtgtacagattattttgtcacccaaagagtaaacatagtaggccaggcccagtggctcatgcctgtaatcccagcactttgtgaggctgaggcgggtggatcacaaggtcaggagatcaagaccatcctggctaacgtggtgaaaccccatctctactaaaaaatacaaaaaattagccgggcgtggtggcaggagcctgtagtcccagctactcgggaggctgaggcaggagaatggcgtgaacccgggaggtggagcttgcagtgagccaagatcgcaccactgcactccagcctgggtgacagagcgagactccgtgtcagaaaaaaaaaaaaaaaaaaagagtaaacatagcacccaatagatggttttttgttttttgttttttgttttttgtttttaagatggagtctcactctgtcgcccaggctggagtgcagtggtgcgatcttggctgactgcaacctccacctcccaggctcaagcaattcccctgccttagcctctcgagtagctggaattacaggtgcatgcccccatgcctagctaatttcttttgtatttttagtagagagggggtttcaccatgttggccagactggtctcgaactcctgacctcaagtgatccacccacctcggcctcctgaagtgctgggattacaggcaatagatagtttttctatccttattctcttcccaccctccacacccaagtgggcctagttttctgttctcttctttgtgttcatgtaaactcagtgtttggttttcacttattggaggtaaacattttgtgttcctgcgttagtgtgtttacgataatggcatccagctccatccgtattgctgcaaaggacatgaccttgttcttttttatgactgcatagtattctatggtgtgtatgtacaatattttcttttttcagtctactgttgatgggcatctaggttgattccatgcctttgctattgtgaatagtgctgcagtgaacctatgtgtgcatgtgtctttatgatagaactgtttctactcctttgggtatatacccaataatgagattgctgggttgaatggtagttctaatttctttgagaaattgcccagctgctttccacagtggctgaactaatttacattcctaccagcagtgtataagcattcccttttctccagaacctcaccagcatctgttatttttttactttttaataatagcccttttgactaattctgtgatttttaattaatgaaacttgcagctcccgaggtatggtgagtgtggtgttacaggaagattgacctggcaatggtataagttggtgaaaaggtgtaagtcggaggcaaatactgatggagatttgggagtctgctgtggaatataggggggagattccatgagacttttggggaggcagctttgtgtgatgaaaataacaggactttgaagtcagacaaacctggatttgaatcgtggctctaccgtattctagctgtgtgccctaggacaagtagcttaaactgtcaacttcagtttcctaatccatacaaacggggattaatatatgtatctcagagagccgctgggaaaaataaaatagatgtatgcagatcttgtgttcctaggaaatattcaataaatgttttgattttgtgtcctcctttttgccaaaggaattattgatcagaagttgataagtaatgggatttgagactccagaatgtgctgcctaaagatggtgactataatagaaaaattagatgttggggtttgtttatttgtgtttttaaaaggagatgggagcttgctgtgttgcccaggctgaccttgaattcctgaactcaagtgatcctcctgcctcagtcttccaagggactgggactagaggcatcactgcacccagatcaatgggtttttttcatgttaactttgagtgacagcctagttgagatgcctggggtagaattggtgatatggggccaaaactcagctgaggcttgagaggggtgaattgtgcagagacattgatttggagagtcctcaacaaaggaatgaatgctctgatcaaagagtcacaagatcaaaacagagaccaggctgttggtgttccatgcgctcatcaacgctgttgattagcattaccccatcctaggaaacatgacaggttgcttccagatgttaccttcaagatctgcattcctttcagattgctcgtcttctgccacagctagcaagatttgcccgaacattgaggtcacagcctcaaatgagcccctcaaagcctcagaatgacaggagagaagcttggtcaggcactccactggcatctaaggtagactgagctctgccaatttccaaagacagatggggctgaagagccaagttttggtaacatggacaaaaaccaaagcaattccagatgttagagccggagcagccagcgcctctgttgctttccacccctgtagcattaaaattagagagcaacagccaagtaatgaagcctgggtcactccccatctgtctcactaaatgccatttggaaccagtgccttttcatttgacagtaaaatcaatgaatgaaatatcgcagggttgaaagtgatgctgttcagaattcattatgggcgatgctctattccaaaggatggaagactcagccctctgcactttactttccggtaacatcaacacatctacttaatgaaacttgaaccttctgttaatccttcacctatttgcttttaaactgagtcgttttgaggaaagtctaaaggccttctctctggattctgcctcttaatgaattagctatcacaaaaagttggaagatgcagcagtttaaggaaagagggactagttaattaggaaaacagcttgagattggaggacttttgccaataatcactgggtcccttatcagccaacaccatttcctttgaattgttctttcctgttgagaaatgtctcagcactgagcacaccgagctgagggtcacaatttgtacaaattcagatacagctatgaggtgggagagcaaagaagggtggcaaagagaagagggaatgccctcactcttggaattaacacctgcctctggaaaaatggaagacacagttgaaacaatatcattcctttataagtaatgaaaactaggatcaacatgagagaacagactcttttttttcagagagttttgctcttgttacccaggctggagtacaatggcacgatcttggctcactgcaacctccacctcccagattcaagtgattctctcctgcctcagcttcccaagtaggtgggattacaggcgtgctccaccacgctcagctaattttttttgtttttagtagagactgcatttcaacatgtttgtcaggctggtcttgaactcctgaccttgggggatccatcctcctcagcctcccaaagtgctggggttacaggcgtgagccaccatgcctggtgataacaaactcttaaggtgtgtgtgtgtagtgtgtgtgtgtatgtgtgtgtgtgtgtgtgtgtagagagagagagggggtgaatgaggccagggctcattatctgctgccctttctacaacagaagtgttctttccttgggatagtgggtgtttgatttatgtaggggtattagacaaaaaaagaaatacctgggatgacaagtaacattcacagctcatctaagaaatatcttcaaatttaatgcagccttccttttttttttccttcaacaaatatttattgagcacttactatattcccaccaggtcctagaaataataagtcatagacttcccacaagagcctgggtgttcaagtatgacagagagagagagagagagagaggcaagagaaaaagcaagaaaaaaaaacagtgatgggcattagaaggcaacaaagaaagagagaacaagagtaaggcagggcagggaaagctacttcggagagagggacatgaagtaaggcttctccaaggaggagaaattcaagctggaaacacagaaaggcgctgaccatgacaagagttggggtgagcatttcagcatgtgcgtgggcatgagacagggcagagctggtggtcttggaagggtggaaagtccaacatggccggggtatagggagtgacaggtggtgttatgaaattaggatggaaatgagcggggacatattgggtagggacgtataggctaccacagtaagtttgggtttttatgtctagacttttcgagtagggaactggatgggagaagacgtcatggaagaaaggtgaccacttagcaccaggtaagaaagttggtacagcagtatttgcagatggaggtggctagatccaagatatattttggagttagcatgatagggatgccattggtgagagagaggaggaatttgggcagacgcagattcctgttgtgagccacactaggaggatggagtcactgtcactcagccttttaaggaatgttcttggcacatcagcagtgcactttgtctgtgccagggctggagaagcaaacaagtgtagaatgcagttccttccctcgctggcttcacagtcaaaacaggaagatggacgtgtgaatagacacttaaagaacgccttatggtactggcacccacctggaggttttctgcagaacgccctgcaaagcctattgtttcctcatccacaacccccatgtttgttttgttgcaatcattattgttttgtttttgttggtatatgtgaaatctatggcatatgttctacttgggaaggagcatatataatgtttacattctgtttaaagagtaataaacctaacatccatgcacccaccatccagcttaagacaaatcctcacccaaagacttggagctccatgtggtctttgccccagagctaactattgcaccaaattttggatttatcacttccatgtactttgtggttataacagtcacgatcacaagcaatatgtatttcttttgcctcttttagctttatacagtggaagcattctatattaatacttctgtgacttgcttcttttgctcaaattacgttagtgagatgcatcaatgtcgcgccatgtaaactgagttcattcatttcactgatgcatgtgaataagtcacattagattgatctattcttttgtcataggacatttggatgtttgccatttttggctattcctaatacttctgtgagtactatttatgtatctcctagggttttcctgagaggttacatgtaggagtgggttagagaatgtgtgtgtgtatgtgtgtgtgtatgtgtacgtgcatgtatgtgtgcatgtgtatgtgtgtgtgtgtgtatgtgtgtgcatgtgtgtgcagtgtgtgtgtagtgtgtgtgtatgtgtgcgtgggtgtgtgcatgtgtgtgtatacacagtcaactttattagtgactgccagtgattttccaaaatggttattccagtttacacccctactagtgatgaagagttcttattgccacccatcttaaccagttcttattcattattgtttcacattttacgatcttttccaatctagaagaatgatacctgagatattaatttgcattttttcatcattaatgaggttatacattaggtatgtgcattggctggttgaatttctgagaaatatttgtttatatcttttgcccattttttttgttgctcatcttttccgtattgacttgtagccgttctttatctgttctgcaaactaagcctttgccaattttatatgctgcaaatatcagccttcagtttattgcatgtctaatttttatgatgtcttatgatgtgctgaagttctgcactgaagttgaatttatcagtcattttttttacggtcttacatgtttttggattcgacttatgaaaataaaccaaaacctggggtcataaaaatactcttcttattgtattctaagtttttgaaaggtttgcctttcacatttaactccttcattcatatgggattgaatactttttgtatggtagtgatttgttccaagatttttttcattaccttttccatgcttatttgtcacagatcaagttcctatatatgaatgaataagttccattggttgtttatgtattcctaagtcaatactacattgtgtttagattattatgcctttataataatcctgatagctagtagtgctagttttcttacctgctctcctcccttttttataacttaaaaattgaactattaaaaacgtaaataaaacgggtgcagtgtcccacacctgtaatcccagcactttggggggccaaggcgggcagatcacctgaggtcaggagttcgagaccagcctggccaacatggtgaaaccccatctctactaaaaaatacaaaaattagctgagcgtggtagcaggcacctgtaatcctagctactagggaggctgaggcaggagaatcacttgaacctgggaggcggaggttatggtgagccgaggttgcgccacggcactccagcctgggtgacagagtaagactctgtctcaaaaaaatatagtaccagctcaatgaattgtcacaatcttggctgttcttaaccatatatattttgggataagtttgtcaagttctttacctatgtacaaatacacatacacacacattgggattttgattgcaattttatttctatctataaattaatttgatgagaattgttgtatgtgtgataatgaatcttcctatctataaacctgatttgttattattttatttgttctttaatatcatccaataacattttgcaatattccccttaaagtcttgtacatcttgtataatttatcagtagacttcaatttttttatgatgtaaagagtacttctagtaatgtgttttttgtctattttgaatacaaattcatcagctttttttgtatttgtattttcttttatgtcttcttccctctttttattttcagagtttttcttttaaatgatatatagttggatttatttaaattcccaaatgaaaatctttcacctaaaaagtaagggtctatttactagattgcggccaccaagatggcaggtgttatttctgccacttgatattgtgctttctagttgtcatactttttagatttcttcatttctcctttctaaccttctttagaatgactgtagatttttatttctcattctaattttaacccccactagattgaaagttatataccaagaatcttaacatgaatatttaacttcaagtctgaaattaatatcttcactcttctccaacacagtgtgagacgttagaaagtttaatcgcctccttctgagttacatgcttgttattttaaaagtttgcttgttctattttattcttgttcaaatttcattaattagatagccttgttgatttttcagttggtatatatattatttttattttttgagacagagtcttgctctgtcacacaggctggagtacagtggcatgatcttggctcactgaagcctctgcctcctgggctcaagcaattatcctgcctcagcctcctgagtagctgggattatgggcacatgccaccacacccggctaatttttgtatttttaatagagatagggtttcagcatgtttgccaggctagtctcaaactcctgacctcgtgatccacccacctcggcctccctaagtgctgggattacaggcctgagccaccacgcccagcctcagtgggtatatttttaaatgtttatctataaagttgctgtttttttttctcactattcttcacatttcagaccttccttctgggattattttccttcctcctgaagtatatcttttaaaatttcccttcatgtaagtgcctagtactagtagcatctgttttttattatctgaaaaatgtctttattttgccatcccgaagggtgtttttcctggatctacaattcttggttgacacttattttctctcagcacactgaaggtattccactcccttaaggcttacattgtctctgttggtaagtcagctgccagtcattttttacttctgcaacatttatttggttccttttcaaatacacctggtcatttttaacagttttcttgttcttttatcataaaattgtataatctgtatggttatctattcatgaataataaattaccataaaacttagtggcttaaaataattggatttgttatgtctcatagtttctgttagaaacccaggaggagctcagctaggcaaatgtcttctgggatctctcatgcagctgtagtcacacatcaacatggagggataattgacttctaaggtgactcattcaagtagctgtcaagttggttcctgctataggccatgggcatcatttttcctctatgtgggcctctccatagggcatcctgagtgtccctacaacatggagattggcttctcccaaagagagtaaacaataagagacagagagagtgtgtgtgcctgtgtgtgtgcgtgccaggcataggtcataacattttttttttttgtaatttctctttttttttcttttttctttttttttttaaattatactttaagttctagggtacatgtgcacaacatgcaggtttgttacatgtgtatacatgtaccatgttggtgtgctgcacccattaactcgtcatttacattaggtatatctcctaatgctatccttcccccaccccatgacaggccccagtgtgtgatgttccctgccctgtgtccaaaggtcataacatttttattacctagattcacatgtcccacaatatcacttctgtcccattctatttattagaaatgagtcactgaaacaattcaatgggagggaatctctgccttttaaagggaagaaagggaaagaatttagggacatattttatttgtttgtttgtttgtctgttttttagagacagggtctcactctgtggcccaggctggagcatggtgacacaatcatagctcactgtaacctccaactcctgggctgtagcaatccttggagacatattttaaaaccaccacctacttcctattatttcttgaaatatattaaacagattttccttatgttctgtacatgatgattttatcagtcttctggggttgaattcattgttacttctgcagtttttgtttgatgttgtggtaagttcgtgttcttggaaatttatctttgaggccaggttttaaaatacagtcctctagataggatttgtatttgcttctgccaggctacaagatggttggctttcagaccaacaagataggtatgattctggcccccaaactccctgagaatgggcctagaattaagaattctcagtggagatcactgtcttttacccagacccaaggctaagacaggcaaatttcctatagaactggctccttacttctttacccatcaaaggtgtgacttctgggggatcctgtctttacgctttgttctctagggtgtttttatgtaatcctgctcttcatctcattttcctgtgtttgccccattaaaaccaatgcttaattccagtagggataggcaggctccccagttcaggtactgccttcagcttgcttagctctcagggtctgtgctatcttatcagtttccattattgactcaagatctgccttatgttcttgcctactcatctatttctgttacacacagataaatgcatgtatgtgcatatatacatgcattatttttacatagcatttttatgtgtttttatgccagagttttgttttccatgatttatttttctctatggtatcagacaccaaactacccaggaagctctttagaaatacgaatttgctggcccaacccagagttaggaaattagcaaattagaatcttctgagatgggtaccaggtacctatatgattttttaaaacctccccagaggatgctgatgcctgtcactgttaaagataattattataatgaagacatggtccagaagcagtggaagctcagcaagagagctaaatttggccgacacaaccgaggaaggctttatagaggaggaaattgcatttcgcctttttaaaacatttcctctcatcctttgactgctacagttagctggacagtatgtaagccccttagcgccatgccatgcgtttgaagaccccagggggatgtccagaggcagccattgtctcactgtgtgtgtagcaaggtcgtgggacttagccactttgcaggataagattctgtagcacttatcagtgcccatccacttatctgcccattgcctaggctcagagccactatggaccagcttacagagcaggaacttgccagcattgttcttgggtgctattgggggtatgaattgggctgtctgggctggcggtgtaatgtaaatatcagataaattgcctaggctcagagccactatggaccagcttacagagcaagaacttacctacattgtttttgggtgctattgggggtgtgaattgggctgtctgggctggcggtgtaatgtaaatatcagataaattgcctaggcccagagccactatggaccagcttacagagcaggaacttacctgcattgttcttgggtgctattgggggtatgaattgggctgtctgggctggcagtgcaatgtaaatatcagataaatgtagcagggaggattctatagaggcgataactctcagaaggttggataccattatttcacaacccagagctgtgccaaaccctgcaatgtcaaaaaaaaaaaaaaaaaaaaagagagagagcgagcgagctttgtttgactttactgttcactgccctgtaaaagactttcacggtggatcatgctcctcgatccacattgagagcagatgctaaacagtgcctgaggcctgtgcatttggagggaagaaaacccagtttgaatctcagctctacaacttattagcagcatgacaaggatttcactgcctctgagcttcagttttcgttctgttaaatggaaggtaaaaatacctatcttgacattgagaacacatagacacagagaggggaataacacacaccagggtctgttgggggccgaggggtgatgggagggaacttagaggacagagcaataggtgcagcaaaccaccatggcacatatatacaaacctgcatgttctgcacacttttttttattttagaagaaattaaaaaaaaaatacttgtcttctaaggttattggaagacttacgtgaagcaatgtattttaaatgccctatactatacctggtatctagtggacatttctgtttattatttttgctgttgtgattctgaaagaccctaatggataagtagggcaaggattattttcatgttctcgtgtttagcatatgtaatgcctgctcacctctgcattcaagtcaagaccagacttatgtatccatagcttgagccaactcttccctctagatttagttcctaataaaaaagtaaaaatgggctggacacagtggctcacgcatgtaatcccagcactttgggaggcctaggtgggcggatcacccgagatcaggagttcgagaccagcctgaccaacatggagaaaccccatctctactaaaaatacgaaaacattagccgggcatggtggcacatgcctgtaatcccagctactcaggaggctggagaatagcttgaacccgggaagcggaggttgtggtgagccgagatcacgccattgcactccagcctgagcaacaagagcaaaactctgtcttaaaaaaataaaaaaataaaaaataacagtaaaaatagacatttttggccgggcacggtggctcacgcctgtaatcccagcactttgggaggccaaggcgggcggatcatgaggtcaggagatcgagaccatcctggctgacacagtgaaaccccgtctccactaaaaatacaaaaaattagccgagcgtggtggcagcacctgtagtcccagctactgggaggctgaggcaggagaatggcatgaacccgggagatggagcttgcagtgagccgagatcatgccactgcactccagcctgaacgacagagtgagactccatctcaaaaaaaaaaaaaagaaaaaaattagacatttttaaaatttattaaacaaatatgaagtatctggcaccaagttagatggtttacagatatggtctctagtctttataataaacttcaggtaggttttattagcctcatttgacaagagcaaaccaaagctcagagagtaaaagatgctgaaagattatacacttggccagtgggtaagctgggatttgaaactaaggttgtgtcgttttccatatacacacacagcctctccttcaccttatacttctctaccacaattgctgtgctcagggtctttcctcagcctggaaggccttctacctcccactctgcccaataaactcttacttattctttaagacccaacacaaatgctgcctcccttgtaaggctttggctccctcaggtgcaaaaaaaattactcttttgcaatattttcatgggattttacttacattccttttttgtacacttttttgtacacttttacttacattccattttttgtcttatgtctcttaggcatatacatgtcttttgtacttatttgtagtgtgtttgaggtcagcaattatatctttttttaatttaataaggactatcctttatacttcataaatgttgattaaatgtttattgaattaagaaatacaaattaggccgggcttggtggcttacacctataatcccagcactttgggagccctgaggcgggcagatgaatcacttgaggtcaggagttcgagaccagcctggccaacatggtgtaaccccgtctctaataaaaatacaaaaaaaaaaaaaaaaaaaaaaaaaaaaaagagccaggcgtggtggcaggcacctgtaagcccagctacttgggaggctgaggcacaagaatcgcttgaacttgggaggcagaggtttcagtgagccaagatcacgccactgcactccatccaccctgggtgacagagtaagatgccgtctcaataaataaataaataaaaattatgttcagaaaagttgttagacagatacattcttaagtatgtttgtccttacatcttcagtgatgctatacaagtgactaccatctcttagcaggggaaaaagttgacacacatttgccttagtgcctggctttgcccttctctgcgaagtttccacattgcaagtgcacaagtaaaggaccttctgtctacccaagttttataagttgcagaagcttatttgacttgatcatatctcctgttcccagtccaggtctttatctgtggcccctccagcttcttcattacctggcacataattctacatttacagaagggcactggaccgcatgttgagttctattagctcagagttgcagctgcttccatgaacaagttcttaaaatgattcatcatgaggagacttacacctaagttactgggtcactgtcactgaaaaattgcataagtggaatggaattagaatctctcaggagctaaaaggttgcatttacaacaggttctgccatttctatgatgtctttcattcaatgacacttcaatagaaagttaattgaaatggaaaagatcaagcacaaagacaaaaagcaaaaaggactttacaagatgtttagccttattccatgctttgatgaggcatagatgtagaagccacaggcaagccaaaaactttgtttcgaaaactgttaaaacaataatatgtccaaaattggcctgtctccaagaaagattcacagtacccaaaattggggagtattgatacagcaaatacggtaggtcagagtcattagatcctgtggaagattctcggtatagatggggttggtgattgtgtctaagtcttcagtggctcaacagctatgcaataattggcagccacagaatcctggaccatcagaaccaagaacctttgtgggttgttctgtggaaatattaatgatcttattttgcaagagtggaggtccaggtctaagaacaagtgggcctagcctggaactcagatctcttgttgcttgtttccaacgtttacctgtagtaattgctcagccagctacaaagctggccttagcatacggagaaaatgtacagacaaatcattgctgtgtgatgggagaatagctgtggatagggatactttgcagtcacaatattgtctctgagtgagggtccaccaattagagttagatgtcgtgtttcttgcagccccgatacccacaatgcagtttcaaataccagttacttaaagcaaagttagtattcaaactcactcttcacgcacaagaatgcagactccgaggagacttctactatccttcccagttgtttaaaccaatagcaatttttttttttttttttttttttggctgagacagagtttcactcagtcgcctaggctggagtgcagtggcatgatctcagctcactgcaacctccgcctcctgggttcaagcgattctcctgcctcagcctcccgagtagctggaattacgggcacacaccaccatgcccggctaattttttgtatttttagtaaatacagggtttcactatgttggccatgctggtcttgaacttctgacctcaggtgatcctcctgcctcggcctcccaaagtgctgggattacaggcacaatagcaatttttttagcagctcaccatggtctaatctttctaaagtagtctattttgttttcagaaaaacaactctcttcccacactgctaattaatagatgtacataatattagagttctcaatggtaagaacaagaaatgacataaaaggtttgggaacaaccacaagtcactcttggtaagcacccagcccaggtggtggaaacagcagtgtgtggacataccagagtgctgcttcgagtgagccatctgtgtgccctgcacatcagttactataaaaacattcctggcaaaaaggaagcattggcaacaaggcctcaatctattgccatccattccctcccttatggacccaggaaagaaagaaaggtgtcctgggtcaagtcttaaacacactgacagaccttctgtcaaacacacatattaatacattaatagcatttgctaggagagagtccttatctgtggattgcttttagcagtacgtaccttgctatggtttggatctgtgtccccacccaagtctcatatccacttgtaatccccagtgttggaggtagggcctggtaggaggtgattaggtcacaggggtggattcttcataaatggtttagcaccatccgtttcatgctgttctcatgatagagttctctcgagatctggtcatttaaaagtgggtggcacctccccccattctttctgctgctcccaccatgtgagacgtgtctgtttctgttttgccttccgccatgactgtgcattccctgaggcctccccagaagcggaggctgccatgcttcctgtacagcctgcagaaccatgagccaattaaacctcttttcttcttcttctttttttttttttttttttagacagagtcttgctctgtcaccaggctgaagtgcagtggctcaatctcggctcactgcaacctccgcctcccggattcaagcaattcccctgccttagcttcccaagtagctgggagtacaggcacgtaccaccacacccgactaattttttgttttttcagtagagacgggatttcaccatgttggccaggctagtctcaatctcctgacctcgtgatccacccgcctcagcctcccaaagtgctgagattacaggtgtgagccactgtgcccggcctaactcaactacttttcttataatttacctagtctcaggcattttttttatagcaatgtgagaatggactaatacatacctgaactaggattactatgggaaacaaatctgtaattattgggtttatggtacgtgcaccccctggaaaacagcacagaaactctgtaattgttggaatataaaattgagatgtttcatgaccgacatagctctgttcagtgcaagcaatgatgcatacacaactcagagacctcatatgttaaatcagggccagaacacttttccatgtggcaaggaattggaaagtggtattggtggtcctgggcttctctctgccttgcctaataattacttgacactaaggcaatgagctctgatatttgtgattctgatcctttgtgttatctcaattgcttaattcagtgtattgattagacattcaaataaaacagcctctggtagatgttcaaaatgcagtaggaaaaagacaaataactggtttttccatttttcaaagagattttgttagaaatctcttatgagagaacccagatctctagtggaagcaaaaccatcatagaaactggaggttggaacaaagtccgttcctaggtgagtttagcgagaaccaagtaaaaaaaccaggagccaggaaagacagatggacacagacagaatgaagatgggctgcctcagactgccagtcagatgtactccaaatcacggtgcacgcagaggacctggcttttcagtgataagagtgaaccattatctcactgactgtagctgactctctacaattcttggtagctttataaactctcaccaccagtggtggtagttttggtcactccctgggagatcagactgaagtatgtagctgtccaagttaagagtgaagcaacaactttttttttttttttgagatggagtctcgctctgtcacccaggctggagtgcagtggcacgatcttggctcactgcaacctgtgcctcccaggttcaagcgattctcctgcctcagcctcctgagtagctgggattacaggcgtgcaccaccatgcccagctaatttttgtatttttagtagagatggggtttcaccatattggccaggctggtctcgaactcgtgacttcataatccacccgcctcggcctcccaaagtgctgggattacaggcgtgagccaccacgcccggcctgaaacaacaacctttcaatgtcttagctttagcactacaaacctgtctgtagagatgatgaagttggcttgtctctgtctattcagtttccttctgggaaagctggagggcaggccagggtggtatggcttaagcacacagcattctctggttccttgctgcctttcaaacaatcctccgtcacggtaattcctctctaccaggcctttggcaagccatagatagtagattgtgcagggttcatttcttgaagtaaaggaaatgagcatgttgtaagctatagtatccattaattagaattgtaataattttgagtaaggaaaaggatggaaatgcctcagctgttttcaaggggtcgtatttaaacatctagacctctgagctaagggagcgtgttgtttctatgcagtctcctttatgtaccccagatgggcgctcctgccagcacctttgatggcgctgaaatgctgttctgacaaatccaccgtgtggccttcctcaccgattcattctcaagtggccttgagccctaaataaggaacagatgtccccccaggcagagttgccctgccactcgctactaaactagtgacgttttccagattgagcttgtgacaacagcctctttatgtggcccgctcacctgagacaggtgtaccaggcctgccatgggccccttcctggaggagaagccaccacctctaccttctctgccactctttcttcttttgctggcattgctctgagcaggggaaatggcctttctcctcaaatgtcacctcagctgtgcttccccaagcccctccccctttctgctgcataggccacccgtccttcaccctgcacccttgctgtgtccccttatctcctttcctttttgtagcatctcttgtcaccacttagcatttcattacatatttatttgtggtccagctcccgcattggaatgaaagtgccaacaaggcaggaatttgttttgttttgtttttttaaacactcaagagtccagaatagtgcctgacgtatagtcacctctcaataaataactgttggatgaataaatgtgtagatgaataaacaaacagctgaatgaacagatgagcagattcgggttggaatgcgatctctgactccttgtgaagaggaacctgggtgtaattggagaccattagtctcagtgaagtaactcaagagtggaaaaccaaacgttgtatgttgtcactgataagtgggagctaagctatgaggatgcaaaggcataagaatgagagactcccggccgggggcggtggctcacgcctgtaatcccaacactttgggaggccgaggcgggtggatcacaaggtcaggagatcaagaccatcctgcccaacatggtgaaaccccgtctctactaaaaattcaaaaattagctgggtgtggtggtgcgtgcctgtaatcccagctactcgggaggctgaggcaggaaaatcgcttgaacctgggaggcagaggttgcagtgagccgagatcatgccactgcactccagcctggcgacatagcgagacttggtctcaaaaaaaaaaaaaagaatgagatactcccatagagtggattttggggactcggtggggaaagggtttgagggggtgagggataaaagactgtacattgggtacagtgtctactgctcgggtgatgggtgcaccaaaatctcggaagtcaccgctaaagaacttattcatgtaaccaagcatcacctgttccccaaaaagctattgaaataaaataaaataaaataagaatttttttggcagctgagcgttcttttcttggtggtcacctacgcgcatatagacaaatgtgttccctctcttgttctctcccaccgctgcccacccccatctctgaaactttgccagatgaagttttttctaccctgaacttggatgcctccatcggaaaggatatcaaaactattcaaaggcagtgtcttacatgttgggattgttggtgatttaacgccatgccaggagaagaccactagctggccattgtagctgtgttgtccttggcttgctaagggagaattctctccgaagagggcagtggcaagagggagatcagtgggctgcgtctgcactggctttgctgacagagccatactctgctttaccccgtgtttatgtggagtgtgtgctgttcagcatttggaggtgttggatgagaaggctcttgtgtgtgtgatggcctaaacaaagccaggatccgtccagacaccccattctagctattaatttcagcaaccttcatttccaggctgatactgcgtggctcataaggacagttttgttaggaaacaagggttctggcctttactcatctgtgtgatcttgggaatatcatttaccctcacagcaagtcagtttcatcagttatacgatgaaaagattggactaaatgagtattaaggtttttttccaggtgtaatatttttaaccatattgagatccatttatttatttatttatttatttatttatttatttaacagaatcttgctttgttgcccaggcaggagtgcagtatcttggctcactgcagcctctgcctgctgggttccagcgattctcctgcctcagcctcctgggtagctgggactacgggcacccgccaccacacctggctaattttttttttttttttgtatttttagtagagatggggtttcaccatgttggccaggctggtctcaaactcctgacctcacgtgatctgcctgcctcggcctcccaagggatctcctctttatattggagttctcatgttctttttctcatcattcaaatgagaagtttggtccaaaatatcctacaggcccttgcaactctgattcctgtgatgtgatgctgcatcaaattttttaaaagtacaaaagcctcggccaggtgcagtggctcacacctgtaatcccagcactttgggaggtggaggtggatggatcacttgagatcaggagttcgagaccagcctggccaacatggcaaaactccgtctctactaaaaatacaaaaattagccgggcgtggtggcgggtgcctgtagttccagctacttgggaggctgaggcagtagaatcacttgaacccaagaggcggaggttgcagtgagccaagatcacactgctgcactccagcttgggcaacagagcaagacttctcaaaaaaaaaaaagtacaaaagcctcatcctcgatgcaagagtccccttagacatagcagactgtttataaacatgagggacgcagtcttcttgatgggcatcttcagggcactggcagccaggaatgtgggttggggctcaactttcttttgaaagtgggctggcttggccagcatattgtttccttggcaaaagactggcaattgattgctctcctcgaagcatgtgctttgagacgcatatataccaggcagcctaacccaaagttgatgagaatgattcagaaaccttggtttttcactgaggatgttaaggaagccaattgtgaatctcaccatagacggagcatcttgtcttgtgagtgaaatgcggttgtagctgtaatgaactggcagtacataccatctttggagtcagagtgcttgattgcaaattttagatctagaaaattctgctacattgataatctaaaacccacacctgtggattctccattgcctcccctttatattaatacaataccacaaagttgacttctgctcttaccctgggggagctctgcacagccctgcctagggatactccttttctgcgttcccttcctctttgctcaacagctaaacagtggagagccccaacactctgccttggtcttctctataagcatctcctttaaatgagctcacattttaaaatactattcatgttccaatgatatgcaaatctatagcttggatctcgggcagcttggatctcaggcttaacttacggaaaacagaagtcttgattccactcaaattatggtatatccatacttggaaataccactcagcagtaaaaaggaaggcagtattaatacacataacacttggatggatttcaaaagcatcatgccaagtacaagaagtcaaacaggaaaaactacgtgctataagattataattctatttttatgaaattctagaataagctcaactgcagtgacagaacgaaaatcagtggttgcctggagcgggtgtgtggggaagtggatggacccaaaaagagcacaagaagacttcaggtccttggaacagttctgtatcttgatggtcgtggtgcactacccatgactgcacccagttactaacatttgctgaactgcacttaaaatgggtgaattcattgagttgtacggtacttcaataaagttggggaggcagggaggctgactccacagttttctggcttaagggagagaatggattgccattgactgacatggggaaggctgagggaagagcaggtgtgaggggaaaaaacaagagtttgatctgggacaccttaaagtctgagatgctgagctgatcattggcccagaggggacaagcaagaccacagggctggacagagagcagcagagctctgaagactgtgtcctggagccccagcatttgtggtgaagattaaataggataaactatgtgagaatattaccgacatataccaagtaatactttcttttcttaatttattgtttaattaacaaataaaattgtatatactaaggtatataagccgatgttttgatatttgtgtacattgtggaatgaccaaatcaagctacttgacatacacattccctccaagtattactttcacgttaccctcatcataattttctatggaggtgaaattcacatacttccatgtagttaacagttttaaagggtgcaatccagtggcatttagtgttttcacaacgttgtgcaaccacttgatgtctctagtttcaagatgtctttatcaccccaggaaaacaccgcgaacccaccaaataatcattccacacccccctctccctgtcccccattgaccactaatctgctctctgtctccgtgaatttggctattccgaatatatcacgtgaaatgtgatatatactgacttagtcatgcaatatgtgacattttgtgtctggcatctttcccttgacataaggtttccaaggttcatccaggtggcagcatctgttagtactgtgctcctttttatggctgaatgtgttgttattactccattcctttccacacaccagctccagagtgtgcatgagtatacttagctgagcccttcctccttccacccactctccccagcctgtccttcctcctcctccctgtgctgcacctgcctttgtgtcagtggtgcagcccacctgctcccgagggacttaccccacgcccagaagcacttcttcttcatccccaagacatacaccatagtaatttcttgaattcaccttcaccgcctctttggcagagccagattggctcctaacacaagccaaagtgttgcctttgtaacaattctattcagcaagcaggaagagagtgctaggaggctgtgcattgggacgtgctggggttaccagagctgcagagcccactgtgccccttccttccgggctcaagcccttatgtggatcacaggggagacaagcactctcacctcccggctcctggtttggccctcggcccctgcatgtcacctgtacacaggcccctcagaagatgttgctgaccatgatttgtgtctccagcccttacctctcccctcatctccatgcttgtgtatccatcatggaatatctctaaaagaaagaatgaaaagtaaatgcttgatttccacctgctcaaatcattcctgatcctactccacatagtggcaaggatgttctcttcaaaacacaattctgggccaggtgcagtggctcatgccttataatcccagcactttgggaggccaagacgggtggatcacctgaggtcaggagttcaagaccagcctggccaccatggtgaaaccctgtctctactaaaaatacaaaaattagctgattgcagtgtggcgtgcctgtagttccaactacatgggaggctgaggcaggagaatcacttgaatccgggaggcagagattgcagtgaaccgagatggtgccactgaattccagcctgggtgacagagcaagactctgtctcaaaaacacaaacaaacaaaacccacaattctgaccacatcagcacctagtctcaacactgccgtgtcactcaactccaagggacactgttcacgttgcctctgtgcagatggtgccctggtgtcatacagcaggatggtcctgcccgcctgttcccttcagtggttccccctgcttgtccttcgtggagaaatccccttactctggccttgaccacaaggcccccagaccagccctcctggcttcagcctcgtctccctcgccatctgctcctccatctatttgtctcagccacattgaccttgagtccctgcagaggtgttttttccctcctgatacaaagcaatgatcagattctgtgcagatacccactaagtgtcctgcaattcaattcaattcacttctgaccctaactacccagaattagtgtcaggctgcacgggcttaagagctccatcccacaaaaccaccatcacttcagacgccagccacacatagtggggccccaggctgcaaagtcagaggtttccatagcactcacctcaggttccataatttcttagaaggatacagagcttaggaaagtgttttactttctgttgcaggtttgttataaaggatacagcccaggaacagccatatggaagagatgtgagctatgggggcagggcgtggagcccccataccttttccagacataccatcctcccagacctggatgtgtttctacccagtagctctctgagccctatcatttagggattttaatgttggtttcattacataggcatgttgactaagtcagtaatgattggtgatcaattcagtctccagccactgccgcctccctgcaggttgagggtgaagttcaaagatccaaccctctaattctgccttgttacttctgtcagccagcccctattctgaagctctctaggggcctagtaagagtggcccccttagggccgggtgcagtggctcacgcctgtaatcccagcactttaggaggctgaggcacatgaatcacctgaggccaggagttcgagaccagcctggccaatatggtgaaagtccatctctattaaaaatacaaaaagtagccgagcatggtggcaggcgcctataatcccagctactcaggaggctgagacaggagaattgcttgaatccgggaggtggaggttgcagtgagccgagatcccgccattgtgctccagcctgggtgacaaaagtgaaactcttgtctcaaaaaaaaaaaaaaaaaagtggcccccttagaacaaaaggtgttgcccctgtcacccaggaaattccaaggggcttaagagctctgtctcagtgatcaaggagggacaaagaccaagtatttttctgagataccactttactcatccttgtcaagcttcctgctctgaggtcttaacgctcttcctcctgccttcttcctcccttcccgatttccttcagatgtctattaaatccttatttcatcagcaacctttttggctaacttcccacctttcagcattctggacctctctatctcagccatttctgagtcacagttccacaattgttggtgtgactgtttagtggacctcgtcctgttttatcagctgaattcagtcccccaaaattcatatgtgggagccctgaccccttgtcacctcacaatgtgaccatattttgagatgggaccttgaaggaggtgattaaggtaaagctaagacatgaagataggccctaatcccagaagactggtgcccttgtaagaagaggaggtggcggggcacagcggctcacacctgtaatcccagcactttgggaggccgtggcgggcggatcacctgaggtcaggagttcaagaccagcctgactgacatggcgaaaccgcgtctctaccaaaaatacaaaaatgagccgtgcatggtggtacgcgcctgtaatcccagctacttgggaggttgaggcaggagaatcgcttgaacctgggaggcggaggttgcagtgagtcgagatcgcgccactgcactccagcctaggtgacagaacaagacaacgtctcaccgtctcaaaaaataaaactgtaagctccactgagggaagggaccgcctcagccctgcttgttgctagactctgattctgatatagatgcaatgaatatttgttgaatagatgaataacttatctcatgatgttgacagagacctttgaaatacgcctttcattaaccttataccaaatgatgccaagccagcatacctttatccttttagtaagtcctggcttgaatttcatccacattcttcctcattcaacaagaattactacatctttataatctgcccaaggatcaggcttaagaatagaaagagattttgtgcttaagtttcctgaccacttcgccatgcaaggagggcctctctcatcagtagctgttctgagtgagccgagatcatgccactgcactccagcctggatgacagagcaagactccatctcaaaaaagaagaaaggaatactataaggggaaaaaaattaagcagtaactacttaaaacccagaaatttttggtaatagtgataatacttaatcaaaattggacagttattttacaatttaacaattcattttacagtcaaaacagtgttatgatagaagtaggatgagttttactgttatccactgttaaaaaaataaaaattaaagtttggaaattgagtcatttgacccaggtggcacagttaataattgaaaaagccagaacttaaatgttggccttatcctacacagaagtgcttattctacaaccccgctttgcagcattctggagaaattaacaaattaaacaatttctcctagacactaataatagtaagtcaaaggaatatctgtgagtgaagtatctaaaagatgccaacaaattctgttttttaaaaaagacaaatccaaaatttccatggatggaggttgtagctgggctgaggccagctctgccgcctcgtggaggcctcgtctgagaggtggcggcagccatgcgtcctgggagtcagtgttataaaagcagccttggaagagagcctagcagctctgtgttccttttttagtttttcccatttccaaagaccaaagatcacggaaggaagaagagaaaaatcattatttcagattgaactgaagtcttaaactgtaaattaagttaatgtgggcctgctggggatatcttgggggttggggagggtggacttgttcttggatcttggcagaagaaatcattatctggacctttattggactggatacccttttctgcatcttgggccttccttctctatgctcccgaggtgccctgggtaggatgtcctctcagctcaatgtactaggattaacactgaaagaaattaaactcagagcatcccagtgggcaccagagggttctgcagaggggcctgggctcctgcctgcaaccccaggtggcagtgcagacaggagcaggtgggctgggcatgcacttcgaccaccctttctccccttcctctctgtgccctttagagtctaccccatggtgatgcccgctgtagccattcccttggggagagaaatgctttgcagatgtttctaaccataagtgtaggtgtgaaaacatgggcttttgtaactgagaggtgggaatgcaatcccctactctgagatttcttgaccttgacatgtgactttatctctctaaacctcaatttcccttctgaaaggtagaaataagtacactgcccacctcgtggtgtcattgtatctctttgatgatgcatagaaagcaatcaatggctgggtgcagtggctcacgtctgtaatcccaacactttgggaggccgaggagggcggatcatgaggtcaagagatcgagaccatcctggctaacacggtgaaaacctgtctctactaaaaaatacaaaaaattagccggatgtggtgcgggcgcctgtagtcccagctactcgggaggctgaggcaggagaatggcgtgaacccgggaggcggagcttgcagtgagcggagatagtgccactgcactccagcctgggcggcagagcgagactccatctcaaaaaaaaaaaaaaaagctatcagtatcccagtgcctggaccaagtactaactagagggagcagcactgagaaaaactgactctgctcatagggcagctgtccatacacatatggacagcacaagtaaaagaagaacaagtatggggatgttcttgatgagaatgttgagaaaactcatcactgacatagcataaagagagctcccaatcaggttggaaggcagctttgaggtcttcaaacctagtcttctgcgcagtacagaaatcccccttcccacagcatgcctggtaggtgaccaccccctttcagaggtccccaaacctaccctgtatcagaattaatgggggccactgttgaaaaagaaattcccagggctcagcctgcgagtagctgcatccgtgagatttgaggcagagcctggcaaatggtagctggaccgtttgagaagctctttgtaaagataaaattcagaagggccaagagcgtgcctgttttcttccctgctgtgtctgtagcagttagcacagatcctggtgcagagttggggctccataaatacctgctggatgagggctgaatcatgcagcctcttccagaaccattccggtgatcggaagcttctccctagaaagggagctcatttctgttttgattaactgatggctagttatggtcttgcttataataagcaacgtctttcttcctctcatcttcacttattcagcctaactcttctttcaagagtgacacagattctgtttgctctcagaagggattatccctgagccatagttcagtaagggtggagtattttttccaagtgaaaggagggctgagtgatgaataaactgggttagaggtgcttcatcaagaaactgaaacccaagcaatcaaaatgagtggcaatgaattggagtacatagatcgcatctgaaggacatgcaatataaacctgggctccccaaacctgattaagagtcccagtgaagccctatgaaatagataccattttacacatgagaaaaatgaagaactgagagtttactcgatattacctatgagctgggtgtggtggtgcatgccagcactatgggaagctgaggtgggaggatcatctgaggccaagagttcaagaccagcctgggcgacatagcgagacccccatgtctacaaaaaaaaatttaaagttagctggatgtggtggcatacacctgtagtcccgtagctgctcaggaggctggggcaggaggatagcttgagcccaggagttcaaggctgcgctgagccatgattgtgccactgcattccagtctgggtgacatagtgagaccctgtctctttattaaacagagagagagagaaagagagagattacctattaaatatagaagagctagaacttaaaccaggtggagaattatattaaagttcaaagaggctggctgtggtggctcatgtctgtaatcccagcactttgggaggccgaggtgggcggatcacctgaggtcaggagttcgagactagcctggccaacatgatgaaatctcgtctctactaaaaatacaaaaattagctgggcatggcggcaagcacctgtaatcccagctactcgggaggctgagacaggagaatcgcttgaactgggaagtggaggttgcagtgagccaagattgtaccattgcactccagcctcagagacaagagcaaaactccctctcaaaaaaaaaaaaaaaaaaaagttcaaacaaaatagcagcagctgagtttgagacacataggaaaaaaaaacaaaaaaaggaacttcaagccagagttttggttttggctcctggctcttccattgactgcgtgtttctataaacaccgctcgcccttggcagtcttcatgtgcagtagtagatggttccagagaagtcattaagaccatcacagttcatctgactgtctgtgatcctagggtgctttgagctggagctgaactgcaaagtaggagctgtgaaacacacaggttcagaaattctccttttcagtctattcggggttgtttaaatatcgttctgtgtgcatcttctcaggaaatgttttcttattctacattgactagccaggaacacctggggctgtgtagcagctctttcaggaggtttagtaaacggtaatatgatattatatgttttcctacttacagacatcctgcactcagacacacattgaatggtgctattaaatgcttttctattttaaaatagcttattagaataaatatgaggttgggagagcactattaggttctctgctgacagtcagggcagcctctggttttaacattttaatattcacctagtggtataagcacagccggtttgatcagcagcagtgattggcagacttcctctgtgtgcccaggagcttttctgggggtggaaaaaaggagatagcactgaaagcatcctgcagatcacagctagagccacctgttcctggtgtttacctggagaagttaactagtacgcatctacttccactccattcagatagaatttaccaattccagatgggctaagatggtgggttgtggataatgtatattttttatttattcacccattcattcatccattcatccacacacctgcagtataatgggcccctagagcacttaagctttttaatcaaggaagcagaatcatcaaatttgtgctttcaaaacatttctgtggctaggtaggcagaatggaatggcacagggctaccctgaggaaaaagtgatcaggtacaaatctgctaatccaggagagagagagaggaggagagcatggtagagcaagggaagggatgaatttgagaaacactccatagataaaatctgtgggatttgggcatggcaaggatgtgaggaatgaggagcaggagggttcaagattgagtaaaaggcttctagctgtggtgacaagtttgatcttcatgctaccaaccaagaaaacaggtaggggtcacacctattttgtaggaggagaagattgtggagttagttttggtcagcttgcgttgaaagtcattgtggaacagccaaatcacctaagaagatggtgggctgatacatagattgaagagtagggcactttggaaagaagtctgagttaacatggagattggtgatcatcttccagtcaatagtgtctgaagccaccggagtagatcccatcatctgtggataaaatagagagtaacaaaagggggccaagaaggggagttggggagcaccagcatgttaagggtggcagagagagggaagctccatggaggaggtaggggaaggatgttcagagggagtacatcagcgaagggacagatgtcgccgacgctaaaggcttcagaaaggtggagtggggtgagagacagcagggatggggtgaggggtaatgtagccaaattttgcagagtccagtctatgcacctaaatgtcagcacttgggtaggaaaacctagacattatgaacactggtcatcccaaaagggaggaagagaagtgcctttagttgagcatctcccatgagccagcactttacatctgtcatccttttttttttttttttgagatggagtctcactctgtcacctagactggagtgcagtggcgcagtctcggttcactgcagcctccgcctcccaagttcaagcgattctcatgccttagcctcccaagtagctgggattacaggtgcatgccaccacacccagctaatttttttgtatttttagtagaggcgggggtttcactatgttggccaggctggtcttgaactcctgacttcaagtgatccacccaccttggcctcccaaagtgctgggattacaggtgtgagccaccgcgcccggccttgtatcatcttaatctgatctcaatatccattcttagaggtcagagatagattttatacttaaccttttatgataaggaaactcaaggctcagagaagctataccttggtcaaatcatacacaggtggggctagaatcctgttttgccaagttttaaaatcctttgtcttcctgatttatcatgctgccttctttatacccaatggacgaatgctcagctcagccttttcatgccagatgcactgtgtggaagaattgtagttctctgctccttggttctcacctcccgagcagcaggagccgggccttgagccaaaacctgcagaaggaagaagagaggagagttccctgcgtagagccatccatctgctggctggtgacaccaacaccagggccccagcagaaaagcaagcttgttcgctcttgtctgactgttagtagtgatgtatgaataagcaaagaagacagcttcattttcataagttaacttgtgcctagactaaggaagatggagaacagcgcacttaatcataaccacaggcccagcttggaaaacaatgacaaagcgttttctgtgagtcacagtgttttattacaataactcccaagaagacgagacaggcagtgcagaatgctgagcaagccagcaccctgtagccacctgtgtcatctcccccaaggaatcccctgggattttacctcttcacacgatggcaagctgaagatgtgtttgcaccatcaaggttacagctgtagacttgggcctctggagaccaggatttagatgccacctggatgatgggctgggattgctggaactgtcacagatcacctgtatcatccatgctgtcacctggtagcagaggggacttctctcctagaagggtgttacccgacagaacccttattggaaaagcttttggggaggcctggctgcagtgctggaagggatgtggtaggtgactcggtgggaagggagacatccaacttgtctagcaggtatcacccacttacccccacagaatcaattactccctacttattattcccccatcttgctaatatcgccctgtcactgctaatatcatgctgcttcaaaattgtttatctgtctcctcttctagctgcccccagggcaagaactatgttttttttgtctttcattccttagtattttgtgtggtgtctgacacaactcaaaccctcaatcgatactaagctgaaccaacgtctcagcaaactaagggccatgtcagctaaggacaggaggagatggctgagctggaggtccaggcagatggagcagagtgtaggaccagggagttctgggtgcttccataagagcaaatgcttactgaacgctttactatttcatcgacgcttttagtggtaatgtttgaataagcacaaaacacagcatcattttcacaaattaacttgtgcttagaggaaaaaaaaaattaggtatgttacttactatctctattttacaagtgaatgaagaagcaagcacagagaggctaagtaccttgtccagggtcacatagctagtaagtggaagagccaggatttgagcccaggcgtctggctctggtgttcattttcttcaccactttactgtactcaggaagtatggcattggagactaccaatgaattctactggtttatgaggtgaatgtagacaccatgtgagtttattatgtgccagtcaccctgcaggtgaaatttacccttgactaaagcagtaacggagcttccaaactccaatcagtaattctcaaactttaatgtgcatctgaattacctggggagttggtttatttcaatgcaaattactagaccccgtggccagaattcttatgcagaaatattgtggagtgagggaattaatatattatttccccatatgcaccacccccgcccctgccaatattgaaccaacttagagataaaggagggagagccagatgtcaccttattttactgataaaggtgaaattggaggactcaactttagagtccttcagtatctacaatggctcttcctagcaccaaaacccagagttggaattgctcagctatcccaagaagtactagacaaccacagcctcacagaggaggtctgctctataaaatttaacagcgtgaaagaacagattcgatgcaggctatctgttggcatgctggctcctggaagaagggacagaggaagaggctaggccacatcaacttggttgcctctgaaactcacctttctcttccccatggatgtggaaggagttatctgtcaccagtcagataactgtcaccagtcagttaactcctttcacacccatggggaagagaaaagatcggctcaaggtgtcaagaaatccctccttctagaaaccggagaagtaggggaaagcatcctcccactaataactaacttctaggttgaatgaagcccaggagcctgtgcttttagcaagaatctcaggggtttctgaaacagatagtcctcagaccacacttagagaggcagagttcgagaatggcctaatggttgtgctggatgacctccaaagaaaacctcatggataagcttgctgtctatcaggggctttcgggttaggataggcagtgactatcatatgtacagtgcttagagttccagcttctgttctaagaacttaacatgtatgaagtcattccagcatgtgaagtcacagcagctgtaagagttagataccaaggcagagataggttaagcaatttttttcacggctacgcagctagaaggtggcagggctaggaaccggaaccaggcagcctgagttcagtccacactctttatctccaactatattgatgttcatggttccctcttcacacagaagctgggaaggcacagcctgaaagcaaaactcaacaccgttgagaggctaagcaacatcgcttacccttactactgttttgatcattgatatggcagctaatgaatttcttttaaaaagcaaaatgaagtctcagtagctgctgattattctgtttttttctcaccaatggatattaaagttctaactatcatgttgctaattaaggaattttttaagaggattggcgtgcctgagagggttaagtggtactatcaaaagcaatgcagcccaggtacaaactgaatgaagagcaatttggatattattctttgggataacgtgactttaggttaaccatgaaaatcattccttctctggagatgaagaccttgagtttaagccttatgtagagcaccccaagtgggtgctgcctccccatctttgcagttttccatacaggggagcgggtgcctgagttcccagagctgggtggaaggtctgttaatattggtgactacagagagggtgaaatgatttatgaggacactaacacacacccgatcaggaaggttaacccactagatgtcatttatttagcagacatttattaagcacctactgtgtgttcagtactacaccttgtagtatcttgcccttggaataatgcaggaagtggttatttataaatgaggtctgtgggtgcctgaatattgccaacttcatcttttatggagtgtaagtcagctgctggcaaaatacccgtaggagccaggcatggtggctcacgcctgtaatcctagcactttgggaggctgcggtgggaggatcgcctgaggttaggagttcgagatcagcctggtcaacatggcgaaaccctgtctctgctaaaaatacaaaaattagccagacatggtggcaggtgtctgtaatcccagctactcaggaggctgaggcaggagaatcgctttaactcgggaggcgaaggttgcagtgagccgagatggcgccatttgcactccagcctgggcgacagagcaagactccatctcaaaaaacaaaacaaagcaaacaaacaaacaaaaaacagtaggaagtactaaatagtgatgtcttccatctaatatgggaatgaagataaagtaatagttcagacttgggcttattcataaaaggcttcatgctggagatggaccttgaaaggattgtgggtggggattggcagggggggcaagggcaatgcctgccaagggagagctatatgagcaaggtagaaattagaccacaggcaacaaaatatttttgtttggcaggaataaagtgtagctcgtagagtatttgtctgaagaagtaaacaggcaaaataaaatgtatgggatgccaccatataaaatttggcctttcagatatctgaagatgaccttacctgaaatttagatggaccccctaaattcaataaaagatccttcccaggctgggcgcagtggctcacgcttgtaatcccagcactttgggaggccgaggcaggcggatcacaaggtcaggagatcgagaccatcctggccaacacggtgaaaccccgtctctactaaaatacacaaaattaactgggtgtggtggtgtgtgcctgtagtcccagctactcgggaggctgaggcaggggagttacttgaacccgggaggcggaggttgcagtgagcccagattgcgccactgcactccagcctggcaacagagcgagactacgtctcaaaaacaaaacaaaagacccttgggatacccacctggggccttagtaattatcttaataattaggtatcacccctctcccccaacaatgacacttcccatcctcattgtgaggttattaaatgaggtctctagctgggtcatagcatcaggacaggacacacagctttcccaactaagggcaccctgcctttcagatctaattgttctgcacaaatgtcctaagcttgttgcacatgggattgattgactcttatactccctgaattggtgttatgtttttctgaggaattctacaagttttagatgtcatcatatacaatgacaaagtgggtggtagtgtttttcccatgcctctgatttatgtatttgtgcccggggtgatgatttagataggagcttaataaaattgatcgaatatattaccccaaacccacacaccatcatttcagggagctgtcatcataccaaggagatgctatatcacccagcatagtgttccaaaagaaccactgtgttttcttaagtgcggatgggcttccatttggtcagaaaggtctttatttctcaaattggccaacagtacaagagtgtaaattcaaaaggtattggttagctgtagaagagagtcattgttaggtgtgtgacttttccaagttatttaaactctctaaacctcaatttccctttctttttttttttttttttttttttgttttgttttttgagacggagtcttgctctctcacccagactggagtgcagtggtgcgatctcggctcactgcaagctccgccttccggattcatgccattctcctgcctcagcctcccaagtagctgggactacaggtgcccgccaccacgcctggctaattttttgtatttttagtagagatggggtttcactgtgttagccaggatggtctccatctcctgacctcatgatccgcccatcccggcctcccaaagtgctgggattacaggtgtgagccaccgcacccagccctcaatttccctttctacaaaacgtggattgataattcctgcctaaaatatttgtttttgtaaggataagcaatagtgcatcaagacagtgggaggaatctttgtttcaaacaaatgtagatgtctatcctagctccatctttagctgtccaagtcactggtcctttgtgagcctgtttcctaggctgtgaaatggtattggtaataattgcaagagaaggccttctgcatgatggagttgtctaaaggagccaggtggatcagatgtgaaggcccagagacatgtacgccctaagagattgaccacaaggctaacttgcctaagttgctaagatgcagcagagactgaggccaacatcaacgccagctctggggacagaggagcagttgttatctagacaacactcttgtattgatatgatattgacatgatgcttgttgacacaagataaatatatttgaaaggaagcagtgagggtgagaacaaaaaccctgtaagaaggtggacaaagagtggctcttctctttgggctctcgtctcagcaaacaagggtaatccctcctccctgtcgtgagaaaccaatcccagtccattcccagaaaacgagtaaattaatgtacagtgggaaataccagaatgggaatgcttgagaaatagtatgcctgtcaataaatatgtgctccatgagttaggaaagaaatgcatgcatgcatgcatgaatgaatgaatgaatgaatgaatgaatgaatgatttgggattctagctttatcagattcactaggtgacctgcagcaaatcagttaactgttctgggcctctatttcttctctataaaatggaaataataaaaatgactgcctaatggtgagaattaaatatgttaatgcaagttaagctgttaggtcagaggctggcacttcataaaacctctcagtaagtgaatactgttgttgtgatgatttgccattaccctgtgtcttcaatagtcactgatccagatggcttggcttctccttttaagatgtttgtattctctgtacctcacaggtcagcaagtcctgggcttggtggagaaccagagtgactggtaccttggaaacctgtggaaaaatcaccgcccatggccagcccttggaagaggctacaacacaggtaaatcctcagggtggtatgggaagagttgcagaaggtgatatgaggacccagtgctccttccgcaggagaggagattgcaaaagctcaggaggaggccacctgattgcttgaattcagtggtggatggtttgtgggcagtttgcattccagttccttcttggtgctatacccacaggtagagtaaccgttgggctgtggcagtctgtggcatctcaccagaaagcccctctcctgacctctaatccagatcctattggatatctttatcagtatgacccataggttccctggctctgttaatacagaccagatatcattcttcagtaacaaccccatttcagtttcttaacacaacggatatgtacttttgccaatcacattccacgtccacttgaggtcttcagggatctgtgttcactgtgggtactcaggattcatctccatgcatacttccatgtatgtggtgggaaagtagcagaagttgtattatctcttaaagtttttgtttagaagtgacgtaatttcatatttcattgactaagcatgttgtgtggccatgcctccctttaaagcgtgtgggcaagtgcagtctaccatgtgcctggcaggagaaaaagcagatatatttgctaatcagcacttttgaggaccacatgtgcctggcaggagaaaatgcagaaatatttggtaatcagcacttttgaggaccacagacctataaccatgtgtctaaaataaaatccattattctacctcgttactagccccaaacttgcatctcctcttcagtttctttctctgttattggtgtccttcattcatccatcaacccttcttgttcaccagctgtcccttgaatgcttactgtgtacgaggccctatgctagctgcagcagacacagtccatgacctcatggggtgtataagcaatgaaactagggcagcctcttcctcctgaggctcaattcccatcagtgtctatctttgacatgcttctggatccttctgcctccctcctccatcctcattgccactgctgtggtatcccattctcaaaggatgcagactcctgatctttgtcagactagaatgtggaactcagggaacagtaggatgggtgagaccaagaagggctggaacttggcatctgagaccagcaaatgaagtgggttgggacaggtgtctggctctggggacagtaccacctaaaagtgataagtgaagcctgccctggaggctgaggccagtctgtagtgggatcagccaaaaagagtcccaaattctgagagctgatggtcagactccagaaaagtcaaatgcaaacacagggtcccagagaacaaaggagaagggacatgagtcaagcttccagaggtaagagttcacagatggggtcagagtgggggtcaaagctagaggaggacaaggaaagaaagtccagcatcaatgtccagaggtggcaggcagccagggagccctgtattgacggccatcctaagagacggggacattccttagctaacatttgcctgagtattagatatgccttgctctatgtaattttttttttcctgtaatgcctaccaggcaaacagaggttgtgattgaagaatgtcaaccaccagcccttcacagactccagattcccaccctggagtctcccatgctgtgttgggcattaatactttagttgctggatgatggggaagtctgaggagttcctgagaggggccaggttggggaaaggcagctgagggcatcagagcagtggttctcttagcaggtcaggaggtatttcactcttttcaataatgggtaaggcagggcctctacgtatcagctgagtattagccaggcaccatgttaggtgctttatggttgtcagtctcctttgatcctcacactcatcctatgaggcaggtgccatgcctataccagaagaaactagtctataccagaggaaactgaagattggagcatcgaaggctgcaaccctgaaaagtcaaggagcctgtggtgttaactaccaacctgccttgcttgaactttaatggcttcaggattaaacacttttcaacaatggagaattctgggctctgcccttcaagagtctgattgactaggtctgtgcaggagactgggattctgtcctataggaagcctctaggatgtttctggggcagaatgtccaagggcctgctctgattaaacatggcactctgtttcctgtcccagcaagctctcccagacgctgttttctcagtgcattggagactggaccctccatgaacccacagcgggccagggacgggggttccacgtgctttcctctggcaaacgactagtcaccccgtgttgatcttttgtgcctggattttcagacacgttccctccaagctttcatggaggtggagacacctatgtttctgggtggagaaaggaagtctcaggaaaaccctggtgtatacatttcgtttctgtcttccaaaatatataatagaaaatgtcacatagaaatatactgcagtgcctcagggatgctgcatcaagatcacggtttcctgcgtaaaacaaaagccgctggtcatcaatccgggtttgcagagagaagaagaatgtagcacactagggaatttattacaaccaaaatggcatgtctcttcctgcccttccctatttgctatagaatgtagcatcaggagacacaggagcacgtaaaccacctccagttcccgcttgatttgtcaaagcagtgagttacttccctcctcgctggtactgaaagggcagagcagaagagggaaagccctgttgaagtgatgtgtccatttaaataagccagtgacactgagtgattattatgaaaggacttaggcaacatcaaaatgcaaaaaaatggctttcacgaaggggatgtgtcgctttaaaaccaaggattgtgccacccagtgaatgagtcatccagacatgtagattctcatggaaactgaggacgaccctggagagaacctgccaccctaaatcccagcacatctgaagcctccaaaaagaatatctccagcagaacctcctgtcttatgccttcagcttgatgttaggaactcaggcagatctgggttagagctgcagtacagtcatttagtcttcttatgcaacttggccaagtcacttcactccttgaacctcagttctctccttttttttttttttttttgtttctttttttttgagacagagtctcgctctttcgcccaggctggagtgcagtggcgcaatctcggctcactgcaagctctgcctcccgggttcacgccattctcctgcctcagcctcccgaatagctgggactacaggcgcccaccaccacgcccggctaattttttttttttttttttttttagtagtgacggggtttcaccacgttagccagaatggtctcgatctcctgacctcatgatccacccgcctcagcctcccaaagtgctgggattacaggcatgagccaccgtgcccagcagttctctctcttttttaagataggacaaggccaggcacggtggctcacgcctgtaatctcagcactttgggaggccgaggtgggtggatcacgaggtcaggagttgaagaccagcctggccaagatggtgaaaccccatctctactaaaaatacaaaaaattagctgggcatggtggtgtgtgcctgtaatcccagctactcgggaggctgaggcagagaattgcttaacccaggaggtggaggttgcagtgagccgagatcatgccactgcactccagctgggcgacagactgagactctgtctcaaaaaaaaaaaaaaaagacataacaaacctagtatgtgaggattagcaattaatgttgtaacttgtttaatgagcctagcctgatccagggcacaaagtaagtacttagtaaatcttggtctttctcctcttgcatttttctgccacttgctctatcagggaatgagatttaccgactggaaaaaggaggttatgtgattgactggggtttgctaaggtctcccaagccctttggtcagaaagaacgagtaagtattttactttccccaggtgtaatccagctacctagcagtttttcctgtatctctttactatctgaaaaggttagctttttatatcacattaggaaaaaaaatgactatttagttcgcatatcagcttcctcgctgtgttttactttgaaaatccccagaaaagcatatgagatgtttgtgttggaagctctgccttcaagacctggcgttgttgcttttgagttctgtgccttttggaaagcttacccaagctcagggagccttgggcttctcatttatgaactggggacctcagaacccactcggaggctctgttgtggtggcgcagccacgtgtgcctggggtaaaccaaagtactttagcaagttggttgtgatttttatttatccccctaaccatagcccaactgaataactcttttcagctaattcagattcaaccgcagacatcaaacacagcctcttcactacacattcattcattgactcatcccaccaggcatcataccaggcaccatagcgtgcatgggctttgttaattccttgaattatcttataaactagacttttccccctacaagagtcagtcagtttcccccgttctctttgtttgcttttctttcccagtctgcttttccaaagcctacatggccacaaaacattagagaagatctttccaccatctcccattcatctccttccctttttactagagctgttcccaacttaattccagaagctactgagccaccgcagcttcggatggataaccaggcagatcctagcatgaagctcttgcccataactgttcgggtgaaattacaggcgtctttcacagtcttgcacagaaacgggtcagtttccaaccgctctgcccaggcatcatctcctagatgcaagaagctgtcattcacccagcattcagctgtgagcaggacttagaaaacaacaacaaaaatacacctaggattttgacaggctcattaagattcagctctcttcagttcctaagctgacggatgaatatcttaaaaacaaacaacagcaaagaaaaggggaaggagggctaaacatagcaggggattggagaatgaggtgagggaaggcaggtcggtagaaagaagatggcatgtttgcagataggtttatttgcatgggaccccaaaggcgactcaagcacaaggtgcgtcctccccaagttgaagggtgtaacactagccagagaatgtgctttttaaaacaatttaaaaataaaatgtatcgtgtttcattcagcccccaaattagggcagagacaggcagatggagacctggctgtttagggagggaggaagaatttctctcggaatccttctctgcaggacaacaaaattggaatgctcaaggactggctcacctctgaggttagagcaaaccgtggaaggcaatgggcagtacagtcagataccatggaaaattctgtggcagagattcaaaaggagaaaacatttgatagtttgccaaagaactgttaaatagctttagtgggataaatagaaatatgcaatctaggctcaacttacctctgcctctgacatccagcattctgggaccctggctaagtcccttcatttctctgcatcttaattgtctctgatgtcaggaactaagatctcttcgtgttctgaaagaatactgtgattgggtgatttctgtctgtaataattgcatccagagaagctatatttaaatacaatttattcattcattacatgctactgaatacctataatactggcaagggtagggtagaaaactgttttgttttgttttttaaatgggtgataccaagaaccttccttcaaaaagtttatcgtctaatagagaagcgtttgcatatctgcaaataaagttaatatgacttgagcctcttccatgattgagatccagaattgatcatcagccctgcagtaataacccctagactagcgttttctagactaattccagaggtcactgcaagggatgtgaatatgtgtttagaaattgtgaacagaggccaggtgcggtggctcacacctgtaatcccagcactttaggaggccgaagcgggtggatcacaaggtcaggaaatcgagaccatcctggctaacatggtgaaaccctgtctctactaaaaatacaaaataaataaataaattagccggtcatggtggcacgtgcctgtagtcccagctactcaggaggctgaggcaagagaatcgcttgaacctagaaggcggaggttgcagtgagccgagatcgtgcctgcatactgtgtctgccctttggagattcatatgtgcatgttagagatcttataaagtctggaagtaaagaaagctattacacccagaagcatttcccagttttacttgatcctagagctacggaaataaattagggacaaactgcctgtagatggagtctgtagaataatcccactgaaagatgtgtgctattctaagaacagttcttctgacatcgtgctcaatagaaatgtctactccctactttcttttgtactgtaggttctcattcatctttctgctgcaaggatgtagacactgtcttaggtgctataacagatgtcccatagactgggtggcttaactacaaacatttctcacagttctggagcctgggaagtctaagatcaaggtacccagccattctagtgtgtggtgaggacttactttcttgtttgcacatggacaccttctcattgtatcctgacatggcagagagcagggaaagaaaatattctgtctgtatatcctctttttttgtttttgtttttttgagacagagtcttgctctgtcacccaggctgaagtgcaatggcaatatctcggctcactgcaacctccacctcccgggttcaagcgattctcctgcctcagcctcctgagtagctgggattacaggcacacgccaccacacctggctaatttttgtatttttagtggaggtgaggtttcaccacgttgatcaggctggtcttgaactcctaacctcatgatccacccgtttccacctcccaaagtgctgggattacaggcgtgagctgccgcgcccagccttgtgtctcttcttacaaggtcattaatcacattaatgaagtccctaccttcatgaccctaattacttcccaaaggccccaccttctaatactgtctcattaggaattaggattttaaagtattttattttattttttgagatagggtcttgctctgtcagtcaggctggagtacagtggcgcagacacagctcgctgcagcctcgacctcctaggctcaagcagaccttgcaggctcaagcgatcctctcacctcagcctccagagtagcttggactacagctgtgcacccccaccctaggctcattttcttattttttatatagacagggtctcactttgttgctcaggctggtctcgaatcctgagctcaagcaatcctcccacctctgcttcccaaagtgctaggattacaggtgtgagccactatgcctggacgggtttaggactttaatgtgtgaatttgggggagatatgacattcagtccattgcaggtaccatatcattgcacctgcttaatcactctgctgtgtgtcattgcataactgaagcgagcatccttccaaaaccttctgtccataggtaggaattctgtgagagatggcttctacaccttttccaatcctgattggttgaccacctttagatagctccactttttctctttggaagtgacactctgacctgaatgatatgcagtggccattatccaacaattgaaggttcacacctccacctgtaaacttccgctcactgttctgaatcacttaaaattcctgtttaaaatgtcaacctcagggccctgcccccagagaaagtgaatctcaatgtctagagatgaggctgggtgactgttcttttaaacatgctccctacttgattccgatggttacttaagtttgagaaccagtacctaggcctctgatgatgtacttttactgccacattgcacttctagctcaaattgaacttgagttcaactgagaagctccatgaatgacttttcagccaaatgctcccctttctgtacttctgtagtagccttattgagtctaaagtacagattttatattggtctagtgagttttatcttctttggaccattcttttcatcattttattagatttcatattagggtatccacaaaaatactaaaaatgccttctgttccttcacccagtgtccttgccccatatttgtaacaaatgttttgaatgcctcttttataatcctggaatgaaattcaaggattacatctatattatattgcctacaagtgtaattttttttttttttttttgagacagaatctcacagcagagcccaggctggagggcagtggtgcaatctctgctcactgcaaccttcgtctccggggttcaagccattcccgcgcctcagcctcctgagtagctgggattacaggcgcacaccaccatgcccagctaatttatgtattttttttaatagagacggggtttcactgtgttggccaggctggtctcatactcctgacctcaagtgatccgcccacctcagcctcccaaagtgctgggattacaggcgtgagccaccgtgcccagccataattataatttttttaaagaaaattaatatagtgccctggctttaatataaagagtaaataaaataaaattattataaaataatatttacttcaacgtgtaatggtcaggtttggctatagtaaatgacctaataaagtggtcagatgcttctgtgcctgtatttgggatagaactgtcttcactgtgacgcctacgagtgctgaatggtactgatacattaccagcactcggcatttcatgagtggggtttgccaaatttgtggtacatttttccaaagtagtgaacaactcttggtaaagtatcagataacaggaagtaccatcttcgcttgacttgttctccaagttcagtgactattcaaaccatgcaaaaaaaaaaaaatggttttaaaaaatatcccgtaagtagtgttagttccaggctcaaatattgatagggtttggatctgtttccctgcccaaatctcatgttgaattgtaatccccagtgtttaggtggggcctggtgggaagtgattggatcatgggggtggatttctcatgaatggtttagcaccatcaccttggtgccgttctcatgatagtgagtgagttctcatgagatctggttgtttaaaagtgtgtatggccgggcgcagaggatcatgaggtcaggagttcgagaccagcctggccaacatggtgaaaccccatctctactaaagatacaaaaaattagccaggcgtggtggcatgcacctgtgatcccaaccactcggaaggtggaggcagtacaatctcttaaaccaaggagttggaggttgcagtgagcggagatcatgccattgtactccagcctgggtaacagagcaagattccatctcaaaaaaaaaaaaaaaaagtgtgtagcacttccaagctcgttctctgtctcctgctcctgctctggccatgtgaggtacctgctccccctttgccttctgccatgattggaagcttcctgaggcctccccagaagctgagcagatgccagcaccatacttcttgtaaagcctgcagaaccgtgagccaatgaaatgacttttctttataaattacccagtcttgggtatttccctgtagcaacacgagaacagactaacacagatacttaacaattatgtgtaattataaacatgaacggcctgtggtacccacatgttatgtgggtgcatttttcattgtgctggacactcctgggaaggagcactgcctgctttgaaagtcgaaggttggaggtgttgccagtgttcaacaggctggctggatgcaaagctgtgctgtgtttaaaatccttcctggggttggcagcaatgagtaagataatgctccttgctcacagagagtagtcggccagctgaaagcctgcttggcagtactgccatgggctacttctctccacttaacctttatccaaattcagtgacccaaccaaagcttattcactttgtatcctgatccagaatcttctttggcctcaggtctgcctcctggattcacagagaataaacctactccctcttccacctgcttacccccagaaatctaactgaaagaaagcagacaatgccttctcatcttgccttctgtagtcctggcaccctggtttcctcaggaattcctatatgtcacttagtctctgagcaccagttcactcatatgtgagttgaggatggttatagtaagtaccatagaaaggattgttctgaaaagtaaatgagataatagagtacatttaatgtgatgagacaaggtttagcacatagtaaatgctcagtaaatgtaggcatagttaccttgttttttaagaggcagacggagggcctgcagtatgtctggcctcttgccttattggtcaacctgggatcctatagctcatattttatttttgctattaagagactgtattgcttgtattctggagttgaacagtctttggtccaagtcccacctccacctgttactagctcccttattctggggaatgaacaactttttcatttcaggataaaaagaattcatatttcacacagatgccttcaggagaaaaggagttaatgttttcaaagtgcatgggacagtgtctgggtcaataaatgttagatattagtattttcccactcctttattgattgattgattgattgattgattgattgattttattttattttttattttttgaaacagaggctcactctgtcgcccaaggctggagtgcagtggcgtgatctctgctcactgcaacctccacctcctgggttcaagcaactttcctacctcagcctcccaagtacctgggactacaggcatgcatcaccacacctggctaattttttgtatttttggtagagatggggtttcaccatgttggccgggctggtctcgaactcctgacctcaggtgattcacccccctcggcctcccaaactgctgagattacaggcatgagccaccgcgcccagccttccttttcctttaatactcgaagtacgtaaatggggaaagaggattacgtctgtgtcttttgacagtaactccgtcttttgcccaggtaaggtatttggagctgagcattctcccagggctgaccatccacgtgttcattcatttgttggacagaaattaaacatgcatctagcacatgcaatgtgccaagcttctctgtaggccctggggtgccacagtgaacaagacaaatgggaaccctgtttacagggaggttactggttattgtgggggagaaactgtcttccttcttgtgcttttttgatgtcgtttcctggaagtgttccccacactcgctccactccagccactctggcttccttgctgctctttgaacacacctatttaaatgtgagcctctctgcctccaaactacagcctccatgctattccgttttccaccttattctcctccagcacttttaagtaccatctgaccaactacagtttggttcattttcttttaatttccctgtgtctttccatgaggatataagttcctcaaaggtagtaatttttttctgtcaatttcactgctgtctatggccataccaccctgaatgcacccaatctcatctgaatttcactgctttatcccccatacctggaatcatgcctggcctgtattaggcactaagtatttgttgttgaataaaataaataattttggaagataagtgtttcgaagacagtgatatagagcagcatttctcatggttgctcgtgggaaattttacaacccatgggacaccggcaatgtctggagacatttttcttgtcacagccaggaggttctacgggcacttagtgggtagaggccagggatgccactagtacaccagacagtccccccataacaaagattcatctgggtcaggtgcagtggctcatgcctataatctcagcactttgggaggccaaagtgagtggatcacttgaggtcaggagttcgagaccagcctggccaacatggtgaaaccccacctctactataaacacaaaaattagctgggtgtgatggtggtaggcgcctgtaatcccagctatttgggaggctgaggcacgagaatcgctcggacccaggaggcagaggctgcagtgagctgagatcgtgccactacacttcagcctgggcaatagagcgagactccatctcaaaacaaacaaacaaaaaacaacaacaacaacaacaaaaacaaagattcatctggccacaaataccactagtggaaccctaacagaaaagcaagttttgagggaattggattcttctagaaaggaccgtttctttgggtagagtctctgagaagacgacatttgagctaagacctgaaggatggaaaggcggcagccatgctgagagctggaatgagcatcccagatagagaggacggcacgtgcaaaggccaccaagcaggcgtgtacttgggtgatcgtgtttccctctcatgatcatggccctcatcattcctggcactgcaccctctgctcttgtcacctttatctagtaatgcatgagtggttgatatggtcaggccctgtgtctccacccagatctcatcttgaattgtaatccccatgtgtcaaaggaggaacctgatgggaggcaattgcattatgggggtggttcccctatgctgtacttgtgatagtgagttctcctgagatctgaggttttttaaggtggcgatttttcctgtgcttgcaactggacttctctcttgcctgccaccatgtaagacgtgcctgcttccctttccaccatgattgtaagtttcctgaggcctccccagccatgcggaactgcgagtcaattaaacctcttttcttcataaattacccagtctcgggaatgtctttatagcagggtgaggatggactaatacaatgggattcttcaggtgttcagaccccaagtgccctcgctttcttccctccatgccctctggactctctgactcgtactaacacactttggaaccatgatgtggtcctgttgacctgcctgtgccccaaggttcctgaagatcaccactagcacagagtgaataatggcaaaattcagcctcataggatgggagccggcctgggctggctttgtccagttgtccgtatccacagcccctcctcttccctgctcactccagccgcctccctccagccactctggccccctggctgttgcccaggcacattctcacccctgcaatctgagctctttgcctggaccgctcttctgctagcagctctctggcttatcccattacttcctcagtccttggatcaggtgtcatctcctcagagtgggcttccctagccatcctattcaaagcggcagtctccatccctttactctgatttatatttcttctttgcactttccatccatgttataaaatatgtttttgattatttgactgctgtccatcacagtaggcagaatcccccacccccatcctagtatccaggctctaagccctggaacctgtggatatgttatgtcccatggcaaaagagactttgcagctataattatgggcttcaacatagggagtttatcttggattatctggtgggcccattctaatcacatgagcctgtaaaagcagagaatttctggccggctgcagtggctcacgactgtaatcccagcactttgggaggccgaggcgggtggatcacaaggtcaggagattgagaccatcctggctaacacggtgaaacctcgtctctactaaaaatacaaacaattagccaggcatggtggcacatgcctgtagtcccagctacttgagaggctgaggcaggagaattgcttgaacccgggaggtggaggttgcagtgagctgagattgtgccagtgcactccagcctgggcgacagagcgagactctgtctcaaaaaaaagagcagagaatttcctccacctagatgtagaagagatagagtcaaaggggaagtcacagaaacttgaagtaggagaaggactcaacctgccattgctggtttgaaatggaggaaacaataggacaaggagttgcagatggtcgttagatgctgagagtggctcccatttgattgagaaagggcgtggggacctccgtcctacatagaactgaattctgccaacaacctggatgagcttagaagtggtttctccccgagagccccgggcaagagccctggatggctgcaccttgactttggtcttgcaagactctaatcagaagacccacctgagcccccaagatttctcacctacttaactgtgaaataataagggtgtggattttaagtggccaaagtattttgttatggctgcaatagaaagctaatatccctgtccttcccacaagaatgaaagttccatgagagtaagatcttgttttctttgttcctatgtccctatctggtgtgtgaaaagctctcaataaatatttgttgactgagtaaatgaattctacactcccacctgcatttctccccagagggcagggaacacactggtgattagaaatggagaaggggcttgaaaagccactggtgggaaacattccatattcctaggtcctgccggctgcccatttagtaggcagttgtccagcagatactaggtgcctggaatcatgattggcattaggagtagaaattaaaaagaaaggctgggcacggtggctcacgcctgtaatcccagcattttgggaggccgaggcaggcggatcacgaggtcaagagatagagagcatcctggccaacatggtgaaaccccatctctagtaaaaatacaaaaattagctgggcgtggtgacacacgcctgtagtcccagctactcgggaggctgaagcaggagaatcgcttgaacccgggaggcggaggttgcagtgagctgagatcacaccactgcactccagcctggtgacacagcgagactctgtctcaaaaaaaaaaaaaaaaaaagtccgggcgtggtgcctcacacctgtaatcccagcactttgggaggccaaggccttggtagcagatcacaaggtcaggagttcaagaccagcctgaccaacatagtgaaaccccatctctactaaaaatacaaaaaattagccgggctggtggcgggtgcctgtaatcccagctactctagaagctgaggtaagaaaatcgcctgaacccaggagttggaggttgcagtgagccgagatcgcacctttgtactccaggctgggcgacaatgcgagactccgtctcaaaaaaaaagaaagtaaaaaagaaaatgggtgtctacttgcaccaccattgcctcccccgccccccaaaaaaaacacacaaaacactagatgacccacatagagccaaaaatcagaagattaaggacagtgaaatgcaatgtggcctgcactatgatggaggagtctgtacacaattccgagagctagagtggaggcctgcacgggtgggtggagaaaagcttcaaagtgggtagaactggaagtgggggatggtggcatggactttgcagagcttgctgttcaacagagcagcaagcccccagcccaggttggaaggtgtgaaaatacttgggatggccagagcagcacacacggtggtttttagtttcactgaaggtgcagcttgtagggtatgtgcccaatgtaggaggagcagggaggagctcaagctctgtctcacccttgactagctgaatggtcttgggcaaatccctttgtcacattttgggtttttatggtctgactttcctcacctagaagatgggagcatcagtgtagactcacgagattggcagaaaaaatggcatgaatgggaaatagctggcacaaagtaaatgctcagcaagtgatagctaagattcgtggtgcagccacagggagtatgggacaagaggctcctgtcatgtcgaggctgggaatcagggaggtctaaggtctgaacggtaaccaggcagttcagccttatccagcaagctggaaggttcttaaacaatacagtttcccgcctggccctcaggagaaaccgccctcacccaccatcctcttccctcttgattgtctccatttatgtcttgaccctgagccaagtgttcatctctcagggctgtggctgcagcctgttgaaacatatgcagaagctcccatccacaggcccagggcactaaagtcatcgcagtgccttcagccttgctacattctctgcagtaccctagcaaggcagccaagcgagagccccctcctatgagacttggtgggggctctaattaaactgagcagctagagagttttcccagctgcatcctgaaaagatggcaagatttcccatcgcttgccttcctgagcaaaagccactgttctagaagagttgctctaccattgcttcctcccttcctggagcaccagccctcacaggagagaatatgtatgcaatgtaaggcttccaggatctggcctgaagtgcaagaaatctgtttccccagcttctctcactctgagactttttctcctgagctatttttcttataaatgattctatttccaggttagctctggcaacaccactccatggttttcctctctctttgctaattacatcacagagctactgcatgctgattagaaggaaaataaagcaaaaacaaaacaacgcctccacctgagctgggcctcccctgcagttgtctgtgaactggagcatctgcctttgtgcagctgggctgcagggtgctgggtgctcctcctgacttgccctttattgctcatgcatcctgacctgaagatactcaagccacctctccacaccccaggatcctcttgtttgaatcgaaaaaaataacactgtcttagtccattctggctgctataacaaaataacattaaccaggtggcttataaacaacataaatgtatttctcacagttctggaggctgggaagtccaagatcaaggtagatttggtgtctgctgaggagtcactttctgattcatagatgacaccttctaactgtgccttcacatggtgaaagggatgagctagctctctggggtctcttttataagggcacaaatcccattcttgaggactgcacactcatgacctagtcacctcacaaagactccaactccccaataccatcctcttggagattaggatttcaacatatggattttgaggggacacagacacttagaccagagcacatgcctggaaacggaagcaatatccctcatgatcttgttgataagataaaaggctacagatgccatagagctatgacattatcagcagctgcattttcttagcatctgaacatgagttgccaatcctagtcaacccctttgttagctacgtcctacccacttgctctcagcttatctttagccatttctcattgtatctgcagccctcaaccttttctccccaaggcctatggcacacacccttttattgttgttgttattgttaactatagcagatttccagttatattttctgttatatttcatataacagaaacttttacctattaagaaataattcatttctcccttcccctagtccctggcaatcatgattctattctttgcctctattagtttgaccattttaaatatctcatatgagcagaatcatgcagtattatgtacttctgtgaatggcttatttcacttggcgtaatggaaccctttaaacactgtttttgggaatgtattatagaatgatgcggccactatggaaaacagtatggcggttcctccaaaaattaaaaatagaattaccatatgatccagcaatcccactcctgggtatatatccaaaagaattgagatcagagtctcaaagcagtatctgtacccccatgtttattccaacattattcacaataggcaagatattgtaacaccccacatgtccattaatagaagaatgggtaaagaaaatgtggtgtattcatgcaatggaatattattcagccttaaaaagaaggaaatcttgccctctgtgacaacatggatggcatgcacccttcatgaatgggggctcactatgccttgtgttcaagagggcagtgggcagttttaaaaagcccccagtaggccgggtgcggtgggtcacacctgtaatcccagcactttgggaggccgaggcgggcagatcacaaggtcaggagttcaagaccagcctggccagcatggtgaaaccccatctctactaaaaatacaaaaaaattagccgggcatggtggcacacacctgtagtcccgggtactcaggaggctgaggcaggagaattgcttgaattgggcaggcagaggttgcagtgagccaagatctcgccactgcactccagtctgggcgacagagcaagactccttctaaaaataataataataataaaataaaataaaaagcccccagtaatgatgcctatgtcagagtgtttcgggggagaggtagggatatcatatggcatatatataaaatatatgtaggaaaaatttgtattctggcatatagcaggcatttaataaactgtggctctttttgcagaatgtgccacacaataggtaggagtagaagttaaaaattattataccactctttcagaaagagtggttcagttgctttaaaactccactatagacattgccagttactagtgaatctgtgagattctggttctagattactgccaaaggataggattttttttttattttagactattttttaaaagaattttgacaactcatattcacatttgttataaaggacaaaaatagtctagaaatgcagtgatgtgctagggtcctagctcacatctgctagtgaaagcctattgttaaatttttaggaaatatgggatccagttgttaaacatagccactattaaaaatcaaggccgggcacggtggctcacgcctgtaatcccagcactttgggaggccaaggcgggtagatcacctgaggccaagatatcgagaccagcctggccaacatggtgaaacgctgtctctactaaaaatgcaaaaattaccccagcatggggtcacatgcctgtagtcgcagctactcgggaggctgaggcaggagaattgcttgaaccagcaaggtagaggttgcagtgagctgagattgcatcactgcactccagcctgggcgacacagcaagactccatctcaaaaataaataaatacataaaataaaataaaaatcagattatgtaaacttacaatgaaatatgtcatttgaaaaacaaaggtaacaaatactcaaaactcttaaaacttgttaattcctaatcactttactctctgtgcttctaaggttgtttgcgtctgccatgtctgtatggcgggaatgccatgcagtggggtcgtgctgcacatcccttcataaccgttcagtagcattgcattggtagcttgaaatctgccatggtgggactattgcaacctggaaatgggaaaacactaccatcaggggatttctttctttctgaagagtcagttgttgaacatttaccagcattgctgaaatataataataataaatatatatatatatatgactttgagatggagtctcactcttgtcacccaggatagagtgcaatggtgcgatcttggctcactgcaacctccgcctcccgggttcaagcaattctcttgcctcagcctctcgagtagctgggactacaagcgcgtgccaccacgcctggctaatttttgtacttttagtagagacgggattttgccatgttggccaggctggtctcgaactcctgacctcaagtgatctgcccgcctcagcctcccaaagtgctgggattacaggcgtgagccaccgtgcccggccaataatatatatttttcacattccctgaaagtaagtactgttgacagtttgcagtcttgacttctgctttccacatatgtaattatctatttctctgtatatatgcatattctttttgaatagacttgtttacttaaaaataaaatattgggcgtcttctacattaatacaatggtgtattttctttcttgttaagaactgcatagttttgccatttgatggaggtgctataattcgtttattccattttttatgagttggtattttagctgtacctaggttttcccctcaattataaacaataccatacatagatattctcattacccatgtttgtttgtttgtttgcttatgcaagtattggtacacaatagctcctaagctattctggtactgctatattaaatgttatggatattttaaattctgatagatcaaaatttaaatttgccaaatgtgtcagtttacaatcgagataaaattttaaattaaacagatgtgtgcatgtttatgtatgcatgtgatttgcttgtttgttttctgtgttaggcacacagtctgtgtatttgcaaagaatcagtattttgccaaggagctacttcataggaacccaacttgagctttttcaatttaggcagatgatctctgactaaaaggtccaggtgtttgaagccatggatcgttgaccagtggccaagtgaaacagagacatttccttgctgtggctaactctgcctggctgcagcattccaacacctggataagtgagttgacctggcttagtatttacacgggggtggccgttcctgaaaatgtgtctgccctactctgctgacccatacaaggtcaggggttttctctgtcactcactcaggtctttagcattgcaagagctaacaggagttacgacccaagcatccagacacctgtatggttcagtgtgcagtagaagggaaagaaggaaggatatgatcctaaatcttcctgacttaaggaaaataatctggccatcattcagaacgtggtttccttgaagacacatttgtgatgggaagaggcacttgatttctctggggcctctcaggttcacagtactaattgcttagatttgattcatgctttcacgtgcaccagctcatataattcccattctacagaggaagctgatggaggctcagcaaggttcgttgattttgcaagttagcagagccagtaaatgtcagagcccagtgcttaagcctaccttgcaatctctttctgggccttcagtgcttgagagtggttggtagagcagtatatgagtccattctcacactgctataaaaaaaaaatacctgagactgggtaatttataaaggaaagaggattaactgactcacagttccacatggctggggaggcgtcaggaaacttataatcatggtgggagatgaaggggaagcaaggatcttcttcacatggcagcaggagagagaagactgagcatcaaagggggaagagccccttataaaaccatcagatctcgtgagaactcactcactgtcacgagaacagcatggaggaaaccgccccccgcccccatgattcagtcacctcccatcatatctctccctaggcatgtggggattatggggattacaattcaagatgcgatttggctggggacacagccaaaccatatcaagcagttacttagctctggggatttttctagctccctccccagtctataggttagagagctatggaccgtcataacaacgtcgtgctgtctactaaatttacagtagtacttgccatcatggctgcatgttggaatcacctgggagatttgaaataatcctggcatcccagggcttatctcagaccacttaaattagaacctctagggtgagactcttccttcagtagttcgtaaaaccaagcaggtgatccctatatactggacaggcatgtcctcctttccttccaaagcctgcattataaagacaccatttgtaatgtagccactctgtacctgctttccctcttcattacctataccctatttttctagccatcactgaactcctagactccatagctgcttgaatttgtggacattcaaccaagatttcttatctttttttttttttttttttgagatggagtctcactctgtcgcccaggctggagtgcagtggcatgatcttggctcactgcaacctctgcctcccaggttcaagtgattctcctgcctcagcctcccaagtagctgggactaaaggcgtgtgccaccacacctagctaattttttgtatttttagtagagatggggtttcattgtgttagccaggatagtctcaatctcctgaccttgtgatccacccacctcagcctccccaagtggatttcgttttattattattattaactgtgcataatgtcacaccccatgctggactctggggatgcttcagtgggtaaaagaatcctagcctcagactgctgactgtcaagtaacagctacagacacaagccatttggatgcagaagtgccctgatggagaaagcccttagacaactgggaaaaggggacaggcagtgatgtaccatcagtggcttatttacatccctattgttgcctggatcctgacctgctatactatgctttcccctggggctgccagtgacatcacatagagaaagagaccagcctcctcctcctccttccgtctcagggtaagctgttccctgtcatccaccattatgcttcaatagcccctccttgtccccctgagcccttgcctgccgcatctcctttattgcatatttgacatttcaccacagcagatcagatgtatttgaatcagaatggcacacagggcccctgaattggttggcagagccctatgggactgctccaagtgaagggaatctccatgaagacaattatccaagagaaatagcctatctcagcaggcatcgttctgctttgcttattgagccaacatttatgaagcatagacttcataccgagctcaatgcaaacagactcacctctagcaaggctcaagggaggcaacaaaagaaatagaaaacacggcccttgtcaacaaacctaggattaagttggagtggccgggcgaatatactgaggaaacattggttttcttttttaacccttttcgaagtctatttaatgtctgcctactgaatatttaattattaacaacaggagttgaccccccctggccatttttgtatgtcccacgctgggtttttccattttcagatagttaaggcaaaaagaaaaaaaaaaaaaaagacaagtctattttgtggcacatgaaaatcatatgaaattctaattgcagtgtccattaataaaagttttgtgggctcacagccacagcattcatttttattttgtctatggctgtatgaaagttgtcaggatcaagatggaatcactaatattagaaaaccctgataaataggggaaggccacgaagacatgattctcacacttatatgcctgataatgaaacagactctacaaaaaacacagccttgcacaaacacctcacgaccttacacaaaaacatgtgtgcaaggacatctgcctctccaacctcggaccagtgtcatccttatcattgatctttgtagccaaagataattactcaaaacaattatgtactcctccttattttttcctttaaaaatgtttatctttggctgggctttgtggctcaagcctgtaatcccagcactttgggggccgaggcgggtagatcacctgaggtcaggagatcgagaccatcctggccaacatggcaaaaccccgtctttgttaaaaatacaaaaaaaaattagctgggcgtggtgttgcacgcctgtaatcccagctacttaggaggctgaggcaggagaacctcttgaacccaggaggcagaggttgcagtgagccgagatcgtgccactgcactccagcctgggcgacagaaaaagactccgtctcaaaaaaaaaaaaaaaaagtttatcttccttaccaccctgaatgcatgcagactttactatgacatgtgtattcccattacaatatttaattcccaaataaacgtattttcttttacagagtgtctctctgcttattatttagattgacagctgctttgaggctgcaaagacagaaattaagtagttgcaacagagtccttttcgcttccaaagccaaagatacatacttattggccctttcagaaaaaatttgctgaccgaggtccacagcatagcagaaagcatggtctcgggagcagacttggttaggatcttgcctgcaccagttagctttccacatctagtgaataggaataataacatgttcttaataggctgagattgaataaagccactgtaaaggaaacataaaccccagttatttagaactagtattgatgcctagtaaatattggttaccttcacccaccttaattatatacaaatataatttcctatataggcacaaaaagaaagatagaattacctgaggctaatcctactctcaactggaaagatatgcacaagaaatagagggaaagggaatgagactaatacattcattggatactttataatagcagagtcttcttactcttgttcaatcctttattccccagcagttagagctgtcctgctgggcacagtggtgcacacctatagttcccgctacttgggaggctgagtcaagagaatctctggagcccaagagttcaaaactgtagtgtgcgatgatcgtgcttgtgaatagccactgcactccagcctgctcaacatagtaagacccagtctctaaaaaagtaataatagagtggtccctggcatatggtataggcatagagttcagtatatattatatgcattttcagccaggcgtggtggctcatgcctgtaatcccagtactttgggaggctgaggtgagtggatcacctgaggtcaagagttcaaaaccagcctggccaacatggtgaaaccccgtctctgctaaaaatataaaaatttgctgggcgtggtggcgggtgcctgtaatcccagctccttgggaggctgaagcaggagaatcgcctgaacctgggaggtggaggttgcagtgagccaagatcgtgccattgcactccagcctgggtgacaaaggcgaaactccttctcaaaaaataaataaataaatgcattttcacattcagccctcttaataattgatatagttgtcaaacattttacttatggagtcatcatcaggatgaggccccaaattccactcctccacacaccaccacacagccctgggcatgccaacttctctgtgccagtgttcacacctgaaaatgcggataatgggaaaacgtgtggcagagggtcgtctcgaagactgaatgagatctaaagtgtgctagatacctctgcaacccaaaagagggaagggcagacaaacagtgagggtgtgtgcgttcaagtcaaaacatggatgtttcatcacacaggcttctttgaactctgtctcggtgtggtagtaagcaggaaatcctgcaagctctcaagacggagaggataggagaaaaatcccaagatgcaaatcgggcagaggtcattgtttaaggagcagctttgtgggtcggatctcaagggatgggactgcgcagaatgttggacagaatggggaagggaagacctgcaggtggagggggcacgccaggctgtggaatgggtgtggccaggcaagtctgggtatacacggcgggaagagccgtggtcatagaggaagccttactactggacttcagagaagaatggagtcaccactcacttgctttaggtctggagacctaatgagaatgtatcatcagattcccatacctgtttctaccaaccacatattcagcctggtttcaaagtttatttctggtttccaagttctttggattgaatctatactactgattggataagactgaggaaatgtatgtgttaatggaaatggcaatgcattcctattgcagttgttaatctttccgaagattccagactctgatttttaatggtcttcatttattctaatgagttaacgtaaccacagattagtaaacagggactatcgatcttcacagagcgtaaggaaggaatttacacgtagtaagggcccattgttgtactaaaatcaccactgacttttcgttcagcattgactctgcaccaggccctgtgctaagtgcttcctgtgctttctctcatttaatgcccactacatcgtttgtaaggatcgttacaccatttattcaaaatctcactatttgtcggcagcaaagtcaagactggaacatggagcattccgtattgaaagcagaaggctcctgcccctgtagtgccttaagtatgtggtctgttgaaatcttcactccccacctagaaaaaaaggaaaagaaggaagaaagaaattacacatagtaatgttgattactccctaaagtaattaaccaggattgtgtaatgaatgacaacagagacagacctctctgatgaggtgacagtttagccgagatctgaagcgtgtcctgaagccagccacacacttggccagagaacaagaatgtagcagccctgatgtgggctccagcttggcctgttctggaactgacaggtgggaggctggaaggaggaacttgagttgagactggggagctaggctagagcttcctgggccatgatacaatgacacagaatttgcattttgttctgtaacacactggcaaagacggcacttggctgagaatatccatgagcttttgaacagtagcaatcatgcaatgtccttgtagggatctactgaatgcaggacgatctttctccctagaaagaaagaaagaaacaaagacaaaaataaaggacacagagcttaggacggtcccatgaccttaaaagccaacaagaggacagcaaactcctttatgctcctcttccccactacccaatgcagaagtgcagagtccttcgaactgggagcctcttttgtggccgtgatgactaagaatcaccctggataattgctcaggtatagctttcaccacactttccttcccccccactgaacagaagcaaaattccttgctagggagaaagttcaccctgtactcagtagatactgcaaagtttggctccaacccccttcccccttacttgggggttattgaatactgcaaaagtgatcaaggaaagtacatttatcactcttgcctcaaagcttgagccaggataattttgcacattctgtttaaacgattgacacgagaaagctggatttagttctcccttcttacttcccagcactaaatgcacacctcgctaatccaatttctaggaaatcctcccttgtgagcaggacagcctgtgggtttgcccagatcaggctggcagagggtagataggctcgtttgtgggagcacgttcagaccccaaggattactgtggccttatggctgccagagccactttctattaggtagggggcctttatgtgcccccagaaataatgttaatagtcctagctaacatttattgagcactggttataaatgtggcattgcaaatggattatgatcttatttaattttcaaaacagcctaggaggcaggcactccttgctgtttttccaatttatcagctggcttaagggcctttgcacttgtggctaattctgcctaagttcctcctccttatcagcatggcatgctacctcgcctcctgcagatcctgtcttaaatatcatcttcttggaaaagtcttcgctgaccactggttgaaaatttcaccacatctcccagctgagctttctttatctcccctccctgctttgttcttatcatacaatagactatatgtttaacctacttacttgtttatccctcttctgttagcacataggcttcccgaggactatgatttctattttcagatgggttctggtacataggagacttgcagaagatactggtctaaggaaaaacataatatcatcataactattttgcaaactaggaaagagaagtttatagaaatgagctagtatgggccgggcgcggtggctcacgcctgtaatcccaacgctttgggaggtgggtggatcgcctgagatcaggagttcgagacaagcctggccaacatgacaaaaccccgtctctactaaaaatacaaaaattagccaggcgtggtggcaggcacttgtaatcccagctactcgggaggctgaggcaggagaatcgcttgaacccaagaggcagaggttgcagtgagccgagatcgcgccactacactccagcctgggtgacaaggacgaaactccgtctcaaaaaaaaaagaaaagaaatgagccggtatggtccaggtaagaccgaaaacaagtagcagactagaattaacctaggcctcagaccttctaagtgtttacaacactgcagaaccagcacgtggccaaatacaaagccatccgtggaactgtggttgtgctgggaaataaggagacactactccctattactcccattaaaatgttcttttgaaatcaacttagtccttcaggatgacagttattgatgttaacacaagtggaattttttagcccctcttctgcactaggactctgcttgttgagatccagaggaaataagttatggtctcatctctctgcaagctcactccagttcattgccaatgcaggagcttatacttgtattgagtagacctactgtatggcacataccgtgcaggaagctgtgggtatggagtcagtaacacacaccactgccctctgggagctcagagtttggtgccacaaagcacctacaataactgcagctctgaaaggcacagatgtagattgtactatgtagtattttgttgttgttgttgtttgttttgttttttacagccatagccctgtaagtcatattccacatcaccccataggcatcagtattagaaaacgcatggattttggaacaagtgaaactggatttgaatctgggttgtcacttgctaattgcttactcgatctttctgtgatgttataaggaatagagttaataggcatgcctagtgcctgggtcctagtaagctgctgccatcaccgttagctctcagtatcatcattattattgttctgcctctgggtcacagtgagtggtgaattcagtgcctacaggtcaataggaagaaactagtttggttaaaaatataccccaggtaataacaatagtcccttatttaattaagactaacgtgtattagtcactgtgctatgctgagtatttcgttatcttatttgattctcccaacagtcctataagttatgatgaatatccattttgcagaagagtaccataaagcacagagcagttattaagtaacctgcccaaggtcatgcgtgctgtgtgggtagatgctaggaccctgacccttgatttttttgctcagctgccccaggtcatcaaagtgtgcactggggaggtgactgtattcttgctgtcattcccaaattagtcagagaagcagcaaaaagtaccaaatctagcatcaagaggcttttattcaagcctgtattctgccactgcataagcttcctgacctcaggctgctgacctcactccgaagtcttggtttcctcatctataaaatgaagacgttgacttagtgatgcccagcccctgggcctctggttctgggatatggctctttcattcatcacacagcagacctaccaaagccaatgtcatcagagttagaaagacctcagctgaaaccccagctctgccactcaccagctgtatgacctctccgagcctcagtttccttgtttgtaaaaacaagcataaacataccaatttcatggggctgttacaaggactcactgaaataacataacaatcaggatcccatcaagaagacatctgcccttggaagtcagcatatttgaatgaagggactgcatatgggggtgaatgggcaggattgaaggcatcagcaagggatgctggggcacccagggactagccaaagctgagagctggtaccagttctgggctgagagatgtgtgttagtttgctagggctgccgtaacaaaataccacagactgggtggcttaaacaacatagatttatttttttctcacagttctagaagctagaagtctgggaccaaggtattgacaaggttggttttatcgcacccttctctccttggcttctatatagatgcttcctctccctacgtctataatctcacttctgcgcatgtctgcctcctaattgcttcttcacatgagggcaccagtcctattggattagcctgagacagcactgcagagcctcttcatggagggtgaagccccacaggctatataccagctactaaaaaaatggctaccactctctaaacagaaatctgatctgctgactggctggttggcatggagattttctttttctttttattttttttatgactaatgggctggcctctcctcatcaatctggctagatgcttcacagcacacgaggatgtctcatttgcctcccaagaaggacgagacagcgtggatggccaagcatttctgaccagttgattggacattggtcacccgtctgacctcattttaacttaactacctttttaaagaccctgtttccaaattcagtcccattctgaggttgctggggattagagcttcaacagatgaatttggaggaggacacaatcaactcataacaagatacaaagggaagcaataatggtgccagaagccactgaaggcttgaaccatggagatggctgccaagcagagactgaagtggaggacacagccattgctgggaacgttgcccacccacatgcgagagtgtgcgagggagaaacacactctctttcctcccaccctccaagctgttgccaaagcttccgatcaggaaccagccaccaggggatgccaggtgatcccagggcacagagaagggcagagtatggacctgggagtggaaaaactgagaatatgtgtctggcacagaaggggcactcacgaagtgttcatccttctcacctcataaatgaggaattaaagtagagaagacacctgtgacctctgcacacctccctgaatgtgttttcagcgtctgctttttttctgagcatgcgaatgagtgaataatgaaggcatactcagttgtgcccttccatgcagactcactttgtttaagctggaagttgcagaaagcttcctgccctttcggctgtttaggagctccacattccagcaggtgccagcacatgttcaactggtcagagctgctcggccatccacgccatctctcccttctggggagggaaatgagacatcatcgtgtgccgtgaagcatctagccagactgatagagagaggcagattcattatttgttaaaaatttaaaatatccataccatccaacaaactggccagcagatctgacttctgttcagagttgcagccatttttcggtagctggtatatagcccatggggtgtcagaccctcccatccctcccccagatggctctgcagtgctgttctatgctactgcatctaccccagctcttcaattattgcattgtgctccattttattcagtggcaattttaagaccaatatcctggtactactcagtatattgttcctgctatacagctgcagaaaatacttcctccttcctgaaataggctggagagtttttaataactactgtaactgcagtggcctggacacagccagaatatcttcattcagtaaatgttatctcctgcgttctgatggactgcctgtgaaagcctgtcttgtctcagagcaggacctctaagggacttgacatcttcatggatttctgagcgagagaagagacaactacagacaagtgagcgtgatttctgccttgggtttttcttatcatttactgtctaaaatgtgcaaaattacttgccttctgtgatttagtgattagctgaaaatctgtccaaatctggaaaatgacagtgatattactttactggaactgctgtaacaaagcaccacaaacagtggcttaaaaaagcagaagttggccgggcgtggtggctcacgcctctaatcccagcactttgggaggccgaggcgggcagatcacgaggtcaggagatcgagaccatcctggctaacatgatgaaaccccatctctactaaaaatacaaaaaattagccgggcatggtggcaggcgcctgtagtcccagctactcaggaggctgaggcaggagaatggtgtgaacccgggaggtggagcttgcagtgagccgagatcgcaccattgcactccagcctgggcaaaaaaaaagcagaagtttctggttctagatccttgaagaatcgccacgctgtcttccacagtggttgacccagcaatcccattactgggtatatacccaaaggattacaaatcattctactataaagacacatgcacacgtatgtttattgcagcactatttacaatagcaaagacttggaatcaacccaaatgcccatcaatgacagactggataaagaaaatgtggcacatatataccatggaatactatgcagccataaaaaagaatgagttcatgtcctttgcagggacatggatgaagctggaagccaatattatcagcaactaacacaggaagagaaaaccaagtaccacctgttctcactcgtaagtgagagttgaacaatgagaacacatggacacagggagcagaacatcacacatgggggcctcttggtcggggcggggggaagcggagggagagaattaggacaaatacctaatgcttgaagggcttaaaacctagatgatgggttgataggtgcagcaaaccaccatgccacgtgtatatctatgtaacaaacctgcatgttgtatcccagaacttaaaataaattttttttaaaaaagcagaagtttactcttccacagtcctggaggctagaagtccatgtgaaggtgttagccaaaccacgctctttccgaagcctctaggggaaaattcttctgattcttccttgcctcttccagctctggtagcaccaggcattccttagggtatatcttcaacccctgcctctgtcggccctcttccctttgtgtctgtctctatctcttcttcttataaggacactagccattggattggagtctactctaatccactatgacctcatgttgacttgattacaactgcaaagacattttccaaaaaatgggtcacatgcataggtattgggggtcaggacttggacataccttttggaaaggacataattcaacccataagaacacttttcctcaactttttatttgcaaagcactctgtggttaaaaggaactatctgtggaatctcctcagatctgcagggttgaccaggaattatcactctagttcggcaagtgagtctaaacagactaaggaaagctgagatgagcttaaacagattgactatagagaagcagagagttggaggagtcagaaatagctcaggaggaaaggttgggggagtgtcagggacttagatccttgacctttttttttaacttcgtattagttgttttgctttgaccagccacatagcctttctgagcctcagtttcctgaagccattggggatagagatggggcatggatttgataaccttctttgaggtttttttttttctagcttaatatagattccagaaaagactagcaaagtaggcagcaggcatcacccacccatgaatgcccatccagctttgagaagggggtctctgttggtgcatagctggacacacaaagccagaaattcgctcatttccagtcagcttcaggacccacattcctttactttaaaagtgggaagaaaaatatatgaagaactcgtccaaaccagtaagaaaaagggcagacaacccaatagaaaaatgagcaaaagaacaggcagttcccaaaagaggacaaaatgggcaattaacatataaaaagactatgaccctcattagtcattaaaaaatgcaaattaaaatccatattgttataccactatacaaagtgtagacctaaccgaatgcctaaaatgcaaaaattgagacaatgccagtttttagtgggactgcggagcaattggaatacttcagaaccactttgcaatatctacttaacctgagcacatgcacactcaatgacctggaaattccacttggaggtatgtactcaacagaaatgcatacacatgccgtcaaaagacatgttcaagaatgtttattacagcccaaatgtccatcagtgacataatgggtagagtaagatattcatgtcatagattattacacagcattaagatgaacaaatgacaatggcatgcatgggatggatggatttcacaaatgtaatattcatacaaagggcacatactgtatgattcaaagcatataaagctcagaaatggataaaactatgctattgtgtaagaaggcgagatgagggcaggcaccatggctcatgcctgtaatcccagcactttgggaggccaaggcggtaggatcagctgaggtcgggagttcgagaccagcctgaccaacatggagaaaccccgtctctactaaaaatacaaaattagccgggcatagtggcacatgcctgttatcccagctactcgggaggctgaggtaggagaattgcttggacccaggaggcagaggttgcggtgaaaagagatcgagccattgtactccagcctgggcaacaagagcgaaactccatctcaaaaaaaaagaaagaaaaaaggcaagatgatggcaagatattgggtaggtttttgactgtaagggggattctggtttagtgatattctgtttcttggtctgggttctagttattcaattcatgaaaattcatcaagctgtacagttatgatctatgcacttttctgaatgtacattccactctaataaaaagtttgcttataaaagcaaaaaacaaaagtactctgcaagtttttgttgaaagtatttgccagccaccaaaccgtttgtgtccttagttctatcacaaccttggccaaatgatttctgtccagtgagataaagaggaagagtgaagtgttgttgtctaaaagaaccacttcccacaacatgaaatccaaccacacccacctttgggagcccaccctgtctgcctagaacatacctctatttgcccataacacctccaagctctctcgggcagggacgactgtgttctttgtctctgtgttgctaaaatatatatttattgaatgaatgagtgagtgaatgaccacaccccattccattcacacttgagaaaaacccagccaagttagggaaggtttgagatggaaggatttccactttctctcccacccctccctccttccctatctctctctctctctctctctctctctctctctctgtcactctctctgtctctcactctgtctttctctctcaaaaagctttcaggaagaaataatttaaaaagcaaaagctggattacagaaccttttcatttatatgatcaaaagtgagtcccaggtaaaatcagcaggggattttaaattaagtggtttttaataaacttactttctgttggattatgaataagaagagaactctagtgcttcaaagcagaagggaggaaggttgcgattctgagggtgatttttatcagcatttctgagatgagagtctgcacgctccccagagcctcctgctgagcagctgcgctgtgtccataggatttcactggttcaaaccagcaaagcctcaaaaaccactgaaggactaaggagcaaatcttcattttcacgtagtggatcctgcattagaggtggagagctgaggaagtgcagaccaaagccagtgaggactcaaactgaagggacaagcaatatcctattagagtcctgggggaaaaggggcaaatcgttctgacagtgttggaagccgtaaccacctttgagattcactgtgcacactgatatatcaaaacctatttaactttatttaaccctaatcaatcatctcctacacttatttaacttatttagccctgcttccacaacatttactagcatcctacagaatgctacatcatacactgtgagaagtactgagtttaggaataaaaggtttcatctgaaacttcctctgaacctcattcaaaggagtcatccaggcactttggtccctactttctcctcctgagccaaggaggtatgtggtctgaattgaccaacccaattctagctacattcttgtagctagcctaaagaatgaaaatagggcagggagggaatagtggcagaaccttctcttaaacagttttcataatgcaagcttaaggcattcccctttgctaaaaaagttttaaagagttcttgcctgcaagtagtcctctacatgctatgaagttacttggatggtttcagatgcagaaagaagggaatgttcctaccatgcaggagggaaagttgacataagttagcgctgacacagtgtcctgagttgaatatttattggctccatccggttacccactatcactaatcttggatcaggccctaccctaggcctacagcttccttttcatacaggactgtcctcagggaagccctagttttcctggctttttttttttttttttttttgaggcagagtcgctgcgtcacccaggctggagtgcagcggcgcgatctcggctcactgcaagctccgcctccggggttcacaccattctcctgcctcagcctcccaaatagctgggactacaggggcccgccaccacgcccggctaatttttttgtatttttagtagagacggggtttcaccgtgtgttagccaggatggtctcaatctcctgacctcgtgatctgccagccttggcctcccaaagtgctgggattacaggtgtgagccaccatgcccagccctttcccggccttttataatgattgggatcttcccaggttttcacagaggcagtctgcttatggcctgtggtcttctcaaagtccttcaaacatttacttactgctcctccaggagctactcttttgttttggctttagacccctgattcagcaaagcctcaccgtatttagttatgagcatgtagatacacacacacatacacacacacacacacacacacacacacacacacacacacacgctcccaggaggttgagaccacatggtatggttgagaccacaaatcaaagagtgaaattaattttaccacacgttagttatatggaagctttagtttcttcatctgtaaaatggaggtaattctgtctaccttagtttcttcatctgtaaaatagagataattccatctactttgcaagtttgtcataagaatcagaggtcatctggctgggtgcagtgggtcacacctgtaatcccaggacttcgggaggccgaggcatgcggattacgaggtcaggagttcgagaccagcctggccaacatggtgaaaccccgtctctactaaaaatacaaaaaattagctgggtgtggtggcacacgcctgtagtgccagctactcaggaggctgaggcagaagaatcacttgaacctgggaggcagaggttgcagtgagccgagattgtgccactgcactacagcctgggtgacagagcgagactctgtctcaaaaaaaaaaaaaaaaaagaatcagaggtcatctaagttaagttccttctctctagtatactgcagttgcttgataaatagtaggtattatcatcattgtcaccctgtttagcttctctttttttttttttttttggcagttgcactggcaaaaaataatgtctagctcataaaatagcattattctcactttcctctctgcacagatacctacttttctttccctgccatcttgattactgagctgttgctaaaaagaaaacatggccctctgatccacagatgaaaagccctgctacttgaccagatgttcatgagagaatcctttgatttttaatttatttattcatttatttatttagcgttggtctctgtgctcccagcacaacagctgtaggtaaagtgctgcgggtcacatgcatcccagccagctcccttgacagtccttgtcaaatttaaggcatgttgcctctgtgcagagcactcaggggcaaggggcttgctccaagctcccagaccccgacgacaaggatgggaatgggtggatcaggcagcagcgaatgccaggcaaaggccaaagtcaagctttttggcaccaccttccacctgacagcagaaaagcagggtcaaaagtctgatttggggcacgcattccaaagccaaatccgtgttgtttcagcttaaaaggctccagtttcaaatggaaccattttcataacttgaagcagtagtcacttaaaaatcctctttctactttgcacacatgcacataatttatattaaatccagtgggaattaggcaagttcagtgagggataattagacaccttaatgaggaaatgtatagtttctgtaactgtcatttattaagcttttatgtactacttcatattttgaaagcactgcacagccattaattaggatatttccgcagccccataggagcaaggtcaataaacagagttctgtttctcttggaaatgttgtttctcaagtcttttatgacctgagtgcaaactcctaacctttgaagaaactggcagattgtcttataagctcatatcaatatgatgattatatttaacatcctaaacagactcattagctgcttaagaatataatttaagctcataattttccatacagtggattttctttcctttattattatttgttttcttcctgtggatgtatctcttagctgccacttggaataacctcaagagatctcctaagcatgcaggctgtgacactataagccacctattttcagaacactgagaaggctatgggcctggaaatgtttgcaaatattgcaaatatttcaagttgtccagtacatttcacactcacgggaattttgaagattatttgaataatcagtggattacaaagaaaaatgatttactaggtttggacattaattatccattaataattcccactacagcactggtggatactcttccactgtaccagatgccatttaaatctttaaagtggcatccactttaaagatgccatttttcttgcttttgttgttgttgttgttgtttttaagacagagtctcgctgtgttgcccaggcgggagtacagtggggccatcttggctcaccacaacatccgcctcccaggttcaagcaattcttctgcctcagcctcctaagtaactgtgattacaggcacccaccaccacatctggctaatttttgtatttttagtagagacagggttttgccgtattgaccaggctggtctcgaactcctgacctcaggtgatccaccctcctctgcctctcaaagtgctgggatcacaggcgtgagccaccgcacctggcccccattttcttttttgttcctcacaatcaccttggagttaatgtgggattgtcactatattacaaataaggatctgaggcttagaaacacagtgacttttttcaagaatcatattgatattaagcagtgatatcaggactcagagccaagagtgtgttttccaagtccactgcagttttttctttttccttccccttctgggatagctacaaaaaaaaaaaaaaagaagaagcgtgtgttcccagaattcattctgctgtgtcactctgaggatgtgaggatattggttataggaataacctgtggtaggctgggcacggtggctcacacctgtaattgcaacacttggggaggccgaggcaggtggatcatgaggtcaggagttcgagagcagcctggccaacatagtgtaaccctgtctctactaaaaatacaaaaaattagctgggtgtggtggtgggcacctataatcccagctactcgggaggctgaggcaggagaatcgctagaacccgggaggcagaggttgcagtgagccgagatcacgccattgcactcctgcctgagcgacagtgcaagactccgtctcaaaaaaaaaaaaaaaaaaaaaaggaaaaaggaaataacctgtggataattatagatttatgagcaaagacaaatgttttcacccatgctagacaactttatgcagcctttctaaaattttcttttttgggagaagagggggacatgggtcattaccttttgaggtctgcagttcagatgtggtggacagtatttgctacctgctagatattcagcaacccattcctttgaaatcactgtcctagagagagaagcctgtctggtttgacctttgttcttcctgtctctcacttatataaccttttttatccttaagtttcagtgtagacatcattcatttcaagatgcccttcccctaatgcttcccctgagacacagtcagtttacctgtaccccagctcccatagttcttccccacctcccatttatcacagtgctttgcatttttgtgattacctgtttcccttccctatcaggccttgctccctgagaacaaggactgtgttttaaaaacttccaagtccccagttaactaatgaatagaaccaaagcaggtgctcaaataaaaaaattttgaaatgaatcatagacgaaatgacttctgaatgcaggacctatgaggatgtgaggatattggttataggaataacctgtggtaggctgggcacggtggctcacacctgtaattgcaacacttggggaggccgaggcgggtggatcatgaggtcaggagttcgagagcagcctggccaacatagtgtaaccctgtctctactaaaaatacaaaaaattagctgggtgtggtggtttacacctgtgttcccagcactttgggaggccaaggtgggcggatcacttgagttcaggaattcgagaccagcctggctaacatggtgaaaccccttctctcttaaaaatacaaaaaacattagccaggcctggtggcgcacacctgtggtcctacttactcaggaggctgaggcacaagaatggcttaaacctgggaggcggagggtgcagtgagctgagatcgtgccactcactgcactccagcctgggcagcagagtaagactctgtctcaaaaaaaaaaaaaaaaaacacacaacaaaagcagacagagtcccctctggtttggcatgccaagagcagcttgcctatggcccagctgtggtgtctgggagccctgattcccagaagcccacatgagcctgtgtcagccgagcacacgtgtgacattcatgtttaagaggaagcatggtctttaaaaatgtctaggtacaaagaagagccacccatgggttctgctggcacaggaagcacagggtctttattagttctaatgttctaagataaacagggcagtaagaagcagttgccagcactgtgacatcggaaacatcacctccatcctcagcacctcggttcccacatcgatgcaaacttagcagtaaggtctaaccagcccccctttctaagaatgttgtgagattagaggaggctcaggaagctgagagtgaaattcataagctttgtgacatgtttgctcatgaatgtttttgtctgctttggattctgattcttggttgaatcggggtacagagagtggtatatttagtaaacgttctggaattccaaagagaaaagcagcctgagaatcagctcatcaaattcacagaggcagaggttgcggttgttttatggcagagtgccagttttcctggatgaagtggtctgatgaaagaaaagaaaattaaattatggcgagaaccagatggtctggccacaaccaaggggttatagcttgttctgaagaccaccctgaaatactggaggcctttgatcttgtgaaatggcaggataaatgacagcaacattttagcttggttttttttgtttggttggttggttggttggttggttggttggttggttggttggtttttgagactgagtctcattctgtcaccctggctggagtacagtgatgcagtcgcggctcactgcaacctgtgcttcccaggttcaagtgattctcctgcctcagcctcccaagtaactgggactataggcacacaccaccatgcccggctcattttggtatttttagtagagacagggtttctccatgttggccaggctggtctcaaactcctgacctcaggtgatccgccagcctcagcctcccaaagtgctgggattacaggcatgagccaccgcacccagctagtttggcttttctaaaacagattctgttgtagtcactctcttgctctacatccttgtctggctttcagttgtcctcagtaggacttcccaaccactgtgtcacacatgggtgacaagtgccaacaaaatcatctcctgggccttggggatactttggtagggcctggggcctctgaaacccttggatcagcctttccagccataagcagcttaactcccagtgggttttaagaatagcattttctctgtaggaaacggcataaacatggttggaacgcacctgtgttgcatagatacgaggctcttcctgatttattgcctgtgcgtgtgttcaggcgtctgtcctggcatttgcctaagcctgctattgaaactgtctggccatgatacactctagttcttgcgtagcccagtcttgtcatgcatctcctgcctctgtgcctttgtccatggtgtttcctcagacagcttccccaactgcctgaccaagtcctagcccaggccacccaggcctccctcctgtgagctctcttcataagcactgcatgatctcagtgtttgcagtcatcacattgaatcctaatgatgtacgtgtcttatgtgtgtttccacaaaagggcctggcaaagaatgaatgttacacctccagtaaatatatgctgagttaatatgttgaataaagcccatgagattggccaggcgtggtggctcacacctgtaaaatcccagcattttgggaggctgaggtgggtggatcacctgaggtcaggagtttgagaccagcctggccaacatggcgaaaccccatctctattaaaaatacaaaaaatcagccaggcgtggtggtgtgtgcctgtagttccagttacttgggatgctgaggcaggagaattgcttgaacctgggaggcagaggttacagtgagccgagatcgtgccattgcactccagcctgggcagcagagcaagactctgtctaaaaaaataaaaaaatttaaaaagcccatgagattggtgaaagtagtgaagcaaaataagtacaagtctatttctgtgaattcacacatagtagctactcagtaaataactgttgaatgaatgaataaaagaaatgtaaaaggtgttttaaatttagaatctgtggactcagtaatggctgactgtaagagaaatggaagatggagtagttgaagatgtttcaagacaaggagcgccttcaacacggcaatcccggtccaactttggaagctgcaccctagctaagctctcgagacatgaatcaagattaggatatttattgcagcattgttcataatggcaaaaacatagtaaacaaccaaaatgtccttcaggagaggaatggataaataaattatggtataggtataaaatggatgatgtgattacagtgactaaactagataggaaatactaacatagttaaatcttaaagacataacagtgggtgaaaaggcaagttagaataggaaatacgcaatccaaaacacactaaaaataccatgtgttattatgtgcatagaggataaaaatataaaaacaagcctaggaataaaacacagacccctgggaatactggctgcctttgaggaagagaggaggtagaatgagatgaactttagatttatctgtaatgctttaattttttaacagtaaatgtggcaaggtattataacaaccattatatctaggtggtgggtattcattatattagtttgtgtgcttttctattgttttgaaatagttcataattttaaaaattaaagtcacgcaaaagaaaagactggctaacagggaggatgatcctgcatctctgcatttagtcatctgttttagacattccgacttttcaggcaacctggcaaatcacatctgccaagtctcacaccatttaaaagcatcagttctcagcttggtcaccagagactcataggtttatcctggacctctctagaggcttcaaaaatgtgcattaatatatttcatcattgtttctagtttcccaccatccccccccccattttttaatacattggagcatctatccaacctaattataattcatttttgtaataagattaatgaaattctttctttcttttttttttttttttttttgagacagagtctcactctgttacccccactggaggacagtggtgcaatctcagctcaccgcatcctccgtctcctgggttcaagctattcttgtgcctcagcctcaggagtagctgggactacaggcgtgcaccaccacacccggctagtttttttgtatttttagtagaggtggggtttcgccatgttggcggggctggtcttggactcctgacttcagatgatctgtgcaccttggcctcccaaagtgctgagattacaggcatgagccaccacacctgcccgccctttttttgttttttgttttttgttttttgttttttgagatggagtcttgctcagttacctaggctggagtacagtggcacaatctcggctcactgcaacctccgcctcctggattcaagcacttctcctgcctcagcctcctgagtagctgggattacaagcacacaccacaatgcctagctaatttttttgtatttttagtagagacggggtttcaccatgttggccaggctggtcttgaactcctgacctcaagtgatccacccaccttggcctcccaaagtgctggggtcacaggtgtgagccaccatgcccggcttcattcatatttttgactggaatatattttcttaaatcagtcaccagtgacttacatcactatattctcttggtttgtaactttgtaaatgtttcttttctttctaccccccccaacattgtttatctgagtaaaacaatcagataatacatttatggcgaacaatttccactgtgtaccttcctccccaactccatattcagtgatatgatattgctagcttgaaattagccatgatgggagtgtttacaccttggcaattggcaaatgctacaaatccggccgtttttttcccccagagagctgatggttaaacattaccagcctaccacaagagtgcgcaacagttttctgagctgtgcagggcaagtagcatttttctcatttaacactcatagaaactgagagtcaacaaaagacagatcttgacctgagtcccatggctccaaagtgacattgctggggctctagtctatgtggttgagtggaagaagcactggccttggaatcacgcagatctgagtttgaatctgacatagctacttttgaacagtgaattgacaagtgtccgatttagcccctcagtttcctcacctataaaataaggataacaaaatctatcttgtagagatctcagggagcattaggggaaatgatacgtgatgtgcaaaaaccctaacaaagcacaaaggacctatgcagcagatctaatttgtccttcagacttacaagttcagatctctgtgtattaacccaatcttcccatagccatatagatactattttttttccaactccacctggccaaacacctttcactaaatggtgaatatatcttttctccaaatatgtgccactggaataagtaaagaggcttagagttgacatttgtatgtgatttggggaaatcagtttctttcctagagtcttggaaatgcaggtgctaggtttcaactaagatcatttttcaactgccttgagtcttccccactgaccattctgctgagctaagcatcctgaagaggattgatttgggggcctctgggtgctacagttccacccaccaaattgactgcagtggcctgcagggaaattctctcggctttttgtgttccgtgctcagggctttttctgcttgctctaactgacctgatggtagatagttgcttctcagccattcagctaagcctaagtgtatttttcttttttagattttaactgatgtatttattttttgcctgaataatatgtttagttgttttagctttttttttttttttttttttttttttgagacggtgtcctgcgctgtcgtccaggctggagtgccgtggcacgatctcagctcactgcaacctccacctcccaggttcgagtgattctcctgcctcagcctcccaagtaactgggatcacaggcatgcaccaccacacccagctaattttgcatttttagtagagatggggtttcaccatgttggccaggctaatctgacctcaggtgatccacccacctcccctcccaaagtgctgggtttacaggcatgaaccaccaccacacccggctgttgttttagcgttttaaaaaacacaaaaggatatagacaaggggagtttccctccctaaacaaccctccattcacccaggtcccttccgcagaaagtaaccaagaaaagataccaaggaagaggaaccacctcttattattagtttcttatgagctcacaggcttctggagctcaccttaaagacccagcgtggatgggccaaaaagaccctcttgaaatcaggaagactgagacaggcccatatggcttgtcagtaatcatcaagcaaattggcaaagccatacccagaataaagtcacagaggagctgcttttgtgtgtacggataaatggtatacatcgtacaaattccacctatcagctcaacctaggtaggtggtcatatctctggggaaaaacacaggagagaacctaatgtctataaggaatgtgctctgtatccagtgcagagctagaatcttttttttcattattgtggtgagatatacataacataaatttaccgtgttaaccatgtttaaacgtacagttgagcggcatgaagtccattcacattgttgtgcggccaccaccactgtccatctccatacaatgctaggctctccctgccctcatcacttactccttccaacagtcctttgaggcctgtatgaccagtctccatacaacaaggaggtctcagagagatggtttcatgtctcctatcgagtaactggcaggtcctaggcttgaacccaggtgtattcgtctccaaaacaggtgccccatactgtggagcctcattggaagaatttttagagggaagactcatctgcagcagtgcataggcctcttgtctgcataagacaatcatccccgagagactgtggctgtgatgtgagtaggtgtgcctagctctccatcttttttattttttaattttctcttttatcctgtgctgttgcccaggggtgatcctgttacttctggataagctgcggaagatgaaatgggagcagatgtggaggctgaccgcagagagggagctcatgggcatgctctctacatccttagctgaccaggtgagtggccaggttcgaaggtgcagctattcctgagtgtgcttggtgctgtttctcaaagaaacttaaaattaaatcgatctgaatggttttctacgtattgtgtgactctgtgtgctctgatacagctgccttattcttgccagtctaagacaacagctcaactccttagtgccttccctttgttcattcatttgttcattcggcagactttcactgagtactgtgtataccaggagccaagttcagaaaaaggatgacagagatagacgaaggatgcagcacttgccctcatagagcttagcgtctactgacgcagactcataagtagatgtcggtgccctcttcatcaccaggtggagtgcacagggcctgctctctgggaccccagaatgccacagcatatttcccaggcaaggtttcactggcctccctggcaaatagagtctaacctttaatctgagccttttgcttagatgctgtcctagtgtccctttactcaagggaaatgcacttaaatagaaagaataaactgcaagaaaaccaccttgctatgcaggcagcctcagaaactccttgaactctaccaaactgttagcaaatattcatttttattattttattttatttttgaggtggagtctcgctctgtcacccaggctggaatgcagtggtacagtctcggctcacggcaacctccgcctcctgggttcaagcaattctcctgcctcagcctcccaagtcgctaggattacaggcgtgcagcaccacaccaggctaatttttgtatttttagtagagatggggtttctccacgttggccaggctggttttgaactcctgacctcagatgatccgcctgcctcagcctcccaaagtgctgggattacaggcatgagtctctgcacccagccaacaaatagtcattttttaaaaacctattcctcattttgacgtcctaggaaaggcagagggctccagtctgactttgagtctaccaggatcactcatttaaattttcatcttcctgtggcactggtagctgtcttcaggcacgaagatgatttctctgagttttctgcatttcaccctttccttttcatccaaagagccagctcactctgcatgtttttgttcaaagtgcaatttcctggttcgtcgaatgcctgcaaagtttcataatacggaggaaacaagaaaccctgcatgattactttactattttttaaagtattattattcagtatttcccaagcagccagaaactgatttcctttttcaaacatgagatagagtataatgaatgagtttaagaaaaaaaataatacccaggtagctgttttaaacctgaggggaaaatcgtccaccagcctcatatttcaagtcgggtcacagtgacttgagcatgtcccccaaagctagcaattgtatgcccatgtccagtaaggatagtttattcagccatcttctgccacgaaggcccataattcacctcccggcgccacctgtcagcagctagttaataagtatggcctggtgcaacagcttggagaagagcccaaaaaaggtaaaacctccctagacaagtcagggttggattttgaaacggggagtgcgtatcctgggcaccatgggctgcagaaatccaaggagcatccatcactgagtccaccgcaggccccaggaagcactgctgaaagggaggatctgtaatttgtctcagtccctgaatgagtggggctacttgtcatcatgcagtttcctctccaggaggctcaggatgggtaacacagggctcctgcctaggaggccagaggggaaggagacttcgtttttcatatgccagtgagggtagggaagacaccccatgtctgcacatgtgagctcactggatagggccttatgagaccagcaggactctggagcttccagtcagcctgggacattcccccgtctctatccaaacattattgcttggttcctagagataacaggcaagagagatgcctcacagtgcgagccagcctgtgttcagagcaggaggttcaagagaagccctatcacaggggatgcagtgccttgagagccaaaatgggcagctggaccatccgactgtcttgactgtgtctttggctttcatcccccaggatattttcaatgccgtcatcaaacaaaaccccttccttgtgtaccagctcccctgcttctggaatgtgcagctgtcagaccacacccgctccgagcagtgctacagagacgtgtctgatctaaaggtagggtcaacacagggacatccctggaggtagggtgaggtgggccgagaggacctcccaggggcatggatggctgggagatttatgtgcaatgtggtgagagagataagggcacaggagagcagaatgagtatgcttttcatctttgtggggtgttggtttttttccacccttatttgggctttctggaaagcctaaagcctcctggcgtaagaaccagcttgtgtggttattattcttgccatctgctgctggctcttttggttcatgccagctccccaaatctattcattcaactcaagcaaaaacatttattgagggcctactctgtgccaggtgctatagatgtggatgtgaataattaacctgcttccaagtcatgtatgacttggaggaggagagaaatgtgcaaagaagtaagtatttaaaaaaggacaaagtgctatgacaggtgtgggtgggtcagtcggggagatgcaagcataaatgtctcattcttcctcacagagggcggacaatgacagaaaaagctttcatcaccactctgtaggtaccaaacactgtgaatgaacctggctatagaaagaggaagaagacagggtatattagtcatctactgctatagataatgctgcataacaagctattctgatagtggcctaaatcagcaaccatttatatagttgatgagtttgtaggctggttggatggttcatttttttactggtttaacagagtatttgtggtcagcttcagatgggacagctggtgactggggcaacttagatgtcctctgtcccctcagcaagccagtatggtgttttctcatggtgaggcagaggtggcagaggaagccctaatacacaagaggaaaccttgagtcattgttgctaatatccctcattggccaaagtaactgtatgactaagcccgtatgattactttgagtaaggagtgtgagttaaggagtgtgttagaattccctccctacagtggaaggagtaaagaattgaccacaactattcaacagaacgaagatttcaacacaggcctgtctgacagcaagggcttttgcctctcaggttgtatcacagaggattagatacatgcatccttaaagaatttgttccatataaagtttatatccattgcaagttttaaaaaggaaaaaggattgcaaagctagcttttctaataaattagtcttttgtacttggcttctgatccatgtccccatgtgggtattatgtcttatttgtagtcataacgcatgttaaatgtggttttctgcttttcatttgttgcatatcataagcattttctgggtgagccacatggtgttaatgaacatcatatccaatagttagtctgttacctagccactcccttgaccttagttgttttcaaattttcataaatataaattatatcttaattaacagctttgtccatgaagcccttccatccaatattgttgtagcttgcctttccaggaatgaaattatagcattagaaagaaagaacttttttttaactgcacttgaaatttatttcaaaatattagaaaggatttaaaacagaggtgcctgcaacattcattccttccatcggcatttattcagttccttctgtatatcatgtgcttgttagaaataaggaaaagagaagaaacagacaggaatattgtcaagaatatcatggattaaaaagtttggagagggggcgaaataaaaccaactgtgtaaagaatatgtaaaaatgctggattaaaaaatattttacatgctttgaaagcataattgatcggttcataaagcaagtaaagaaagcaaaggccagaaacaatgacagagtgaatccaaaaagataagcaaagagcaactggatgtcacctttgcccttggaagggatgatccctagtggcagggagcctggtttaaaggtgagcctggtattataagaaatctatttagtctttgtccctggttcctggaacagagctcctaaaacccttgaaatttcctgagtgataagaacagcttttattgtgtatatgagcccctttgggttatacctgagtttatgctaatgaggtgtcttagagtagggcccctagagagcctcaggatggaaagaccaagtgatcagagggttagaacttccccactgatcaattcccacctacgagtgagaacatgcggtgtttggttttctatccttgcaattgtttgctcagaatgatggtttccagcttcatccatgtccctacaaaggacatgaacttatccttttttatggctgcatagtgttccatggtgtatatgtgccacattttcttaatccagtctgtcactgatggacatttgggttggttccaagtctttgctattgtgaatagtgccgcagtaaacataggtgtgcatgtgtctttatagcagaacaatgagaacacttggacacagggtggggaacatcacacaccggggcctgtcatggggtgggggagagaggaggaatagcattaggagatatacctaatgtaaaggacaagttagtgggtgcagcacaccaacatggcacatgtacacatatgtaacaaacctgcacgttgtgcacatgtaccctagaacttaaagtataataaaaaaaaaaaaaagaaagaaatcactcagcaaatataaagctttgcctgtgtgacttctttcataaaataaagactttacgacactcaaaaaaaaaaaaaagaacttccccactgaaagttccatggacctctgggaaggcaggagggtgtgctagaaatcaagctctttaaatgctcttgaataacaagatttgatgaacttctgggttggtgaacactattgttgctgcagggtggtgtgcccagagaaggcatggaagctccataccccctcaccccacacccccatattttgccttatgtacctcttctctctggctgttcccaagttgcatccttgataataagctagtaaatgtgtttcccagagtttcaggagccattctagtaaattatggaacccaaggaggggatcataggaatccttgatttacagcaaatctgtcagaggacaggagactgggatttgcaactggcatctgaagtgggcagcctcgtgggactaagccactaacccatagagtctgatgcttttgtcaaggaggtagtgtcactgttgtattaaattatagggacccagctagtgttgaagaactggtcattgtaggaaaataaccccacaatatctggcatcagaagtcttctgtgtgagagtatagaaaaacagtggtttttctcaataggtaactgtataatttattgttcaaacaagcgaatgctatcatgggatacagagggacaataggccaacaggcaaaacatataattattctgttgaaatactatacacaggaccttaggcccacaagaagaaagacctcacataaaggcctcacataaagtcaggatccacaaagagtattatcctcagcggataaacagttaataaaactcagagtgtagaagaagacagtagaggttgttgtctgtttcatccttggttttaggtagaatgagggagaaatgtttcctctgagattttattttaagcctatgcccatattattttgggggctgaaattacatgtgtgggagcaaaaatggaaagaaaaaaaattaaaaatttgccaggcacttggcagaaactaacataaatctgatctagaagaatattcttaaaaacaagtcttcagaattttttaggggaagttacaaggaaagcaaggttctcaggaatcacaaaacacacaaggaagtaagctaccctgagaaagtgcaaaaactgaagactggagttaaatctgaaagactgcaaatattggacttaccagatataaaacataagtatttttattacatgtagaaataaaaaatgaatattgaaagtaggatgaaggaatagtagattctcaaaaaatgaatagccgtatttggattaaatagtatttttagaagtgaaagatatgattattgaaattaaatggatatgttaaacagcagcttaaacacagctgaagagagaattagtgaactggaagaggtataagaaattacccaagatgcaacacagaatgaaaagagatagaaaaactgagaaagaagcaaagaaattgggatatgtctcattggactatcagaaggagataatagagaaaattggaagtgaggcatatcttaagtatgccaagaaacaataacaggttgtatacctagaagaataatctttcaagtataagataacaaagagaattttctgcaaacatgcaaagaaactgctaaagtattgtcagccttaataatgaagagatcctctctaaaagaaaattatatttattctggaatagtgcattgcaatgggaatatacatgccatagcaaactatgtgcatacccagggaggtaaaggaagataaaggtttttaaaggaaaaatgaagaggattttataattgtttggagataattatctttggccaaaggatcagtaacaaagttgacaccagtccaagactggacaggcagttgctgggcagacgtgcctgcagaagtttttattttgtgtgtgtaaagttacgatggcatttgtgcaagattgtggttttcacggagtcttttgtaatcattcttgttatcagacacttgtggaagaaaagcctctttccatggcattcctggttctatttgtcagggttttgttaacacaaatgactccatttttattttggcaacattcatatttcacccttttgatcaagatgtttccccaaaagtgtcactgttcagtcatcctttagttaggttttcatgtctctcagtgccaggatggacctctcccaggtttctggtcttgtttcacgttggagagaatgaatggcagctaggagtcagtgtcaaaacctttttaaccacatttgagcaataaggaagtttaagtggggtgctcctcgtctgtctacttggagtctgtaattaagttcaattttgtctgttccataggcatgtgttaccatctcaaagtgctgggttagcattatactgttaggattcgtacatctgtaaaaaatttgaacaagtaacagatacaaaattaaagagaaaaatgcaaagtaaaattaatagtgatgtgacaagaacagtttgcataaggactttgagcaataaacctaggctttaaagacagccaattgaataaacaaaatgaccattatcctaccaagtgaaaaaggtaggctttgttatatcattatgatatagagccttgttctgacatcttgaaaaaaagctgtctacagcatgaaaacaatcaactctcgtcctggtttgcagtttgaatgtctctggtgatggcatgggacagtttggtgaaccttgtgtggcccagacatcaggcacgagacttatttcttaaaattcatctagtttcatcttatagggcttccaaaacagagaaattcccatttgtggtaactgcatagaagaaagtaggattgtagaaatctagaagagttctataggcaaataacaaatagcaatttgctctataggcaaataacaagaacttgaaaacagtgcacacagctatcatctaataacaggtgtattctagctttctttagaaatataactcgtgtccgcatttttttctttaaatcatagccatatgggaaattttctattttgttatggttctcttttattgatgggcatgcagtgagtgtttcttggaaatggccaatttttattaaaatatttctggaagaaaaaaaagaacagaaacataactttttcttcctacggtgatattggcttttccaaaaatagagtaagacaaatttgtttctaaaataaatttagtttttatcaaatattgcctgcaagaatagtgatttgaccacatagtaatctcagatttaaaaacctttcaaagctaagctggtggcaagtgcctgtagttctagctactggggaggttgaggtgggagaactgcttcaccccaggagcctgaggttacagtgagctgtgattgtgccactgcactccagcctgagtgacagagagaaaccatgtctcaaaaaaataaataaaaaataaacataaataaaaataaaaatttcttgaggttaataagataacccaagacagactttaggttatacttacagtcctaatgttcctgcacctgccaggaattgataatttttattcatctactctaaggctgagaaccctagaagtcaggcagtttatacatattctcagatatgacatttcagtcaaagccttgatgatataaccaattgttgccattgtatcctgctatagagagagagttaattttttttttatttttaggagagacagagtttcaccatgtatgccaggctggtctcaaactcctggcctcaaggggtctgcccacctggcttacagacatgagccactgtggcaggcagagagagcaaatgttattgaacttgtataaataaccatattaccgtaaaaaataagaatactcacaaaatctctccaaactttggagagagaaaattggaagaaggaaatgcttctaccttgttcacaaatatatagtttaccaaatcattgtgcactatagacagcttagggaagaaaatttccttaaatctggaaaacaaaacatttaagtgaagaactaacagtgttttaaataaaagtcaaaaacattatcagttacttaatctcatgcaatttatttttgttctgcttgagcttgattagtagtttcatgaattcatgtttcttcattggagttctcaaacatttgcatttagtccattgatcttaaagtttttattaacctatatctaagagtacttgttagagtcgcttccataaatttgcttgcaaatgcctttaaagaagaattcaaaacaatagctgtggataaaaacttagaatagccatggctaaaaatctgatgggagttcattataataagcaattaacatggaaatttagttatttttgtgccacacaacataatgtctagaattttaactaatgtcatattagatttttaagaattttatataatttgggtagatacccataaatgtaatgcaaagaagatctagtatcacttattatttgacagcatttagcatgcagttcacaaaataagactaatcatttaatatttctacaagatgagagatacattctttgagactctccagagtctctggaaaatccaaaagttaatttcaggtcaataaaacttaagttagaattttgattcatggaaacctgccaaagattttaaaaggttgaaagcacttgataagaagttactgtgaagtaatagtcattcatgtaaccagagtgattatcaaaagacgatagagaaacttacgtggaatcttagtgctttcaaaactccattttcctaagtaatcaaatactgaataaagataacacaggaaattatattgataacatataaaatgtttgtttcttaggccagttattaaaaaggtaagaaacaacttcagcaggttgattgcttctccttgtgagaagccaatgtataatagataaccaggtagtcgacctgatgaaaagggtacttgaatttaatctgacatagaaagaatgagtccaaggttaggaatgtataccatattatacaggaatgtaaacaagaaaactagcaccttgagcaggggaatacatggtccttagtaatagcacgggaagtttcttggttacatgggataattccgacatgtcaagaaaagccaagagtacaaaatcaaggtatactggtggaagacattgcctttgtaggccttcaagataaactttttttttttttttttttttttgagacggagtctcactctatccccaggctggagtgcaatggcgcgatatcggctgactgcaacctccacctcccgggttcaagtgattctcctgcctcagcctcccgagtagctggaactacaagcgcgtgccaccacacgtggctaatttgttgtatttttagtagagacagggtttcaccatgttatccaggatggtctcgatctcctgacttcatgatctgcctgcctcagcctcccaaagtgttgggattacaggcataagccaccgtacccaagataaacatttaatggacaagccataatagcagagttagaactgggggaaaaaaaacagttacaggaaggaatggaaaacttaaaggagagagttatcccaggccttctcaagggtagaaagacgaagagcagaaggcaatgatgtatgacctgaaaatcacatgcagcaagatatagcaaaagttgaacttctgagacatgaatctgaaaagcttccagaggaaacctctgcctcaagaagtgaaattaccattctaaatgaagaagacagcatttctaacccaaaactagggaaattaaatggatctcaggaagaaattttgcagaaatagaaactgcagttcagaagatggcagttaaacagatttcagaattaaaaattatgatctcttatggttttactaagagcagatcagtacttcaagaaaaccttgttgttctaacataggggatgaaaattttagttttgttttagtgtatttttaatagcaaagctcaatctttaggaaggcttataaataattgccttctaattacaggcaacttgatcacacccacaatttcttttataaatttatccttcataaactttatcgtgacttactcagaccttttacaacatgcttaaactttctgctttgtcctttactttctctttattaaataaccagtcattttactttaagacaaaaatttaccacataagattgtttctcataggaaatgctcttttctttttaactatccttaccaaaaatacatccttatatccataactttcttcatattactctcctacttatggattcctgtctgtcttgtttctatttccattctaaatatacttttcgaggcaacctttaagtaacctctgaactggacaaaattattctattttctcagtaagaaacatatttttatgccttgtaatttcattcatcaaaacacatcttattttggtatactttgtgatatgatttggctgtgtccccacccaaatctcatcttgaattgtagctcccacaattaacacatgttgtgggagggacctggtggaaataattgaatcatgggagcagtttcccccacaaatttctcatggtagtaaataggtcttacgagatctgatggttttataagaagtttcccctattgcttggctctcactctgtcttgcctgctgccatgtaagacttgccttttgccttccaccttgattgtgaggcctcctcaaccacgtggaactgtgagtcccttaaacctctttttctttataaattacccagtcttggatatgtctttatcagcaacatgaaaatggattaatacactttgtatacagaattatatataaattaattaggattttattcttagtaaccttaatttctagtgaaaacctaggaagccaaaaattttgaattctctgtcacatatcagcattttgtaataagaactattttataatttttagaagcatgttttaatagactcaaatatatttaagaagctgaaaacaacttatatttatgttcagcaatttgttcttatttttatggaaatgacccagacatttgatgagtgttttttatttaatgtaacatagcataaccttatgattttaaagtacatgaaaagttattttataaacatttattccacattccatttattccaaatgtttattttataaactttttttttttttttgagatggagtctcgctctgtcgcccaggctggagtgcagtggtgcaatctcagctcactgcaagctctgcctcccacattcacaacattctcctgccccagcctcccgagtagctgggactacaggcgcccgccaccatgcccggctaattttttgtatttttagtggagacgaggtttcaccgtgttagccaggatggtctcgatctcctgacctcatgatccacccacctcggcctcccaaagtgctgggattataggcgtgagccaccgcgcccggcaaacatttactccatttacatttacctaatttactgatttttaacaattcacctagattacttatgaaaactgaaatattacacaaagcgaatcatcatttcaagttattgtcctgttaaccatttttgtattttgtgaatatcaggtgtttgtttaagtaagagcctgaaagtaaaatacacaagtattttgcctgtaactcagaagctacaactgtttttattaaaccaatattaaattagtcctacttatcaaggagttacacaaagattattctgttttcaagttgacttcatagcttcatgactttaaaacatgtagcagaaacaaatacaaaacccagccaaaaatgtatgctgccagtttcgaagatatttccatttttattttaccaatgatttaaaaaccatcttatttatcaaagttttatttaagtcacaggaactaaaaggcatttgggttaattactatatattttatatgtgtgataattcatctaagccaatcaaaataaaatttcttaggagttttttttttggccaactattccacattttactatgtagatacagcataacatatattatctaacataatgcatgttatataatatgtattattcatataacatgttattctataacatgtattattcgtgttctatgaatatactatgaatattatatttcattatacattttattttacatttcttagattttactatgtagacataacatatataaaatgataaatgttatatgtattattcatgttatgttatatgaatactattcattgttatatccattaatattcaataattattgaatattattaatttattaatattaatatcaattatttaatttaacagtgttaaattattgatggtatttaatgatttgataatattaatatttataatgcaataataatgttctataatataatatgtattattataacacctattccagattttactttgtaaatacaacataacatattatataacataatacatgtacatgttggtaaccacacctaaacacatagacatacatacacaaagatcttactgcttttattttagaattttagccatgagatagtaatacaaactcacccatttataaacaacgattgcattcaaattatatttctctcaaaattgggacctttttacatagctaaacttaaatgctaatctagtgaaggctatggatcaaagttttggataaagcagtttgattttttaaaaaacctcttttacctttttttgtttcctttcttcagcttcaaatgagtttacattttagctgggagtgacgaattgtataagaaaaacaaaatctccagtggccttgaattagtaacacatttatctttgttcactgatcccctttgctagtcaatggttatggggaagcatcttaacaagagttttgttttccagctatttttttttaacggcccctgtgtggcagacacaacagtttttatgctggaaagagataccttatattactgttctgacctcaagattttgacctgagagcctaaccttcataatgatttatctaatttttattattttaggctatcagtccccttagttaactgctctagcatcctaagcaattggtagccaggcaaacccaaatttacatttgcaaaagatgtctaggttgttggttactttggagctgttgtaatatgtaaagccatttatttaaaagccctttaagacttttttttttttttaatcttggctagaatgccataagcactgaattttatctcaacaccagcagaaaagtcaactgatttaggccaggcacagtggctcacgcctgtaatcctagcactttgggaggccaaggcaggtggatcacttgagttcaggaattcgagaccagcttggccaacatggtgaaaccccgtctctactaaaaatataaaaattagccgggtgtggtgatgtgcacctgtaatcccagctactcaggaggctgaggcaggcgaattgcttgaaccctgcctggaggcagaggttgcagtgagcctagatcgtgccaccgcactccagtctgggctatagagcaagactctgtctcaaaaataaaaaagaaaaagaaaagtcaccagatttaaagtaggcagtaaaaaaagtagagatagagaactaagaaggctctgttatctatataatcacaaactcttaatttggggaaaaaaaaaccaagaaaatagaaaaaagaagcttggggagttcaaataatctgtgttgtggctgttgatccaaaaacatgcatgaggaaagccttgtaattagctggagtctctgaaaacctggcacaccttcatgtgggagaatcccattctatttcttatcaatctcttgagagcaaagaaaattccataaatcctatctgagaatgtcaggattttggacttgtgtctcttcctgtgacattttggtaatgttcattgttattatatctgatttaaaatactacataaacttagttgataaagcaggggcaggatttgagaagattggctccaattttgaaagaagttctattgtaggtaagaattatcaaactgcatcaattgctacagagaaacttttcatgaaaggaagagtcgatccatgtgggaaacttcattgttaccttattttaagaaattggccacaaccaccccaaccttccaacaaccaccaccctgatcagtcagcagccatcaacaccaagacaggaccctccaccagcaaaaggattgtgactcactgaaggccaggtgatcattaacattttttagaaataaagtatttcttaattaaagtacgtatttttttagacataatgctgttgtacacttaacagagtacagtgtagtttaaacataatttttatatgtatcggaaaaccaaaaaatgtgattcacttcatgtggtattcactttattacagtagtctgaaaccaaacccacaatatctccaagttatgcctgtatatatatctgtccaaatacatatacacaaacaggcacacacacacacagagctcattagaactccagggagaaattgataagtccattttcatcttggaatatttaacatattttttcttttttcctttttttttttttttttttgagaaagagtcttgctctgttgcccaggctgtggtgcagtggcatgatctcagctcactgcaaccttcacttcccatgttcaaacgattctcctgcctcagcctcgcaagtagctaggactacaggtgcccgccaccacgcctggctaatttttgcatttttggtagagatggggtttcgccatgttggccaggctggtctcaaactcttgacctcaggtgatcggcctcccacctcggcctcccaaagtgctgggattacaggcatgagccaccgcacccagcccatattttttttcaaatgttgaaatatcaaaagacaaaaattactaagactatagaagatttaaactacacagttaacatgttgacttattgggcaaataaggaaccttgtacctaatgatctgagagtatacatccttcttaggctcatatggaacatttattaaaaagaaaccaagtactagacatcaatacatttcaaagaatgatattatactatagttctctgaagaaagcaaaattaaataagaaggcagtaacaataaggtttttaaaaatctatttgattacaattgaaaacatacttttacattactcatggttctaaacataaataatttaaattgaaaactacttagagcctaaatgaaaataaaaataatatgtcaaaattagtgggataaaataacatgtaaggaaatgtatatccttaaatgtttatattaaaaagaagaaaagttgaaaattaataagccaagtttgcaactcaagatgatatattaatataaacaacgttagagttggccgggcctggtgactcatgcctgtaatcccagcaacttgggaggctgagatgggaggatcccttgagttcaggagtttaagaccagcctcagcaacaaagcaagacctccatctctaccaaaaaataaataaatggggggatgggagtggggcagtggtggtagctactcaagtcccagttcctagagaggctgaggcaggattacttgagcccaggagctccagactgcagtaaactgtgattgcaccaccgtactacagcctgggtaacagaatgagaccctgtctctaaaaacaaaacacaacagaacagaacattaaattcaaatgcaatcaaattgaagttggtcagcaaattgatcaataaagtcaaaagtttgaaagggaccaataaaatagacaaacctatggcgagactcatcaagaaaaaagaaagtgaactcaccaagaaatgaataggggcacctaattccagatccacttactcattctctcattgtttttgagcaagtgacttctgagttctagatatacagcaaagataaagcaaacagtctcagttggtggagctttcaatcaattagcagaattgaaaaaaaaaatagaatactgtgaacaacattatgtgaacaaatttgagaatttttgttaaatggacaaattcctagaaatgtgttacttaccaaaaccgatttaagaaaaaagtataaagtttagattatcttctagccattaaacctttttaaaacagtacccctagacggcaagtagaaataagttctaccaattttttttaatccaaggacatttccaattttaaataaacttttctagagaatatgaaaagaggaacactttttaacccattcagcaaagccaggatattatcaacaccaaaatcagacaaaaaaaaagtgcattagtctgttctcatgctgttaataaagacatactcgagactgaaactaggtaatttataaaggaaagaggtgtaattgactcacagttccacagggctggggaggcctcacaatcatggcggaagacgaaagagaagcaaagtcacgtcacaaagacaggaagattgcaagccagtctcactcatgaatatagatgcaaaaatcttaagcaaaatatttagcaaaccaaatctagccatgtataaaatagataatatatcattgccaagttgggtttgttccaggaaagacaagagtgatttagcattgaaaaatccacgtgtcattcagcatgttaatagattaaaggagaaataccaaataatcatataaacagatgaaggaaagttatttgacaaaattacgtgctcattcatgataaaaactctcataaatagtaactagtgaaaacctacagtaaactattgctgagcatttgctcagggccgtgcaattagttggaaagaggagagcgtgcaagagcacacacacatttatgaaagcattttggtatatgaagaggcaacatacctgatcattgaagaaatgattaagttttccataaactgtgctgagacacctgattatccacatggaaaaaatttaagtggatccctgtctcataccatgcataaaattaattccagacggattagaaacttagaaagtgaagggccaaattaaacttttattttttaaatgaaaagggaaactggccttaagacttcagaatggagaagtatgtattcaacaagacatcaaaaacgcataccataaatgaatgaatccgtaaatttaatcacattgatatcaataactcaatcaaacaggcattaaaaagagaaaagcaggccaggtgcagtggctcacgcctgtaatcccagcacattgggaggccaaggcaggtgcctcacttgagctcaggagttcgataccagcctggccaacatgtgaaaccccatctctactaaaaatacaaaaattagccagacgtggtggcgcatgcctgtagtcccagctactcaggaggctaaggcaggagaatttcttgagcccgggaggtggagaggttgcagtgagccgagattgtgccactgcactccagcctaggcaacagagcaagactccatctcaaaaaaaaaaaaaaaagagagaaaagcaaaagatacttcaacacatgtaactgacaagagagcactaaacaaaatatataagcaactcttaatattgaatgataaatctgtaaaacatgtaaacagtcctttcacttggttgccaggcaaatggccaataaacacatgaaaagatatatagcctcgctgttcatcagggaagtgaaaattaagaccacaaataattttatagccaccaaattggaagagtgatactatcaagtctcagttgaccagtggtctgttatgtcacccataggagtgtgtatggatacaccaaattggaaaacactttggcactatattgaaaaattgaagtggaatataccttacaatctgggtcttggatgtaataggtcacaaatggagaagtggatgactttctaaagaaagtcaggttcagccatcagtgagcgaattacaacagatagaagtagtgctttggaaggcctgtgtcctcctgatgaatgacatttcttgaccaggcagggcacaggagacttctaaactctcaagtctttttatatcaaaaataaaaacataaaaataagtacaactaaaaactttggcaggccttgaaaagggataaaattctgaaggtcaggcatggtggttcatgccagtaatctcagcactttgggaggctgaggcaggtggattgcttgagcccaggagtttgagaccagcctaggcaacatagtaagacccccgtctctacaaaaaataaaaaattagccggcatggtggcatgtgcctgtagtctcagctacttgggtggctgcggtgggacgtttgcatgaacccaggaggcagaggatgcagtgacctgtgattgtgccactgcactccaacctgggcaacaaaacaaaaaactgacatatgctataacttggatgaactttgaggacattatgcttagtgacctaagccaaacacaaaaggacaaatactgtattatttaacttaaatgacttatgtaaagtggcatgaaacatgctacttaaaatggcatgcaatttaaaatatgaattatttctggaatcttccatttaatattttcagacagtggttgacctctggtaactgaagtggagaaaagcaaaaccccgagtaaggagaggctgttgtactcccaagggaagaacataaaaaacagcaattaggaggtccttcgtaaacgcggaacgggattgaaaaaacaaaagatgggaggaagcggagaaaaagaatgaaaataggccggacacagtggctcacgcctgtaatcccagcactttgggaggccgaggcgggcggatcacgaggtcaggagatggagaccatcctggctaacacggtgaaaccccgtctctactaaaaatacaaagaaaaattagccgggcgtggtggcgggcgcctgtagtcccagctactcgggaggctgaggcaggagaatggcgtgaacccggggggcggagtttgcagtgagccgagattgcgccactgcactccagcctgggcgacagagcgagactccgtctcaaaaaaaaaaaaatatatagcaaagatgcactttgaccaggactctgagacccagattggcctggtgggacagacggtgttcttgggtcatccctgagggctccacagaaatgtccaggcaccaagaggacccagagggtctcaccatcccgctcagtcccacccgggaggtgaatcatcccttcatccagcatctccatgctgtctgcactactggcctgtgaatcacttagtagccatctcagttatcagattgactctctgggatcgcaatgcttgtgttcaagtcgccctaattttacttcgtcatggctccaaagtgcaaaagcagtggtgctgacgtattataattattcagttttattataatttattgttattaatctttcactgtgcctaattatgagttaaactaatcataagtatgtatgtataggaaaaaacatggtatggagttaggtacgtgatacggtttggctgtatcaccacccaaacctcatcttgaattgtagcccccataatccccatgtgttgtgggaggaacccagtgggagttacgtaattgaatcacgggggtgattttccccatactgttcttgtggcagtgaataagtctcatgagatctgatggttttataaggggtttcccttttcccttgggtctcattctttctcttgcctgttgccaatgtaagccatgcctttcaccttccaccatgattgtgaggcctccccagccacacggaactgtgagttctccattaaacctctttttctttataaattacccagtcttgggtatgtctttatcagcagcgtgaaaacggacttatacagcactattgcatggtttcaggcaaccattctgggttttggaatgtgtgcagatactactgtagacagggggaccctgcctctcctggtctccctcagctcacactctgctactccaaaggagagtcaacctgagcagccccctgtgggaaaagcgggagccccatgctgggtcagatgattgaaaatgtcatttaaagcgagaatcataaaaatattttaaccttgatttgctttcttttcatccacaggccaggttttttgatctgctaattgagtgctgtattatcttgcataaaccaccctcatgcatcttctgtggttatcggtgtcctttcattcaaagtgaaacaagaacttaaggactcttccaaaacaattggaggacggtcctgggttagttctattttcccccctttagtctcacccacacctaacacaaaagcaaatttgtttagggacttcttttcattgagctgttgcaaagcgtttagtttgcctttcagggaaacagcaattctttgtagttacataccataaactcaaataatatttaattagatttccaattgcattagaaacacaagatagaaaaacaccttcggtaataatcacagctcactcttgctgagcacagagcccatttgtaggaacagacatcctctgacatcctactagcgagaggcttaccagccttgggcatctactttgccctaggtgtccatggagaactttgtgctaagtagaggttggttaagagaacttctaaggggagaggtgttttcactgaagaggcaaaagtgtatatcctttgggagccaagcaatcttgtaaattctgatgacagttttgcttcttaccaactgaaggacttgagtaaatcacttaacctctcccaggttcagttacattattgagaaaattgaggccattattctttgccccattctcagccatgccccttgagtgctccatagaaatacacttgactttacctcagtctttgtgtttcaggaccttcattgttatctctttagtccttacgcttgataactcagccttccctggctgagtcttaaattaaaaagagaagggaagggcccaagggagcatctttttatcactttaccagtggcacaaactcttaggagaccagagtgtgtagtgtgctggtttacagaaaggagcatgagagaattctgtgaaactttgctctagttcttgagcctttgatggaccattagagaatgaagctctggccagaatcagttggtaatgaccaggaaagggaaagcagagggtctaccaatgggtctctctaggggtttctagagtcccagagctgagtgagccatggttcctgctctcagaaaagtctctagtgagacctaattggtgagtaatggaaaattccaatagagtctgctaggtgctgtgatgtaaggaagtgagggagcctaacagagcaagaggagggactctaaagaggagggactctaaagaggagggactctgagccagttggggagtgtgatgcagaatctgaatctcaaggaattcagattcagataggaaacctgagctgaatcttgatatccaaactcccagacacctgaactctcttccttccccatctgctgccctcacactacccctcagccccaaaacatccttgctgcccctctccacagtcctgtgaaaactgctgctcctcccctgctcatatctccagagcagggagtaagtgcaaggactacacgagaaagagtggaaacccaaatgcaagttaagaagaaatagatgcacacagctgggccattgcttcaaaaatgtttatgtagaatgcattgagctctttctggaatcaacaggaagtacatttcagaggaagttgttgtgtcaaacccctgtgaacctcattaggaaagtcatcagctccaagaggctgaagaagagacccagagacagcaaaccagaaccagacatggtttatttttatttttatttatttatttattattattatttttttaaacagtcttgctctgtcacccaggctggagtgcaatggcgcattctcggctcactgtaacccccacctctcaggttcaagcaattctgcctcagcctcccgagtagctgggattacaggcatggtggtgcacgcctgtaatttttgtatttttagtagagactgggtttcaccatgttgggcaggcttgtcttgaactcccgacctcgtgatccacccgcctcggcctcccaaagtgctgagattataggcgtgagccactgtgcccggccgacatggggttttatcgggattacatacaggggagagagtccagcggcagcaggctggacaggagagctgccttatgtacagaaagagtccagtggcagtgggctggacaagatacctgccttcgtacagcccagtggcggtgggctgggcaggaaaactgcaattatctgcaaacatcacgcagtttatatagcattttcacttaacactctcccactaatgaccttgatacggtttaaatctgtgtccccctccaaatctcatgttgaagtgtaatccccagtgctggaagtggggcctgctgggaggtgcttggatcatgggggtggtttctcatgaatggtttagcaccatccgcatcgtgttgttcttatgatagtgttctcacaagatccgattgtttaaaagtgtatagcatctcctccctctttctcttgctgctctggcccacataagacatgtgtaagtttctgccatgccccttctgccatgattgtaagtttcctgaggcctctctagaagcagatgccactatgcttcctgtacagcctgcagaaccatgagccaattagacctctttataaattaccagccctcagggtttttttgtttttgtttttggagacacagccttgctctgttgcccaggctggagcacagtggcgtggtcttggctcactgcaacctccacctcccaggttcaagcagttctcctgcctgaacctcccaagtagctgggactacaggcacacgtcactacgcctggctaatttttgtatttttaatagagacgaggtttcaccatgttggccagactggtctcaaactcgaacctcaagtgatctgcccacctcagtctcccaaagtgcagggattacagatgtgatttctttatagcaatgtaagaatggactaatacagaactctaactggcaaccttcatttaacccaaaactcaggactttggtcccatatatgggctcagatgttccttatagacaaggaaggaatctctgggttggccactcctagattgtctagctcagaacacacgttaagatgagtctgctggctgggtgcggtggctcacgcctgtgatcccagcactttgggaggccgaggcgggcagatcacaaggtcaggagatcgagaccatcctggctaacacagtgaaaccccatctctactaaaaatacaaaaaaattagccgggcgtggtggtgggcgcctgtagtcccagctactcgagaagctgaggcaggagaatggtgtgaacccgggaggcggagcttgcagtgagccaagatcgcgccactgagctccagccttggcaacagagcgagactccatctcaaaaaaaaaaaaaaaaaaaaagatgagtctgccatacagggtcgttctaagggttgcttaagttgctgctctcaggtgtgtttatcctacagaagtgagctgtcacagcttcattgtgggcctcaaaagatgaaaaggagttttccaggatgattggctgggaatggtgttccaggcatgacctcacttaatcttcccaagtctcacaaggtaaatcttttttcattttataagtcagaaaatgaaggatcacacaggttaagtcacttttcttgcccagtcacacagctaaatatgacagagctgagattccaactcacatctgtctgattccaagtccgcagcattttcctctgatacagcaatgagtttctacctgaaaatattttccaatgaaaacatgatatataacataatgactgtatagaactattgtatgggactgtatacagtccctcttgtgtagggctattctgcatgaactctgtttggattaagtgggttttagagggttaactccagaacagagccccttaataatactatatccttgaaaggacatttgaatttttttttttttttttaagatggagtctcactctgtcgcccaggctggagtgcaatagtgcagtctcggctcacttcaagctccacctcccgggttcacaccattctcctgcctcagcctcccgagtagctgggactacaggtgcctgccaccacacctggctaattttttgttgttgttgttgtattttaagtagagatggattttcactgtgttagccagggtggtctcaaactcctgacctcatgatccacccggctcggcctcccaaagtgctgtgagccactgcacccggccaggacatttgaattttaaacaacagactcagaggctgaattttagaccccagtccatttataaattggtaattgagtacacctaaaagaaaaatcctaaagcagaagagaaaaaccaagagaaaagatgccagccataggaggaaatgatatatcttcttaggggcaatttatagcatttgcataaaaaaagtagcccataactcaagcattgaaacattttataatagttagagttgtgtcagtttctacatctttgggggaagatgaggggctaccatatatcagcatactgaacatgtcacagctaagcagactacagtgaaaaatgaggcagggaaaacacagggtaataagaatgatgaatgttaaggttgattttggaggattgggatggatcaaggaagaaaaaaaaacagttggttttgggggagaagatctaaaatctcgaattactaccttctagtcagacttctctttcacttcaggccagtgccggtttcatttctttcattgtatgacctgcgtccaagggctgtcagtgttttatgatctctttgtgcactgctgtgaccagtaaactcaaggagtcctcaggattaaatatgaggcagctggctcctgtttaagtaccctgtcctttgggactattgccctgtggcttgtatgcgggatctctcattcccccagcagacatggcagagcacccactctgggccaggctgtcactgagttctttaactcaccctaaccaagtcttttcatctgaaaaactaggaacttttcctcatgagtctaaagtcatcctcatgactttatagaagagatggaaagattaaaagggacaatacataaagcagtacaaggctttgagacattgtagtaaacctattattcttttttgtataatttttttttcttttttgcgacagtttcactcttattgcgtgggctggagtgcaatggtgcaatctcggcccccctcaacctctgcctcccgggttgaagcgattctccttcctcagcctcccaagtagctgggattacaggcatgggccaccatgcctggctaattttgtatttttggtagagatggggtttctccatgttggtcaggctggtctcaaactcccgacctcaggtgatctgcctgactcagcctcccaaagtgctgggattacaggtatgagccactgggccaggcatcttttttgtataaatttaagtggtacaagtgcagttttgttacatggatatattacatagtgatgaagtcggggcttttaggataaccatcacccaaaataatgtacattgtacccattacgtaattactcatccatctcccctctcccaccctctcagccttcagagtctccaatgtctgttattccatgctctttgtccatgtgccctcactatttagctcccacttaaaatgagaacatgtagttatttagctttctgtttctgagtatttcacttaaaataaggcctccagtcctatccatgttttcattccttttcatggctgaatagtattcatatatatatacctacactccacattttctttctacgttaagccattgatggacacttaggctgactctgtatctttgctattgtgaatagtgctgcagtgaacacacaagtatagctatcttattgttacaatgatttcttttcctttgggtagatactgagtagtaggattgtgagattgaatggtagctctgtttttagttctttgagaaatctccatgctgttttccatagagatactaatttccattcccaccaacagtgtataagcattctctgggaatagtttccatttggctagtgggcagacacataaaaaggcactcttcctactcctctgttctgtcttgtttcttttgttttctcttctctttctttcttttctttttttctttttcttttttgatatggagtctcactctattgcccaggcacagtgcaatggcatgatccccgctcactgcaacctctgcctcctgggttcaagcaattctcctgcctcagcctcccaagtagctgggattactggcacacaccaccatgctggttaatttttgtatttttagtagagatgggtcttaccacgttggccaggctggcgtcaaactcctgacttcaagtgatccgcccacctcagcctcccaaagtgctgggattacaggcatgagccaccacgcccggccaactctcttatttcaaagaagggaaatagagacacacaaaggttaaacaccttgcctaaggttaaacaccggttggtggcacagctgggatagtacctgaccttcacatcatgtgtccttggatcatgccagagaatggcaggctaagcagacgggaccttgggtgacttaagcttgagtctgttgtcttccctcagcactcatccattttttgctcctggataattttcagaactgaactcttttgagttttattgatttcagttgtccttcattggctttttacacatagctgataaacttccaatgcagttattgctagaaacaacaagattcctagaagcaaagtgatgtctctggaaattttaccctatgacagcattttccagagtgtatgtccaaacagttctaagagctgttaattggacttatttaaaatggggaactggggaggaggatggggagagcggagttctatgtactacataccaaatactgtattaggaagtcctgcagccagaaaatctgattgattttgttgatccccagcatttcccacatctattttatatcaacacacaggaaagactcccctttgattacagaatgcctggtaggacaagttccttagaagcccacacttccttacataaatactggctctattaagaagaacacaattttgagcaaaggaagcgccattgtaaagcagtatttggcgaccatggacattgagccactaactgagagcctcccctatagaaggctcaggtgcatgatattaacactgggcctcagaaagccggagggctaggcagagaaagggtggtccaggaggagttagaagatctacttttgagattctggaaaagaccataaattgaatggatcatgggttcataacttggccgtgatcagagaagagtaaccaaggtgagcaagagacaaaggtttaattttccagttatcacgaaggggacaggcaggtagcatatccaggtgtacatttgaagatccaaactatccttgaggaaagggctgcaaaacacatttcagcctagcaagctacccagtattgagtgcccgttgtatgcaagggtttgaagacacttagtgaagttgaggatatagagacaagttcatcataattcctgccctgaaagagccttacaaacaggggatacagaagtttcaactgctaatttccacataatgtgaacaatactgtgcaatattgcttagaggtatccaggtcagaaatgaaggtgctacataaaaagggatagtacgaatgaacacaggggcctaaaagatcatggtgtccagaaataacaaggagataagcagagagttcaggctgtgtactaaggagcttggaatttaaactatgggtcacagtactaaaatacttcttatctgacctattccaatgcaaacatatttttactgtggtacatgaatacactataaaacagaaaagtttcattttattatatgtttgagtaattttaagttaatttagtaataataaacccttttgctcttatgaaaaacataagtattcatatgtttaaacatagcaatattattgaatgtgcttcattatttttgaaatgttggtttagtactttgtgacacagtgtttcatagtcttagttttaagggcatgttatacaaatactagaatttaatggctatgactgcaaaaaggatccctcctaaaattcacagatccaaatggaaaaaaagtacatcattggctggctgaatacattttatactcattgtttcagtttaatccaaaagtcatacaaaaatatttgtagcattcagctattatatttaagtctctcttgatgaccatcatttgcttttgataatttattaaatattctttagcattttgataacacattcaaaacccaccatacaataagtcctcacttaatgtcatcgataggttaacggaaactgtgacttttcagtgaaacaacacactatgtgccatagaaacttaattcttgtttatatcaactaacaaggtaaattgatttctttatagtgtatataatttcacttgaagttgcagcctccaagaacttatcaaccttaagtgaagactgtaattttttttatttgcaagttaattttcaaagttaaatctattttgaagttttctaagtatatagaaatgagggctttgataggtaacatcatttcttggcctcacaatcccataacgatggaaacaatttcaaacatttattttctaaaagctctatcctgtttcagagtttctgtctgaaagcacaatatttactttctcatttgtcacctttccaccgaagggtcagatttaaagtgtgtgtgtgttttcaaaagtgtgagatagaatactaccagcaaccatcctttcttcacgtgtgccatctcttacatgtcctttgctttgagttagccagcaaagctgtgtgttacagattttcattgccacctctcatgtcattagaaagtattgtacaattgtaatgctatttttagtcttgcctttataaaattatctaaatcaatggcatctagcagcgcttgtgcctgctggcctcaggtactctgttgcaggcttgcttagcaatgatggagtcaaggaattcattgcatggtgctgactctgtgaccttactccataattcttttgttattccagttaaagcactgtacctctaatgattccacatactctcttttcataaaatatcgttatcattaaagtaggaatttactgctcagtgtataactctgcaggacagctttcctttagtgctcacaaaaaaagtcattctttctgtctttcattctctaaacagaatctatcacgtagcgtaagcctacacacagtactctgtactttgatttaattccatagcaaatctcccatgtaattcagtctaatactagttgcttccatccttcagcgtggttttctctgactcttcctgcaatatttgctgacaaaggaacttacttcattttgttaccatattatctttgtgtatttttacagccatttttgccaaggcaaaaaaaaaaaaagaaaaaaagaaaaacaagtattctccttactggactttattgtcctttattctgatgaaagaaatctctaaagcaacttctaacctcttttcacagagttcagtgaaacattgtcaagcttaagaccgactttcacaagactttaaacatcatccagaaattatggtgacttcatctgcatattctgaatgctttgtttttaaatgtcttgctaatcacacatctttgtactaacattaagtaatatatcaaggcataatacacagtttgaagttcttcctgaatgatagtggttgtaaattcatatttcaaatagtcttgaaaatttacattttttgccagtttcttgtcagatccaattagggagtcatttctctactttgtaatgtagctaaggaagagcttatactgggaacagaagtgtcagctcagctgttttcttgctattcacatcagcttgtcttattggtattctcaatctgtagctcctttgtagaactcccttttttaattataaacttttatttggaaggatgttagacttaaaagtttaaaaggtagcataaagagtttgtatatatctgtcattcggtttcaatttcccctcacattaacatcttttttttggtgggggtcggggaatggagtcttgctctgtcgcccaggctggagtgcagtggtgtgatctcagctcactgcaacctccacctcccaagttcaagcaagtctctccctgcctcagtctcccaagtagctgggattacaggcgcctgctaccacacctggctaatttttgtatttttttttaagtagagatggggtttcaccgtgttggccaggctggtcttaaactcctgacctcaggtgatctgcccacctcggcctcccagagtgctgggattacaggcatgagccaccatgcctggccagcatcttctaacagttgtacattcatcaaaactgacaaaccaacatcaatatattgcttttcaagtaaacttcaagctttcattgtatttcactcaatgtttccatttaagctttatttccttagtctccttgggtctgtcataatgtcacagtctttcctggtttttcgtgactgacctcaatagttttgtggagtactggtcaggtagtttctaaaatgtcccttaagttggtttgtctagtatactttctcacgattagactgaggggatagatttttggaaagactatcacagatgtgaagtgccctcctcctcacattgtgtcaggaggtacatgatgcccacatataacattactagggatgttagccattcttatgtagtaaaggcaatgtttgctaggtttctccactataaagttactaatttttgccaggccttgggggctcacgcctgtaatcccagcactttgggaggctgaggcgggtggattatgagcgcaagagatctagaccatcttggccaacatggtgaagccccatctctactaaagatacaaaaattagctgggtgtggtggcgcgcacatgtaatcccagctactcgggaggctgaggcaggagaatcgcttgaacccaggaggcggttgcagtgagccaagattgcaccactgcacaccagcctgggtgactctgtctcaaaaaaaaaaaaaagtttctaattttccctttgatactttattttttgaaagtgagtcattatatctaccctgcaatggaagtggagggattaagatccatctcctcgcaaagggggtagtagtatctacatatattattagaatttctctgtaattaaagattggtcactttttctcatttatatttatttattttaaaaataatttatgtctatatatactcatttattttatactttgggttataatgcaggactcttctttaaggcattattcattttgtgagggttattttaattcaatattagtaattataaaataatattatgaaatgcactaaaaataagtaatagtatggttggttgacagaagactttgccagattcatttaaaccccagaacacctcaatatttgagagcgccatgccaccatatcatgccttctgcattgatgcagctacatatgggtgctcacatgacttagcctctcccctctctccctctctgcctttgcttttctctgttatggcagggtggcttcctgaggcctccagccagtaggtagagcttagtcattcaacagatattaattgcacacttgctatgagctagacactggttacacaatagtgaacaagacagtgcaggcctttgctcttcttgaacttacattctagtgcagaatacagctatcacacaagaaaacaaatgatcaattgtcatttcaggcaaaacgtgcaatgaaaacataaagaaatctaaggctaatggaagagtgactagcactcatgaacccaaattgaagagagaagccccttttctcttaatgtctcctcaaaaggactctgttgacccttcatgggacaggtatccatgcaagaacccatccctgtgttcttaggaatggtcaggaatgactcactggtcagctggagtccgtgtctgggcttctggctggtcaggcatgactgacagccccattagagtcatgggaagaaggcctgatctacttctgcaaagggcggtgatgcggggcagacaaaagagcaatagtgggcctcacggaaggtgcctgctgggaaccaggaagcacagctgcctctcccagggtttccaagcagcgaatcctacggtgcccacccccaagggcatgactgaaattcggccaagttagcaacatcccacgggactcaagccagctgctcctccacccaccttggtcaaattcctcagctaaggatcccatgccaacctctagaggtgggatctgcttccttctagcctgcctgtcctccagtcacacccccgaggaggacactgtggggaggctaaaatgtgaatacagtcttagtaattaattccatagagacaggaagaatacgggctggttatcactcctggtcttgtgtgggttgtctgcagggaagtcgcataaaggcagcagtcattgaggacacttaacactgtttgcatcttttttcatgtcctgctatcaagacagcatcaggaattctttgcatgtaacagaatccagttcaaattggtttttacccccattttatagcataaaggaacccaacacattgaacatgatgaacattagagaaaatacagctgaattgtctcatggattcatgaccttcccagccctgagtattgtgaaaagtcttcattttcctgttgtccttttatcccctccttagcctctacctccttgggcagggaaaaataagaaatgttacagagaacagaataagcaatgataggatataagacaaggcctgggattcatgcattggcctaagtgtctacattttccaagtgagaggactaagtcatcaatgagttgggtctcttttcttcccctttcctggataatgatgtgtttttgtctgggaagaaatttttcttttcttttttggctgagactcctaaaaaccaaaaggcaataggaatctgtgtgacaggagccaaagagttatgagtaccaggaccctagactgcactgtggcaaaacttccatggctgaaagagatgtcttggtataaagggcaccatttttatttaatttttatttaatagcagtacctgataattgtcaggaattggaaaggaaaaggaagggggatgaaagggaagcttcagcagctcatggggagcataaaaaagctgagatacaatccatggggagtcaacaaacattgaccaagcctccttttgcatgcaaagttggatagaacacagctcttgcattgaaggatccagcagtccgggatgttggacagtgtcactttagctagtgctgagcctccctcagagagaatcatgtgggaatggagcgtgtatattccacagacttgattcacatcacaagcactgagcatggatctgctgcaggctccatggtgaacacctatattagattctccagagaaacagaaccaataggaaatagaatgtatatgtatctgaagatactaattatgagaattgacccatgggttatggaggcagagaaggcccaccatctgccatctacaagctggattcccaggaaagccagtgttataattcaatctgagtctgaaggcctgagaaccaaggaagctgatggttaaatccctgtattcgtccatcttcatacttctatgaagaaatatctgagactgggtgatttataaagaaaaagaggtttaatggactcacagttccacctagctaggtggaggcctcacaatcatggcagaagacgaaggaggagcaaaagcatgtcttacatggcggcaggcaagagggcatgtgcagggaaactgctctttataaaaccatcagattttgtgagacttattcataatcaagagaacagcacaggaaaaacccaccccgatgactaaattacctcccaccaagcccctcccacaacacctggagattatgggcactacaattcaagatgagatttgggtggggacacagccaaaccatatcggttccagtctgaaaggaggagaagactgatgtcccagctcaaatagtgagccaaaaaaaaaaacaaaaagcaaatttctccttcctcagttttttgttctatcagggcctcaatggattggacgatggctccctgtactgggaagagccatttgctttgctgagtccactgattcagatgctaatctcatttgcaaacaccctcacaaacacacctagaaataattgtttcaccaaatatcagggcacaccatgatccagtcaagttgacacataaaattacctactacaatgccattacagcttttgtttcattgatcctatgcagcaggtattattattttattttaagaggttggaaaatagaggttcaaatatagtaggtagtttggagtaacagaaaaggcaatggtttgaacctaagtcttaccagatcagtgccttgcccctgcccaacagcactcttgatctctgcctagtactttttttttgggggggggtgggtgggggagcggggacagagtctcactctgttgcccaggctggggtgcagtggagcaatcttggctcatcgcaacctccacctcccatctgcccagtactttaaacccaatttaaagtgcctgtgtttcagaatagtccccttttcgggtcactccttgaagtctagccaggaggacctgcccttggcctggcttcctctctgggctgtgttgtctgtaccttccctgtccttgcccctcaggttgtgtgacaatctgcagccccatatttaaaatcttgtttcttactcctccttcccccatagaggttctgttttcatccagccttcttcattggtaaggtgactctttcatgaagtctaaaccagatgtcttttataactgaatgaacacatgcaatatacctttatctccatcatttcatctgtcctgatattgaccacaactttgcaaagtacttgtggttctttgcaaagtacttaggttcaaacaccccttctacagatgaggggctgtctctgtgatattaggcaactaggtgcaggttacatagcaactaagtgcagctcagagctggagctgggtctggcttgtaggtttgtctgctcctccttttctctcatgtgtcataatcccgaagatgacaaggaaaaggacttgtgaaaatattgtccttctctttgaaaatccaaacaaggggataacagcgggagcttaaactccttcaagaaaaaatgacaagctctttgtcccttagacaaagaaaaggggaatatgtttctccattccaaatcccacattagtagagcttttatcactgatttactgtagacagacaaaatgtgaggattattgagaatgtcatcatcatgatttccattcttgaaccaaagggcagctactgaatactaactgcgtgccaagcactgtggcactccaaaagaataataagtcaagttctttaccagcctggaaattcacatcccaatgctgccaggtgcaggcatgtaaataaataattacaagaagcatgcaatgagttctctaatagagctacctgcaagagcctgtagagcactgaagaaggacctagcaattgcctagggtgttatgttaggaatgcttacaatgagaatcagaaaactcaatatgcagtggcttaaaataaagtagggggtttgaatttcttacctgagaactctagagtaagcaaacacagacactggctcataggagagcaatgtgttgacctctcatggtcacaagatggctgtcatggttctagtcatcacatctctgtttacgatagaaaggtgagtgaagtgagaagaggacactagccatatgtgaacctttttattaggaaatcgaatgcttccctatgtaactttttgggcattcctaggtcacgtggccacccctggctgcaaggtagtctgggaaatcagagacttggatcatcatgattggcttggatcttgggtcatgatccattcacaggggcaggggacattgcaactacaaacaaagttagtgttctgttaggaagaatggggtggagggggagacacacaaggaggtgtcaatgtgagtgttcaggaaaagctttgcagaacatgtgcatttgagctcagccatgaaggatgagctggcattggtagaaaagaaggtaggaggccaggcgcggaggctcatgcctgtaatcccagcactttaggaggccgaggtgggcagatcaactgaggtcaggagtttgagaccagactggacaacatggcgaaacctcgtctctactaaaaatacaaaacatagccaggcgtggcggcgcatgcctgtagtcccagctactcgggaggctgaggcgggagaatcgcttaaaccggggaggtggagattgcagtgagctgagatcgcatcattgcactccagcctgggtgacaagattgagactctgtctcagaaaaaaaaaagaaaaagaagaaggaggaggaggaggaggaaagaaagagagagagagagaagagaggaaggaaggaaggaaggaagaaaggaagagaaaagaaggtagggtattgtagagagaaaataaggacattctagcaagggggagagcacagggaaaggcacagcatcatgagagacaggtttaagaaatactaggattgccttttagcctggatatagagctggaatcataagtgggaggcagtttgcatcaggcctacctatcaggctaggtgttattctgtgggtcatagaaggtcagttggagtgttgagatggagacccattttctaatgcctcttatcccagtaacttggaagagataagatccatgttcttattcacctggccatttgcacacaggctctgatttcttcactgttttgcaccattaattacttttatgaaccctctggggtctaagtgcatcagaagtattggctggactctttccacagccttgtccttgcactgaggtcttgtttctgcctttgaactgctttcttctgtgcccttgatgggtgatagagtttctcgtgtctcctttaatcacatggacttctgctgccttcccagatgatgtttaagtttcctggacagtaatcaatttctgtcaattttctctggctcagtagaggccgactccaagtcggcacatatactcagcctttataggcatttcagatccaatcagatcacacccatggggcccctgatgcttggcagctcctgcagcccacctggcatgcaacttccatgcctccctctctctgcttcctgccagactggaggctctgcctgtgtatctgggaaatcctaaatcatcctgcagccttagtatcccaggggtgggtattagaaggggaaagtaggtttcatttctgatcctgtcatcttttgtcaatctcatgttcatttaatgatgacagatatgggagaaataagggacacagaattctaatttttctatctgcttgggttcaaatcctgactctcctactttctagctgtgtaacttcaggcaacgtgctaaacttttctcatctgacaggtaacatagtaagagcatcacttgtctcatagagttgtgtaaagagtaaatgagctatcagaagcaaagttttcagagcagtgcctggcatacagtaagtgtctgatacatgttagctgctaataataattattattattactacttgataatgtgcctcagaaagtggaacaagttatcacagattttcatcacaatccttgtagatccacatgcacttatcagctccttacaaaaatctattttgggtgcattctccagtgtcactctgtctcagatgtgaaagcctgtcaataaatgcctacaccaccagcttttcctgcccccaagccagcaatgatggctgatcctttccctcaagggaccaggacaagacattctttagcagtcaccagcttgctgcccccaagccaacaatgatgggtgatcctttccctcaagggaccaggacaagacattctttagcagtcaccagcttgctgcccccaagccaacaatgatgggtgattctttccctcaagggaccaagacgtaacatttcttagtagtcagacaagcactgataaaaatatatatatatatcagcaacacagatcctgagtcagattttcagagtgagagatgtggtttagtggaaagagcagtggcccaggagacagaagctggcctctacttctacctctgctgtgtgactctcggtaagtcactttccgactctgggtcttggtttctttccacttaatgcgcccttcccaggaaaaatcaccaacagcctctttaaatgcacgttatcatacttgtagtttaaaatggacagttttgtgataccttcctctctatctaagttgtaagtttcaggaagagagtatggtctcttgtgtgtatctctgcattcacagcccccagatcagtgtctggcacaaaatcagtgctcatcttactatctgttgaataaataaatgagatataatagaaagaaaatcatttctgagtgtgatggttaaaactgagtgtcaacttgattggattgaaggatacagagtattgatcccaggtgtgtctgtgagggtattgccaaaagagattaacatttgagtcagtgggctggagaaggcaaatccacccttaatctggtgggcaacatctaatcagctgccagcaaatataaagcaggcagaaaaatgtgaaaaggagagactggcctagcctcccagcccacctctttctcccgtgctggatgcttcctgccctcaaacatcagactcagttttgggacttggactggctctctttgctcctcagcttgcagacagcctattgtgggaccttgtgatcgtgtaagttaagacttaataaactcctttatatatctaccctattagttccgtccctctagagaaccctgactaatatactgagcaagacagatctgattttgttttaagcttgagcatgtactcacttagtgaccctgggctagtctgaggctcagactcatcctctgtaaaatgaagataataatagaaatcaccataccaggttgttttgattgaatgtgatcccacaatcacattcatgaattttgagggagagtgggagacagtccattacatctactaagctattcaacccctgcaggagagagtaaggacagtagggggctactgaggaaacgtgagagctattttgtttcctctataatcccatgatcacattcaatgtagagaagtaaataataggtattatgtatttaatatcatatatatatatggatacatacatacataaaaaaccctggcctggccggatgcagatgctcaaagtgctgtaatcctagccgtttgggaggctgaggcaggaggctcacttcagtttaggagtttgagaccagcctggacaacatagtgagacctaagctctacaaaaaataaacaaaattagctggacatggtggtgtgtgcctgtagtcccagccactcaggggaaggatcacttgagtctgggagattgaggctgcagtgagcccagattgcaccactgtactccagcctgggtgatacagcatagaccctgtctctaaaacaacaaacaaacaaacaaacaaaaaacaccagcctaatgtctagcatataatgggtattgaatacatggtagctatttaggttggtgcaaaagtaattgcagtttttgcaatttttaatggcgaaaaccgcaagtactttttgtaccaaactaaatattatttatttagatcctagcacaaggtaatggagtattctatgtcctgatgattaaaaactcaggtgcaaaatgtaaacctgaatataccttaacagatttttggatgggcttgccgatcagagggagctggatgggaaagcactcttcagaaccgcctttgcttgcctaagacctcgccatccactcccccatcttccttcttatgtaacaccagcacttgcctgtagtgaatacacaaactagacagatgcagagcgggatgaggcttgatgagctaacagacggcttgcggtgggttgtggggcaccaggagacctgggtcctagtcccaaccctgacttggcacagactcaccatgtgatgttgggcagactcatttctctgtaaatttcactctcctcatctgtaaaatgctcagccctttaggactagatataatagtagttaagaacctcaggtttgggcttcagagttgacttccagtctcagcactgcaacttaccagctgtgagatacaggcaagtcacataccatctccataaagtggacagtgggattcaaatgggcttgtttggaggatttaatgagaccatgtctcttaagtacctggcagatttgtgcacaatccattaagctttgtttgcggggtccataggccagcccttcttttcacttagtttaagtttctccctgttgaagaagcttaacatttcctcagtcagatccacatccatcaaccttcctgctggctcagcacttggcaagcaccggaatcattcgcaaagacgacacgatccccccactgggtgtgagtgacaccagcccacatgcaattattttaatgcatggcccaggatcttatgcccagatcaaatgtgttctcaggggagagtcttccctctcctacccttcaaaaggcacaagaagaaaagcacatattgcacactcatacgtccctgaaatgtaagcctcatcgaatagtttcatccctgccagccgtctctactctcctgaatgcggagtgcttgctttctgactgatggcggcaggaaggagaaaggagggcagaactccttccctgccccatctttgagagggtaggaaacccacacttatggaaccactctaacatggaagcactgagctaggcatttgtttaaccctcttacctacttgctgatccccaccttgcacttgaggaaacaggttccaagaagagaaacgagttgttcaaggacacacacagctaagtaaagagcatagctggaattcagacctcggctggtctgaggttcatagttcttactctggctactgtatcattcgttgttggttatgggagttcgtggggatgtggtttggaccaaataggtttccccataattcactgtgccatgagagagaaaactggtcttctagagcagtatttatccagccaacttcaatgggtattgctattgcacattgccaaaatagaggacagagggagctgggtcttccagtcctctcttcagatggcaggctctggaccctgctgcagactctcatagatggaacccaaccaaaggagggaaacaagaagtgactgagctgtggatacccagttccttccctcagtgtcgtagtccagtctggctgcttgatgtttatttctcagtttctggaggctgggaagtccaaggttagggcgctggcagatttggtgtctggtgagggcatgcctttcggttcatagtcagcaccttttccatctgtcttcacatggtggaagcaagcaagggagcactttggggtgtcttttctaagggcgctaatccactcacgagggttcttcccttgtgacctaatgacttctcgaagatcccacctcctaatgtcatcaccttggcgattaggctttccacatgtgaattttgtgggggaatgggagatagtccattacatttgatatactgttcaacccccacaggaggagagagtaaaggtagtagggggctattgagggaaaagctatttcatttcctctataatcagacaaagcatgaaacagaatgttttaaaagcttggcttctgtcctccacagtgtataggaaagaatgtgggcttgggaatcagacatgcttgtgtttgaagcctagctcccatgtttaccagcaaggtggccataggcaagtcacttcttcactgtttcttcccctttacgattgcatgccttgctagggtcattgtgaggactaaaagaagccaatgaatgtaaaactgctggtgaagtgttcaacccatgggtgagccccccaggagaaggctcccagtcaagggcatgagcagtggccactcagtacaggcttccctttcccgtcacaggtgtcccatggagggttctctggggactgtgctcaggtattcatgccgttgcactgggctgagccttgccttggtgtctgccaaggagcattgagaatatgatcatatatgaccagggccacctcacagtgcagtcctcatggggtctttccctggcttagctgtttttgatggtgtgtgatttccctcacctggactcaacctgtccccttggaccctctgcctccacccatcattcagggttcagcttatgtggctcaactgtgagaggccatctgattggcccagccatcagtctcctgggtccctgtgtgctgatctcagacacagtgcaagcccagtgagtagttaagcaggtggactctggaaccaggcttcagaggttccaagcctacttttctgtgaccacaggcaaattacagagtctttctgtgcctctacttccccatctgtaaaatggagttaataatcatgctgccccataggcctgttgtgcgtattaaataaactaatacaaattatgtcttgctgatcatggttattctatagtaataatgaatcatttttaatactaacaatgaatgccaccagatattaataataaattaaggtgctttcttagaataaattttagtactattaaatattctaggccaggcgtggtagctcacacctgtaatcccagaactttgggaggccaaggtgggaggatcacttgagcccaggagtttgagaccagcctgggcaacatggcaaaaccccatctctacaaaatacaaaaacttagctgtgcatagtggcatgtgcctggtcccagctattcagagggctgaggtgggaggatcacctgagcccaggaggtcaaggctgcagtgagccaagagtgcactttgttatgaccatgtcataaacaaataaatattttataaatattttattgcttttcccagatttttttttcttgtgcatatcttgtctctccaatcaaactgtctacaaggccttctgtctcggctggaagttacagcggactcttaaccatcatcctaggctctagttttgcatctcccatcctgcgacttgcatcttcttcattatgaatagagtgatctttctgaaacctagagttacggatgttcctcctgctgaaaatctgcagtacctacagtctgagtgctgaccatgggcctctcaggtccagggcatgaccccacgacgccactaccaacatttttccgccccttgtgcggaaagaccccatatctttccgccccttgtgctccagctagagcacttgagttctcatgctccaaatgagccaccccaccccaacacaacacatcttccctctgtcccaggccctgtctccctcaagctccagcacaagcatcttcttctttgatgcttctctgatcattcttcagctctcatttcttcttcttctttttttttttttttttttattttttgagacggagtctcgctttgttgcccaggctggagtgcagtggtgcaatctcggcccaccgcaacctccacctcctgggttcaggtgattctcttgcctcagcctcctgagtagctgggattacaagcacctgccaccacgcccagctaatttttatatttttggtggagacagggtttcaccatgttggccaggctggtcttgaactcctgacctcaggtgatctgcccacctcagcctcccaaagtgctggcattacaggcatgagccaccgcacccggcctctcatttattcttgatcgtctctccattatcacattcaaattacctgtttgtggacacttttccccaactgaccatgagtgtgccaagggagggacccagtgtcctatgtctctggctgcttcccagccctctatactctaggcactcagtagtcagaaccagcatctactgagcacttaccatgtgctaggcattatttacatgctttataggcatgaacttgtttatttttcaaaaaagctttatgagacagtgtatcattcaacgtcctagctggaggcagaaaccacagcaattatttgaacagagaatttaatctttaaaaatagttataaggcataaagtgttcacttggtacaggaagcactaccctagagctgaagaaataggaggaggaggtaggaatgattaaaacctggggccaggacccagacctctaggatggcatcaccaaccgattccagaggcagcatcactgggccgagaagtagggacagcgaagcgtgttctgagtgtgggaaaaactgcagaatggatgtagctgctgctaaaggaaggaggtgccactgctgggctgaaaaaatgggactagggtgatgcccacagggacaggaagcaacaggaggagcaagcgcctttctccccttccagacccttcatgtcccagtcatgctccctctgggtggcacctacaggcagcaggtggccaagcagaattagggtttgtagagtcgtggcctaagcatcacatcttagggctgagagatgacaatgtaataactggcacagattattcccatttcacagatgaggaaactgaggcacagagattcagtcacttgtgtgagattaaaggactacctagagcagaggcagggtttgatcccaggtgacctggcccccgagcccctacccttaaccactctgccaaaatgttgaatgagcgaatgagcagaccctcaaataatgcttagcccagtgctgagccatggcttcctacaggtgtgagggatccccaccccacccctgccatacctgaccacttccttatctccctgccaggtcattcactggaactcccccaagaagctccgggtgaagaacaagcatgtggagttttttcgcaacctctacctgaccttcctggagtatgacggcaatcttctgaggcgggaactgtttggctgccccagtgaggctgatgtcaacagtgaaaacgtaagtggctcgcaaggctgggcagggaaggggcggcttctctgctcatccatcaaggacctcccccatgccaggctctatgtcaggctcatggcaggacctaggtgaacacaacgccatcggtgcccagggtccaccatctagtcggggagagaggtacatcagcgggtcctttgcatgctcatcattgtggatgcagacagggtatgtttggtccagacgaggtgaagtcagaagtgagtttccaagcagaggaaacagaatgaacaaaaccaccagtgaaaggaaagatcaagtgtctctcatagccaggaaacaccaatgtttttgtggacatgatacccacatgggagaccctggattcagtgtagtcagtgcatggggaaacacaaaaagagcttttcacaagtaactggctcctttagggtgagcatgggtgaagacagtgttaggtaggtactaagtcaccgccatagctacagtctactatagctattcctgtttctctgtctcttcaccacttataatttgttcatatgctgtatctcatttgatgttcatagaaacccacttttttttttttttttgacagagtttcactctgtcacccaggctggagtgcagtggcgtgatcttggctcactgcaacctctgcctcccgggttcaagcgattctcccgcctcagcctcccaagtaattgggattacaggcatgcaccaccacacccggctaattttttgtatttttagtagagatggggtttcaccgtgttagccaggatggtctcgatctcctgacctcgtgatccgcctgccttggcctcccaaagtgctggaattacaggtgtgagccaccgcgcccggccagaaccgactttttagagttgagtaagttgaggcacagagagattaggcaggttgcccatggccccacaggaaacaaggagcaacgttgagactggttgtgagtttcttaggatatagagaagaggcactttaacagaaaaagcagggcatggggagtcaggctgacctgggtttggctttaattccttccagttactacctgtgtgatctcagataagtgactcaacctctgtgcttcattttcttcaactgtcaaatggagaataaaaacttttgtggggccaggcgcggtggctcacacctgtaatctcagcactttaggaggctgaggcaggcggatcacttgaggtcaggagtttaagacaagcctggctaacatggtgaaaccccatctctactaaaaatacaaaaattaccaggcatggtggcaggcacctataatcccagctactcgggaggctgaggtaggagaattgcttgaacccgggaggcggaggttacagtgagccgagatcatgccactacactcaagcctgggcaacaaagtgagactctctcaaaaacaacaacaataacaacaaacttacatgggatgttttgacagtagctgaaaagttgcatgcaaagcacctagcttggtgttggccctgtgttacatgcatagtcaatatttgcactctgctctttccttgacccttagtattagacacagaagtacctggttcattcctttaggcagcaaacatttactgaggaccttctacttattctgcacactaagtattcgtagatgaaaaaggactttggttcctgatctcatgatgtttatattctggtggaggagacacagttaataactaaactcgcagaaaacaatgatcagccagtggcaactgctacatagcaatatattagtgagcagctccactggtttaaggatttctatgaggaggtgacgtttagtctgaaacctaaatgacatgaatgagcctcccagagaagagcaaagggagcacgttccaggtagaggaagtagctggtgcaaaggccctgaggcaggacaggttcggggtgtggaacagaaggatggccagtgtgcctaggagctagtggggagggagggctcaggtaggcaggagccagattggtaggaggttgtatgttggatttcagattcagaattttgatttattgttgttgctgctgtttttatagttattttttatagttattttggatgtagtgagaattcttttaggctcccaatggcagggaagggcacctgtggaaggaccagaggcatgtactcgcctggccttttatcaggatgaccctggtcacagtgcgcccctgctctctgtgactgggtccccaagtcacagtggatcgccactggctctggcccttctccccatcaccctagaggccttctcagcatctgccctccttcgcatctagtgataaaggaaagaaaaccattaagcactggaactctttcagattctgggaagcacttagaggctcaacaaacactgttctttcagtttttccttcagttctctttgctcacatcagtatgtatcatcatcaagatttgagtgcccattcggcacatttttgcaaacgttaaatggaaactgttctcctacctcgtttatttcccccctccatggagaaggctcccataaaaagccttgcaggatgaagccgtcagttaatcatttgtatcagtgcattcccatgccatgctgctgctcagtgttataagaaatgagactccttttatgagtgactcaccagcttttcctaccatctccttcccctggggggatcggcgaggtgaagaagtcgtcggtggtctttctcggaatccgtgaccatacttatttgctcaggaagaatgcgtgaatgctggccatctgccaggagccgtgtagctcacgggggttgaacttagagactgagcccacccctgtatgtaagtggcctgaagcttaacagctcttagagatgccaacaggaagggccgtctgggcccaggaggcccatgaatgagaaagcagcctgctctaagcagtcaccatggctgtcatcccagtctctctcccctctctcccttgaccactatgcatgggccacatccacctcctttctgtgctttctacattctgggctcaccatagggctttcgtgcttgctattcccactggcgggaacaccctgaccctctgtgtttaaatgtctcagctgtgacatcacagaaactttgcaatcccctacccccacacaaagtaatccattaagtcactgtttatgacatgccctgtttctttttgtttggtgttttttttttttgtttttttttttttgagacagagtcttgctctgtcgccaggctagagtgcagtggcgcgatctcagctcactgtaacctccgcctctccggttcaagcaattctgcttcagcttcctgagtagccagggctacaggtgcacaccaccatgcccagctaatttttgtatttttagtagacacagggtttcaccatgttggccaggatggtcttgatcatgatcacctttcatgatccacctgcctcggcctcccaaagtgctgggattacaggcatgagccaccgcgcctggctttttttttgagacggaatctcgcactgtcgccccagctggagtgcagtgccgcgatctcggctcatggcaacctctccctcccagattcaagcaattcttcttggctcagcctcccaagtagctggaatcagaggtgcctgccaccatacccggctaactttttttgtatttttagtagagacaggttttcgctgtgtcggccaggctggtctcgaactcctgacctcaggtgatccacccacctcagcctcccaaagtgctgggattacaggcatgagccactgcacccagcccctgttttctttttgtcagagcatctactcctgtttacaattacctggttcatatgttcgtttcctacattttttcataaatgtaataccaaaacataagactcttaaagactttgtactgttcacctctgaggttctccgtcctaacataggatagaaccaagcacataataagcacctaataaatatttattgagtgaatgtactaagtaaatttaagaagtaagaatgaattaccaccaagtaaagggaagagcagatgaagaagtgaactgttaaaagagaacatgctggaagttcatgtaccagagcacaggcatgttgggggcatggctaggaacaaagctgaccaggaggcgccctgactgtgctgagaagcttggagtttctcctcagggcagtgaggagccactgaagggttttggtgatgggcagatttatattagagaaaaatcactcaaggtagaggatgaaatgaaaaagacaaaactggagggaccacttaaaggacattgccccggcccagcacagtggctcacgcctgtaatcccagcattttgggaggctgaggtgggcggatcatgaggtcaggagatcgagaccatcctggctaacacggtgaaaccctgtctctctaaaaatacaaaaaaatagccgagcttggtggtgggcgcctgtagtgggcgcctgtagtcccagctactcaggaggctgaggcaggagaatggcatgaacccgggaggcagagcttgcagtgagccgagatcacgccactgcactccagcctgggtgacagagtgagactccgtccaaaaaaaaaaaaggacattgccccatcccaggcaaaaacatgatggatggggctctgatctctaggacagttgcggtgggaatggagagagcagatggattgttttgtgggtactaagaacatgagagtaggtgcagctagcactcataagtcaagacaagcaggttcctgtacactgctccagccctgttcctctgctggctggggctggggctggggctggagctggggcaaagagagagtctgtaaacattgcactcctgaaccacagctctgtagggagtttaccacctggtcttccgcagcgcgtcaagtgttatctgcagacacaaccagagggaaagggtatgatcttggatccagcccaaagcctatgctcccagctctgtgggaagaggtcattagagctgtgataagtgcacagatggtggtgagtctgaaagaaaccaagtcaggaacctcttctttggacttgagatcctagatgggagcaggctctgatggcagtgtctaagtgacttaagactcctttcatccactgtattagtccattttcacgctgctgataaagacatacctgagactgggtaatttataaaggaaagaggtttaattgactcacagttccacatggctggggaggcctcacaatcatggcggaagagcaagggacgtcttacacagtggcaggcaagagagagaatgagaaccaagtgaaaggggtttccccttataaaaccatcagatctcatgagacttattcactatcatgagaccagtatagggggaacctgcccccatgattcagttaactcccactgtgtccctcccacaacatgtagcaattatgggagctacaattcaagatgagatttgggtggggacacagccaaaccatatcatccacccagctgataattcaggtagtcgccagacacagggctagtgttctagcaggcagcattgcagattaaagctcggctcttgcagtcactgttgagtgagggttacagacaagcagaggattattaagtagtgcggttagtgccaaaatagtggtagtgctttgagagcacacgggaagggcattttacacaactagggagagaaggtgcatcgaggaagacttcctggaggaggtgagatttaaaggttgaataagtaggagtgaaggagtctgaagggtaaacttggtgggtgggagggagcaacatgagcactggagaccaggagccaacacaagcatgatcactcgaggacctgctgggagttgagagtcaaatgaagtcagtgtgagaactataaaaatggctgcacaggccaggtgcggtggctcacgccggtaatcccagcactttgggaggccgaggcgggcagatcacctgaggtcaggagttcaagaccagcctggctaacatggcgaaaccccgtctctactaaaagtacaaaaagtagctgggcatggtggcacatgtctgtaatcccaggtactcgggaggctgagacaggagaatcgcttgaacctgggaggcagaggatgcagtgagccgaaatcatgccattgcactccagcctgggcaacaagagcaagactccgtcaaaaaaaaaaaaaaaagataagaagagaaagagagagagaaagaaagaaaagaaagagctgcacaagttaatttttgcattattttaactttttcactgggaaattgataatgacaacaagagtatgagctctctggtaatctgaatcgctcatttaatagacacatgacctcagagaagtcacctaaatgctctgagccttgggtttaccatctgagaaatgggtacatgacaccattgccatggggttttatgaacaattgaaggccaaaaaagaaggacttggcaccaggaacacagtgtgccttgggatgagtttcttcacagaccccaatgcctgacccatgtgatcataatccactgttccacacataggctttaggttttattagcaactctggtaaaaagacgtagcagagaagggaacctgtagagtctctgagaaatctgtctgtaaagcatgtgagagggtgtcacatttgctctaagtcaaacaatccccagtatccccactgattcggaaattcagggtaggaagaagaggctatttggtttgccttgctgccaaaataaaaataaggacatccagtcagggatgtaattcttcatcaaggagccaagatgtgaggggcagagcgccatttcagagccactggttgggctgcttgctctaggacaagacagtttgatttgcaagagaacaggctcccccagtgctatggaatgacagtagctaattggtcacagccacttgtctctcatagtttgggcatctctccctggaacttgtaaattctttatgtagtgcagtaagcatttggtatgcattggttattatgagttgattgattgacatagggatggaggttagaattctataccttagcatttctctcccttttcctcaacaacccagcccctcaagaatatccaagaaatggcagggtgcggtagctcatgcctataatccttgcacttttggaggcagaggcacaaggattgtttgagcccagaagtttaaggttgaagtgagctatgatcgatccgctatactccagcctgtgtgatggagtaaaacccagtccctaaaattaaattaaattaaattaaatttataaaagaatatccaagaaaccccaggactcttccagaacatagttggataatcagagctattctctaccgttttttctattcagaatccttccacagtatccctaataggcttgcatctggcttctgctgaaattctcccaaagacagagagccaccttccaaggcagcttactctgctattggaaagctccagatgctaaattgttctacctcatgttgggctgaaatattcccttctgtaaagaacccactgatctgagccctgtcctctggagtctaggttttgttgggtttttttttgttgttctgtttttttaatgaaacataaggaaataaggatccttccacctccctagtacctgacagcccagaagatagcatagaaagtttccattcagtttgctatttagaaacatgcaatgctccctaagtattgtatttgtagggtgatgctttatcatcaagagggtcttgctccacctaagggaatttccaactaaaggaacctcatctttttaaatgcaaaaaccattaaaatagatgggttttaaccaatttggacaggaaacttgctgctaaagtgtatgccgttcctttagtaagcaaacactaaactcagtttagtattaaactaagtttacaatatttgatgactgtggttacattgaaaaggctggaggaggtggagggggttgtccagaggaggaaagatactgtttaacctggcaggaaatggccccagactgttcactgcttattctgtggattcctttctgacagctgtcactttctgcttatcagcttcagaacaaccctttctgggctcgcctccttgttccttctttccaaggcagccaacgcccccttccccccacaaaaaaaaaacccacaaaggtatttaatttagaaagactgatggtaaaagaatgatctgttgttatgttaaaagctagattatgaaacataccaaacatccacaaactacaaaaaaaaaatacactggacaccaatgaatttttgaatgtatatggaattgtaagtcaacagccagtgtctccaacccctgcccacagcagacatcactaattgatgactgcattattcacctatgcccagcttctttatcctcctcaaaacagcactctgagtaatcagtattggtctcctagcctcctagtgatagcagggaaccaaagcctgctgggtatccctacgataggtattagtcattctggtctctcctgcatgagcacagctctttgtgctgttctaagacctttctctgcttgcctctagcttttgggaattggaaattttctacagggaaagaaagagaaagggaaatacaactttaatcttcaccacaaagagtgggagtcattatgagtcacatttcacagataaggaaaggaaggcttcaaagaaatgatttacttgttcaagaccacacaactcctaagtgctggggccgtgattagaaaccaggtctacctaactctaaagccacaagacaaggaagtgcttcccaaatggatgtagctatgtatgtcatattaatgtaatagtaagttacattattacatatatccaggttattccacaattctcctagttgttatatggatacggttttcttactctttcactaacccttcaaggtagttcctgttatctccttttttattatttatttgttttattttattattattattattattattattattttgagagagagtctcgctctgtcacccaggctagagtgcagtggcacaatgtcggctcactgcaacctccgcctcccgggttcaagcaattctctgcctcagcctctcgagtagctgggattacaggcacctgccaccatgccaggctaatttttgtatttttaatagagctggggtttcaccatcttggtcaggctggtcttgaactcctgacctcgtgatccacccacctcagcctcccaaagtgctgggattacaggcgcgagccactgctgttatctccattttatacagaaggaaatagaagctcagagaggtgaattcatagaacacgttggtggcagggctgaagccggtatcaagccctgattcatagttgagtggtctctctacgactatttaaaatactcctctatctaaaattgcaatgcctgtcccataccccagcactccctctctccagggctccttcatttttctccatagtacttatcactaatataatcatgacttatttatttttgttgatcatgtctctacccactagaatgtaagctctgtgactacggggctttttatctgttttattcatcagtacatcttcattaaagagtgcctggcaccagatccatgctcaataaatcttgttgaacaaatgaactataacaagtccttttcttgaagcatttgtggtgtgccagaagcatccctccacttggactcagaaaatttggcccaagctgggaatagtggctcatacctgtaatcccagcactttgagaggctgaggcaggaagatcacttgagccccaggagttctagaccaacccaggcaccatagtgagacctcgtctctgtgaaaaataagcaaaccacacatgcctgtggtcctagctactcaggaggttgtggtgggaggatcacttgagcctgggaggtcgaggctgcagtgaatcgagacggcaccaccacactctagcctgagcgacagagcaagaccccgtggccctagaccagatctatgattttaggcataactctagccttacatgaacctcggttttcccatctgtaaaatggtcagtaaatgcacccacaccaggctatttgaggaaagttaaaggggttaaagtattcaaagtgctgcaccatctaggcagttattgttacgagtattttccagaaagcttgtcttggatacccgctctctcaactgctgggagatcactgcctcacctctgaaatgaagaaggcttccaagcttaactctctcacgctatgaaggtgacaggccacttccaaggccacgttccctgacactaagcctgctaagaggaaaaaacaacagcatcacctcaactagaagttaaaaataagacacatataaacagattctataacattgtatggcatcaccctgcaagacaatgccaagaaacagatggctctgtggaaacagctgtatctcagaagaatcccggagaaagcccagaatgcattcctgctctcacgtgcgagccgcatgtcgccaactcttcagtcacgcagcaggcagcagagcccaggatggacagacccaaaaccctaagacaggctaggctgctcaaggccagtctccaaaggaccctccaggaatgtgttaagctccagagagagggggtgaagggaagaggagctgtgggatcaagagactcagtggatacaagtctgggccacggtttccccttgtggcctggctgctttgatcctgttcagctgcaacttacacagagccctgtttgacccctctaggcactggttgtcatctctctgcacttgccaggtgttcggccctcccttgtctataaagcagctccctcccttcctctcctttccaccatatctccctttctcaagtggcatctcttacttgtgcagtagataagaaggcagctctggaatgaggctgcctcatgtgaaatcccagctggactgccagctgtgggattcctggtgatctgcttaaactccctgcacctcagttttctcatctgtacgatggaaattagttattcctatctgatagacttaagaggaatcaataaagtaagacagggccaggagcttagaacaatgtggcagatggcaaaggccccccagaattaaggtttgtgttgtgattgcactgtgtttgtaattagtgactggcttcattgcctctcctcctagaccataggaataatacaagtgcagaagcaggagctcattccccattcctagcacaagacttggcataaaataagagcctatgaattgtatgtgatgcgtgaattaatactgataactgggagggaggagaccaagcctttttcttatctcctccaagtcgaggtcagggctgggcagaccctctctgaaccttcactcaacagtcctgaatgcagccccctacctccctgcaaaagaatgaaaatggactcatagtttggtttccttagtaaaaaaatgctttgggttcctggaacttgttgattaatacacacagcaggcaacgaggaaggtcgtgagctttttctgcctgtctgtgtggcttaataagatgtaactgctttgtggaaaccacagggacaagctctgggttaggtttcaggagaccagagttggagccccagcttctctgagcaccttgggccctcatctgtcaactgagggccctaagggcagccttgcctgtctcatgcaagcgctggggaggagtaaaaatgaaatagtggatacgaagccaccaaaaagtgaaagcaagttgaaagtgcaaagcaacatgcttgagtggtaatttccccatcagtgatttcacccattgccccaagacatcagaaggaggggtgtcacaggaaggaagaaacggggcctcccagactccttaattggtccatcgtactatgtctccatcacttacaggctacaagcattcaaatgtgcctgttagtcaaggtagcacaagcagctgtaatgtggctcaacctgctggaaccttgcagaaagtccacatgggtgttcatgattggcaggtagtttttctgcaggttgaaggacccaggctccttttgtcttgtggctctgccctccacagaaccccagcctgctctacaggattctcttgctctggctgtcagccaagaaaagaaggcgaataaaatttgttcctgagcaaggcttcagagtggtgcctgtactagccagagcctttccagactccagtggccagagctgtatcacagagttattcttaactgcaaggaggctggagatacagcctagctctgtgcccaggaagagagcaaaatatggatattggtgagcacaggatgtttctgccaccatgtgaaatacatgtgttgagtcctctgcagtcacagaatcgtttactgttagaactagaaagaagcccagaggctgaccaactaggcattgtagtgagttggttacctgcaagaattcagaggaaatacacctgggtttgaatctcagctactctgttcgcgcattgtataaccttaagcaatggctaaacctttcagatgatggatgtcttcttctactaaagaggactaagagtggttcttgatctgtagagttgatgtgagtcttacatgagaaagaacctgcaaaagctctccccactttacctgacccagtgagtgcgtgatccttgagcgtcactttaggaagtccaaaccctttgtcttactaattcagagacatgacttgctcaaggtcgcatagaaaatgagtgtcagagatatcaggtctcgcttttcagttatccccataatctcactccttagtttgcgcaactgtgaacagaagtctctaaggccagagcacaggatgcacttgtactccctctggatcctcaggtataaccagccatcatttccagcagctcaaaaagtcagtctaggccactgtccttaaagatgaggagaaataaatgcaaactgcctaacgggccattttcccttgggtccaaatttccctctgcctcagctggctgcccaaagaagcagtttagcaaatgcattttatctcaggagaaatctgtcttttgtttctgtgcctcccttgtcaggagccctctgttccctgtggcagtggccagagagcagagtacagtagcattcagaccctgttaatgaaatactccctccggctccatggctccccagagaaattacccaaaccctgggtgaaaaggaggcaggttttgtttttggcttttttgttgtttgttttggggggggggttgtttgtttttggctttttgtttttgtttttttggcttttttttttttttttttttttttttttttgagatggagtcttggtctgttgcccagactggagtgcaatgacatgatctcagcttactgcaacctccacctcctgggttcaagctgttctgccttagcctcccgagtagatggggttacaggcacccaccaccacacctggctaatttttgtatttttagtagagatggggtttccccacgttggccaggctggtctcgaactcccgacctcaggtgatccacccgcctcagcttcccaaagtattgggattataggcgtgagccaccgcatctggccaaggaggcagtttctaaactgctagagtctccccattgagataacattagccacgcagtcaggaataagcgagcctaaattagaatttgaaaaggtacataatataatcataaccacattgcttaggtttgggtagcactttacagttcacaaagcagttttacgtgcattagctcatttgagaaaattgcagggaattagttaactacagaaaagtttaagaagccaataaaattcatctgtgaatccaccactcagaaaatctttgttaacattataatgtgttcccttctttttttgagtgggtttttctttttcctttcgtctttttcctgcactgggaccacagttttttatggcctgcttcgttcatggaacattgtgtcttccaccatctcatttgattctcacctccatctcctgggaagaagtaattgtgttgtgaaatgtccctggtttgaggtccgaagactggattcccatcctggacttcttctcgctcactgaagcagattactgaaagctcctgagccttagtttcctcctttgtacaacagatatgtgtgctgaaggattaaattgatgaagcaatgcacctgaaaacatttagcattgcgccagtcacatagtaggtacccagttagtattaggtggatcaaggtgcaaagcaccatgtagaggagaaatgaacatgcaagttcaaggatggcttctggttgccccagagtcctgtggacaggtacgtctgacagcatacctttctttctttcctgttttgtttttgttttttgttgttgtttttgtttttgatggtggtggttgttttttgagacagagcctcactctgtcacccaggctggagtgcaatggcgtgatctcggctcactgcaaccatcccctcccaggttcaaacgattctcctgcctcagcctcccaagtagctgggactagaggcgcacgccactgcacccagctaattttttgtatttttagtagagacggggtttcacggtgttagccagaatggtctcgatctcctgacctcatgatccgccttccttcgcctcccaaagtgctgggattacaggcatgagccacggtgcccggccaccttttttttctacaatacccactgtggttggtaaatgacaatattccctagataataccctttatacactgcagcaagggctgcaagtgagcttgggatgtggatgccaccaaatcccattattggtaccatgaagttcagagctggaggtggcctcttctccaggactgccctagtccatcccactagggcaaggtgtactttggaagtcctcggagcatctccgttgaccagtactccctctcctaacatacaggggctgaggacatccaacagaggcttgctgaacatccaagatggatcacatcagccacgcagtcagcaataagcaagcctaggttaggatttgaaaaggtacatgatataatcataaccacattgcttaagtttctgcagcactttagagtttacaaaacacttgacatgcattagctcatttgagaaaaatgcagggaattaattaactacagaaaagtataaagaagccaataaaattcatctgtgaatccaccactcagaaaatctttgttaacattggatatagaacctggatattgctaggttcagatggttcagaaatgaaggggatacagctcctgctgttaggagctcaccatatggatgctttttagaaagtggttcctggagccatttacctgggaatgtctttttccccaactcaagggtatgtacctgtgtgtgcatataaagagaaggagaggccagacgcagtagctcatgcccgtaatctcagcactttgggaggccgaggcgggtggatcacctgaggtcaggagttcaagaccagcctggccaacatggtgaaactctgtctctactaaaaatacaaaaattagctgggcatggtggtgcgcacctgtaatcccagctactaggaaggctgaggcaggagaatcgcttgaacccgggaggcagaggttgcagtgagccgagatcgtgccactgtactccaacctgggcgactgagtgagactccatcttagtcaatcaaccagtcagtcagtaaaggggatgagaaacccccatacatgcatgtgtttctcattctccactcactaatgcccattttcacatggtgaggaccagctacttgtctgaagcctcatcaaagaaggacccatttctccacacacatttgcctacccacgctcacacccacgcatcacacacatttccactgtcctcttcattgaactggaagcccttcattcttctgagcatattaaaacagaaaccaaaaccaaaggaaaaaaaagccaaccctgctcttgcaaagaattttgtagatgtttagtctccagtggaggataatttcttgtgctcttctgcagtgtgggtgagggagtttaggagcatagcagttggttacgttttctgccgggaggtaacattatggtttataggcatattttaggccctcaaggggaaagccagggggactccctctaatatgtatgaatcagaagggccaccctggctcatccagcccctaccatccctgcccaccaggatcttgccatacagtctccttcaggtgaggtttgaggacaaaaagtatccacataggtgtcttcaggggcccaggtgtttccctttcctgtgataatcactatgataataggtgacatctgttgaatgttttcttcaaccgctgttttctctatatgcagcatctttcagaatccttctataaccttctggggtagtgagttttgtcgtcctcattttacagctgaggaccctgaagctcagaaaggttaggtcactcacccacttacctgagatgatccaggcagaatgggttagaaccagtgtccttagccactgtgctgcatctgcgtcttcacatgaggccaagcaggcatctttcctgaagcagcagcatggtggtggaggggcacagacccaggtttgacacctccacccttctcaactgttggatgaggctgccagtgactcaccgggggctctggggaggagaggaaatcacctgtacccagcaccttacgtggagcttggcacatgcttgtttgctctccaaaagcttttcagccgtcacagacccttggatgcaaatattgaagcaaatcataggctgaagaatgggcttattgatcaccttctgtgcatataattagaggacacaaaaggaaaattgaaaggatagtcttaacttcacagtgattacaggttttttgtatacagcaaatatttttcaggcatgcaacacatgatattagcacctgtcacaagccaggcatggtgctcaggacaatggtaaaatgtcacagtctcaccgggaaagttgccgttaaataatttcagtttaagttgacaagtgctttaatggagttacgaactgagtgctcttggagcgcagagaagaaacggattgcttctacccagcaggatctgcagaggtctcacagagcaggtgccatctgggctgaatcttgaaaggtaaatggaaggttttttaggtggaggagagtggagtgaagtgagggagggcatccccgagagggaagagcatggcacggaacaaagtcacggaggtgtgagggaaaggcagatttggggagcacacagaccaatgatgaggccacagagtgtgggggtgatgggtcagagagagcagcccgtaattgtcaacaaggaaatctggatttaatcatacaggtcagaaggaagcagtggggtcatagatcttagatggaatgagaatttcagcttccttgtcttatattaaactgttggcatggtgagaatcttcaaataggcagggacagcaaattgacttgaaaagctgaatatccctaattgcatccttttaacggttaaaaattttagagatagttgacagtgtctcacagatgattggatctcagccagtttcccaagctgcatttggaaatgttcaagtacatttggagcatcacagggctgtctggagaatgctataagcatttggtgggcaggagctcgggaggttgattgtccttcaatatgtggtacaggtccccataataaaaaagtgccccccacaaaataccaatagcactctatcagtatctattgctcagaaccagtaagatctcagtggccttcaagaagcatttattggccgggcgcggtagctcacgcctgtaatctcaacactttgggagggttcggtgggtggactgcctgaggtcaggagttcaagaccagcctggccaacatagtgaaaccctgtctctattaaaaatacagaaattagccgggcgtggtggtgagtgcctgtgatcacagctactcgggaggctgaggccagagaatcacttgaacccgggaggcagaggttgcagtgagctgagatcgcgtcactgcactccagcctgggcaacagagctagactctgtctcaaaaaaaataagtagtatttattgaggcagctgggccaggctggcttgcatgactttggcaattggggaggagctgctctgccccagatgtctcatcttccagcaagctagcctcggcatcttctcatggcaatggtaggggtgcaagaaacactttctcttgaggtctagcctcaagactgagacaatattacttcccctgctttttgttaacaaaaatacatcatgattctagcccttattcaaggctagagaaataaactgtgccgctttagtaagcaccactgcaaaggacaaggatatctggggtggcggggagtgggggagagagaaggaattggagcaattaatgccatcatcttccatagcacacatcttgagaaataatgccatcaagtaatctgtcaaggcaatggtcttaacaggtacaaagctctacagaagcaagttaatatattttcttattgactgctacactgttgatttggtgatttaaaaaagtacaccttcttggaaaaacattctatggtattcagctaggttggtaacccttgccatgtaaacttttgtctgtattctatcgtgtgatagacaaggctgatttaacagaaaaaaaaaaatggaaccagccctcctgtgacctttggcaaattatcatttttttttaatatactttaagttttagggtacatgtgcacaatgtgccggttagttacatatgtatacatgtgccatgttggtgtgctgcacccattaactcatcatttaacattaggtatatctcctaatgctatccctcccctctcccccaaccccacaacaggccccggtgtgtgatgttccccttcctgtgtccctgtgactacaatagcaaagacttggaaccaagccaaatgtccaacagtgatagattggattaagaaaatgtggcacatatacaccatggaatactatgcagccataaaaaatgatgagttcatgtcctttgtagggacatgggtgaagctggaaaccatcattctcagcaaactatcgcaaggacaaaaaaccaaacaccgcatgttctcactcataggtgggaattgaacaatgagaacaaattatcattttttaaaagtttgtttttatggaaatacagattgcctccgacaagtcctcccattctttttttttttttttgagatggagtctcgctctgtcgcccaggctggcatgcagtgtcatgatcttggctcactgcaacctctgccccctgggttcaagcaattctctgcctcagcctcccgagtagctgggattagagatgcccgccaccatgtccggctaattttttgtgtttttagtagagacggggtgtcaccatcttggccaagctggtcttaaactcctgacctcgtgatccacctgcctcagcctcccaaagtgctgggattacaggcgtgagccaccgtgcctggccaagtcctcccattctaagtgcacagtttgttgaattttcacgaaagtgcacatccatgtacccatcgctccagtcatggtggagcgggtttctgtcactcccagccctctcttgcctcttcccaggcttcactcccccaccccacatgcccgagtccaatttttgtcactgtggattagctttttgctaagttgtgtcactttttaatttcagttcttcatctgtaaaacatacatcatacctgcctggtaggggttcacatgagaccgtgtctgttgggcagctgcagatttgcacatctgtgtatctgcctctgcatatctgaaatgttatcttcttagctccctgtcagcaggtgtgcctgctcttttcacaagttggtgaaggaagagagaagtacagctagttaaacaacttctacaagcagattaatgaagtaagactttcagagagttcaaagaaagaaaagagaaaaaagtacgggtgccaagattctgattaaacttaggtgaaatgaaaggaaaagagtttctgttttgttaacgtgctaagttttgttttgttttgtttttttccgagacctagtacaaaaattgaaatcagtagctctagggagagaaaagcatcaggtcatacggaggtccttgtcagttttgagcgttttcttctttgggcattttcctgtgtaatttttatttttatttgttttatttgttttttgtttgtttgtttgtttgttttgagttggagtctcactctgtcacccaggctggaaggcagtggtgcgatctcagctcactgcaacctctgcctcctgggttcaggagattctcctgcctcagcctcctgagtaggtgggattacaggtgtccgccaccatgcccggctaatttttgtattttttgtggagacagggtttccccacgttggccagggtggtctcgaactcctgacctcaggtgatccagccaccttggcctcccaaagtgccgggattacaggcatgagccaccgtgcccagcccattttcccatgttatttgaaattgttatgctgagttgtctaggaaaacatttctcatttgtttctaaggagtttatggttggttatatgtttttcagtgagcaccacctttgttcttagctaagaggggactcatttctcaggtgttaaaggcatcctcttttttttgtttttttctttgtttgtttttgttttgaaacagggttttgctctgtagcctaggctggagtgcagtggtgccatctcagctcactgcagcctccatgtcccgggctcaggtgattctcccacctcagcctcctgagtagcactacagccacacacctccatgtccggctaatttttctattttcagtagagacagggttttgcctggttgcccaggttggtctcgaactctcaggctcaagcgatctgctcgccttggcctcccaaagtgctgacattacaggtgtgagccaccacagccggtccccaggcatctgatttttaccatcacctttttgaaattagattaagttgcagagggaaataaaagtggtgatcccttccatgtacgtcagacccatcaacaacgtcctgatgggtaataaactcaggggagggcagggctcaaggggcaagctcatgggccccctcggacctcttcttcacgtgcccaagccctctctcctaccctgcagctccagaagcagctgtctgagctggacgaggacgacctgtgctatgagttccggcgagagcgcttcactgtccaccgcacccacctgtacttcctgcactacgagtatgagcctgcagcagacagcacggacgtcaccctggtcgctcagctgtccatggacaggtatggcagacggcctcacccaccccagtctcctcaccgcggctgttacatggaggatagagaatggagaagggtgtgcctgcttcccagtgcatctgctaaaattggaggatggagcaggaagagatggcacatgggcttagaatattgaagcctgggccgggcacggtggctcacacctgtaatcctagcactttgggagccccaggcaggcagatcacaaggtcaggagttctagaccagcctggccaacatggtgaaaccccgtctctactaaaaatacgaaaattagctgggcatggtggtgtgcgcctgtaatcccagctactggggaggctgaggcaggagaatggcttgaacccaagaggcagaggttgcagtgagccaagatcgtgacactgcactccagcctgggtgacagagcacggctccatctttaaaaaaaagaaaaaaaaagagtactgataagggtgagctgtgtcacatccctaccacctccccagcaccgaaaaccaagggctcttaccttatcattgtctgaggatagatgaaaggatcgattcttaagaagtagagcccgactcgaattacctcaggaagagggacagtggggagactggagctacaattgcggctggaaagcaacgctgtttcttttccttctatgtgtattgatgaagcaaacatccatcaagcatttccaggcagtacggacatgagccccgccctgatgtagcttacaagccaatgcactgcttctcaaccttgtccagggagattgaatcacctcgggagttgtataacacgttcacatccaggctcccttgcagagcagttaagtgaggacctttgtaggatagagcccttggcattgttttgttttaagcttataacgtgtagccagggctgagaatatggagctagtcacataaacagcaatacacgcctcccgggttcacaccattcttctgcctcagcctcccgagtagctgggactgcaggcaccagccaccatgcccagctaattttttgtatttttagtagagacagagtttcatcgtgttggcctggatagtctcgatctcctgacctcgtgatcctcccacctgagcttcccaaagtgctgggattacaagtgtgagcccctgcacctatcccaatttatatatttttaaaaacatctctggctgccaagaagtgaatggatttgaagccccaaggtcactcagccagggctacatggcttttctatacttggccattccaggtgccccttcccaccttgtcagactggcttccgcttcaatttacacatggcccacagtggctgcccttaccccaactccctcacatgtcatcccccctcagctcctacaattaggaaggaagtttgattcctcattctgtcttttgagccacatcagagatgcctatccagcctatgggtgagattccatgggattgttctaaggattaaatgagctaatgcctgtacagtgccgagaacagtgcctggcacataagtgttccataaataccaggtgttattagtcatgaatgactgaagaatggacaaactgatgaaagaacaaacacctggatgcaaaaacgttttcataaaggcacttgagagctccaggaagtgagaggaacctggcgctggaggcaacgtggaatgattcatgttgagggtggctcagggaagtggattccttgctctgtgagtcccgccacatgcaagcaaatgaccacatgcataattcaatggcttcaggggccggcggtctcttggggattcacaggctccaaaagaacttggagaaaggccactgggactcctgtgcacagagaacttggggatcctagcaggtaacaggtaaagacagcatgggacaaaagagcaagggacaagcatggaggctctagcaccaggtccatgcttgacctgctgtgagggccctggcgagccctgtcccttcttgggcccacagttttctcatctccacatccacatgatcactcggcaaataccgctcaccgttctgcaccaggcacttagtgggaggggaatatgtgttaaaagacctatccctgtcttcaaggagtatgcagcctatgtggggctcaggcaccccattcgttttctgttgttaggtgacaaagtaccacacattgagcagcttaaaaagtacacctttgttaccttgtggccactatgggtcaggaatctggaagatgttagcagggccctctgcccagggtctcaggactgaaatctcaagggattatccagggctgggatgtcatctggggattggcatccacatccaagctcatttgggttggagcagaattcagttccaggatggaggtcccatttccttgctggctgttgatgggtgtccccctcagctcctcgaagccacgctcagttcctagccatgcagccccctccctgcagggcagcccacttcttcaaggccagcaggagaatctctctggcccatgaccctggagtcttctataacatcacatgatcacaatgtgatattcagaagccctgcccacacccaagagggcgataacacagggcatgtccgccagcggggcgggaatctggggggtccctcatagaactctgcctgtcactgacaggtaaacaggtctacagtaggatgtttagttctgagtgtcgtgcaggaggtgcaccgattctatgagagcccaaggaagtggagaaaggaaaaggcagggaatgtgtccgaggggaggtagtacctgagttgagttggaggctgagtggactgagagtagaaggcacagaaggagagaaggagggctccccgagatagagcgtgcagcatgttcacgggacagagaagacgtcagggccagtggggaacacaatagtaaggtgtggttagggcttagggtgtaggagggagaaagaggagatcaaatacacatggccaggtaggcaagggctggatcacagagggcctcagggaaaccaggggaggtggccagcccttccagctcaaatctggcatcctgtgtgtctccatagggacacccaactggtgtcccagagtcacccctaaaattctcaggtccctttggcctctcacccagatttcagtttggacacctaggctccccaccactaagcatcaggaagccacctcaccacaaagtccctcttttcacatatgtgtttccttctcctccatggcatttatagtaaaaagaaaatggaatactccatgtcagtgctgaatgatggtctagattggtctctttcaactgcatctgtcccctcccgtgagctaactgaaactcaggtactataatccatgcaagtgagagggtttcacttaaagccaggtgcccatttctccaaccatcactggctctctgttgcattcaggcctcctgataatgcattcagattatcagcaaaatattctgagtcaatattagtggccagtggctaccaaagaaatctgatatactttctaatcaaagtaaagagtagcataacagtgaatgacacttggtccctggagtcaggcactgtgggttctttgttgccctgtcactttgtttttggacaagtcacttaacttttttttttttttttttttttgagacagagtcttgcggtgtcgccaggccagagtgcagtgttgcaatctcggctcactgcagccttccccttctgggttcgagcgattctcccgcctcaacctcccaatagctgggactacaggcgcgcaccaccaggcccagctaactttgtatttttagtagagacggggtttcaccatgttggccagcatggtctcaatctcttgacttcgtgatctgcccaccttggcctcccaaagtgcatcacttaacttctttaagcctcagtttcttcatctgtgatctgaaagtggtaactgtatcattatcctcatccctaaggttgttacaaagatcagatgagagaaggcgtgccagtgcttagtcctgacatacattcagaggctcccagaatgataccagtactgttgaccagaatcttaatatttgtgatattgggtaaaaaggcactagacggaaggacagagagctccgggttcaaatcccaccaactcattcaatcctcagctggtgttctgggcaagtcacttaacatctttgggtttccgtttcctccttctataaaagaaggataaaattacttgcctcatagggtcctgtttaggagtaaataagagatcctctataaaagccctgagcacatatttgacatccagtaaatactggctagatctgaacatccttacgaaggcatgtgcacatgatagttatttaggagaggtaaagtgatgtagtagaaaagaaaaaaaagcaagacttggattcaaagtacacttgtgccacttcctagctgtgtaagtttgaacgacttacttagcctttttgagcctcacttgactcatctacgagatggtgataacgtcagattcactgattattgtctgggttctacaaaataaggtgtaaagtgcctagtaagtagttgatgtgagaaaatattaatttcccttttcttaatgtttctcacctctctgctggctatagaatttgctatctggaatttgcaaacaagtagaacaaacatgtttctagttattaacagctcaaacccatccttctgtatacactagttagcaagaagagaatacagacaaaaccaagtgcctccttctattgccagtgggatccatccttctggcctgggctgcagacacagtgcatttaaaagaaagtccggggccgggcgcggtggctcacgcctgtaatcccagcactttgggaggctgaggcaggcagatcacaaggtcaggagatggagaccatcctggctaacacagtgaaaccccatctctactaaaaatacaaaaaattagcctggcatggtggcgggcgcctgtagtcccagctacacgggaggctgaggcagaagaatggtgtgaacccgggaggcggagcttgcagtgagctgagatcgtgccactgcactccagcctgggcaacaaagcgagactcggtctcaaaaaaaaaaaaaaagtccgggccccactcacatatacagcaaacaccaaccatagcggtcttcccttcaaagcatggacagcccaagcgtagcagacacacgatacccactcctgtattgtgacatgtatcaccatcaggacagtatctcaagagaacccaagggatgccaagccctaatgagaggcacttaacgggccacaattaaaaattataaagcggcactgcaggcttatgaagaatggtagaaattcctgcagccacttccactctgtcaacacatccgattatgatgcagcacgcggactggtgcctgttggattgatttttaatttaagaaacctttcagatatatttgtaaaccttcgagtcagaagtaggccctacgtgaatgccacaacgaattaggagagccggccttcgcactcccgtacgcagctccctctggaattccgttcagaaagaatgaacgttgcaaccatggccatgaagccaggagttctgcttctccttcagcagctcagcacccttccctcccatcccagcagaagacaccaatggcaaagggacagagggagctgatcacgaggggttcacctatcttctgacaccacaccagggagagcctggttctttagtgtgtttttgacaaagatgttaagtgttgactacagttgcggggcctcatggggatgacaggtcacttctctgctctctctgagtaaaggagagagaatgggctgggctcacagagccctactctctagaacagcgttgcttcaagcctgctcctggaaccagcaacacagcattgcatgggagcttgtcagaaatacagattctcaggccccaccccagacctcctgaaccagaatctcgggtggtgcctggaaataggggtcttaagaagccccgcaggtgatctttaagaagcttacatttgaaagcactgaccgttctggagagtgaaaggtaattttttctccatgtaacaggcagagcgatgttttaaaaatgtaaatcaggtcacatcattaaaaccctcagatgacttcttgttacatgtggaacagtgtcccacccgcctgctgtggtcttcaaggcccatccagcctggcatctgtgcaacccctgacaccttcatctcacccctgcccctcaccgtcctgtgctgcacccacactggtcctgtttcttcctgctcgaacatgctgagcccattgttaccccaagggccatcccctcttcttggagagctttccccccagacttttcacaacgccagatccttctcattatctgctgtaacaaaatgccacaaattatttgatatatgaacaatggaaatgtatttatcacagtgctggaggctggaagtccaagatcaaggcttcggtcgatttggtgtctggcgagggggcacttcctggctcacagagagtgcctcattactgtgtcctcacgtggtggaaggagccagctagctccctgggcctcttaaaagggcatgaaggctaggtgtggtggctcatacctgtaatcccagtactttgggaggccaaggcagtcaaatcacctgaggtcaggagctccagaccagcctggccaacatggcgaaatcccatctctactaaaaatagaaaacttagccagctgtggtggtgcacacctgtaatcccagctactcagaaggctgagacaggaaaatcgcttgaacctgggaggtggaggttgcagtgagctgagatcgcaccactgcactccagcctgggcaacagagtgagactcagtctcaaaaaaaaaaaaaaggcacgaatctcattcaagagagttccaccctcatgacctaatcaccccccaatcaaacctctggtttgtcgattgtcttttttccccactagaataaaagctcctgaaatgcaggcgcctaggccccttgcctgtatagtataccagatgcattggaaataacaaatatttattaggtgaagacatgtttgagaggcagaaatagaacctaaggaggaaattacagctgtcatatactgagtacctgctgtatatctagctttgcaccagacactttgtatcatcatctcatttaaccctcaaatccaagtaaatgttactgtttcacaaactgccctgagtcttagcagcttagtacaagaactggaatgagcttgtgattctttggattggcagtgtgggctagactctgctgggctcattcctgtgtctgccgtaaactaggtagcttttcgggggtttgtctggctatcagcagggaccatgggaacgccagggcaaggtggtgtagggctagttcacatggcggcaggtacaagccggttgtctcacctcttctcatgtcatgtttgctaatatcgcatggaccaaagcaagtcatgtggccaggattcatgtgggagattatttccagagggtatggatagaggcaaagggacgattgatagctattttgtaatctaccaaaggcattattatccccaaaatacatatgtgcaaattgaagctcaaagagctgtcacttgcccaggaatactgacatagctcagaggacaaatccaggcctgtctgaccccaaaacctacagttgcaagctgtgtgatatgctacacagcctgcctcatgggcagtgcaccagattagaatggtccgccttggtgggtgtgagttccccatcccagcagacactgagtgatcactgcctgggctgcttagtcccactgagactctagaattccttccagccctggtcttctgggtttctgacctggccgtctccctacctgttcctttatgactacagagactgcgtgaggcttccagctttaatgggactctctggaatagcccccacctgtttttagatctgccagacatttctgagcctttgcccacccctccctagatgaagcagtggtgggctcgatggggtagtgggaaccaacatgggacagagacaggccttctgggtttagggtcagctcttccatggactcatccagcaaaagaaagcctggccacagagcttggcatcagcaagaactgcacggggacgacccttagggaacacatgaggggagagaacctaggaggtagaggttgcagtgagccgagatcgcaccactgcctccagcctgggcaacagagtgagactctgtctcaaaaaaaaaaaagaaaagaaaaagggcaccaatctcattcatgagagttccaccttcatgacctgatcacctccctaatcaaactctggtttgttgattgtcttttttccccactagaataaaagctcctgaaatgccggtgcccaggccccttatctgtatagtatatccgatgcattggaaataacaaatatgtattaggtgaagacatgtttgagaggcagaaatagaacctgaggagagggccgaggggattgtggaactttgagacagataccaagagggactgaggaggggaaagagtggggaggcattgacaccgggagaagaacacgctcttacttggggaaacagacaatgaagcaaagatatttgggaacattgttctcagcctaaccccaatccatagtaaataatgacctggatccgggctttggggtgaggtagacccgaatgtgaatctatgtccttcactttgtaactgcgtgacttgaaagaagttatttcacccccttaagcttccttgcctgtaagagggtggtgacaatctcaatattatagttactatgaggattaaatatgatagccacagtgtggcaaagacatgacaagcagcaggtaaagggggagatggatgagatcatgatcacactttaaatattaccatcattattagaaacctcagtttgtcacagttgttcaggtcctggcagaaaagttggttctaagggactaaagattggagagattggggctggagggcatagaaacagcagtgcgttgtgtcaccattctgtctcgcttgtggaggttccacagaacaacatccagctgtgttatctgtaaagctcaacttatttttcatgtgcacagcaccttctgagaaccttgagtattttttctctattctttttttttttttttttgagacagattctcactctggagtgcaatggtgcgatctcagctcactgcaacctccaccccctgggttcaagcgattcttctgtgtcagcctcacaagtagctgggactacaggcgttcactaccacgcctggctaatatttttgtatttttagtagagatggggtttcaccatgtcagtcaggctggtcttgaattcctgacctcgatgatctgcccgccttggcctcccaaagtgctgggattacaggcatgagccaccgctcctggcctctctgttcttaccctaaactcttggctgagcttaggagagggactgtggcaggtcacggggcaggggaggggttcctttcttggaaaactgagacacagaggcaaaaaccaagccagtgagagaatcctgagaagtggtcctctcttcatgcccagccaaacctccctccttccgcccacttccttcagcaggtctcatgtctacatgctagaaattattcttgcgttttgctctccaattctcagaggagttgtacaaatggccctctcatgaagcgcagagtcccccacatttgcagaaggtaaaacaggtgcaggaggcataattcaaaattccagatcagagcccaggagagggcaggcccccacagcagaagtctagtacaaagttcagtgcaattaggcgtcatggagaatgcatgcctttttaagaaatggctctggtcggccaggcgcggtggctcacgcctgtaagcccagcactttgggaggccgaggtgggcggatcacgaggtcaggagatcgagaccatgctggctaagatggtgaaaccccgtctgtactaaaaaatacaaagaagaaaattagccgggcgtggtagcgggcggctgtaatcccagctactcgggaggctgaggcaggagaatggcgtgaacccgggaggcggagcttgcagtgagctgagatcacgccactgcaccatcctgggcaacagagcaagactccgcctcaaaaaaaaaaaaaagaaaaagaaaaagaaatgtttctggtcaatttggttagcaagcattataatggatgagaaatggagagcattttgcactggtgaatatcttaatcctccctattgaacgaggaagcaaatctgggcagtgccacttaacagaattactgagagaaaactctggaagtcatcaaaaaggccattgaaacaagataggtgtgcccatttccttttgtttagaagcatggaaatgcatggaatcgatttcctggtaatcgtccgaataaagtgggcattctgaccaggagactgctgattacgtacctcttgctgggtaaggaaaaacaattcaagtaggcttttgctgtttcttagccatagattttatgtaccagacgcttctaacgcctttgaaagaaaatatctttatagatttatcttcagacgtctttgcagaaccctctctgttgcaaaccctccacacacaccttttttttttttttttttaattttttccctgggctctatttttccccctctccctggctcagcatctctgaggtagccttgcacagttgcctggcgccctggggtagtaggggctctgaagacgagtgatgcagacagcatcaccccaggtagacttttgtttccaacattcacatatttttctattcccttttttagtgttatttttttctccctgactccaaggtcccatcagggtacctgtctacacatgtctggcctctaagtgtaagaggccaagctgattgaacatacggcacgtccgttcctccatcaggaaaatggggagaatgacagctagtgctcaaggttattgagagaattctgggaagctcctggcacactgcagcacatctgtaattatagttgttgtagctcttgtgtttactgtttattttaccgttccttgtaacttagcagcctctaagtttgtgtaagtcctctctggctggtcactgccttaggagatcagcagagcttttttatacctttgtggagagagaagtgtaggactttggggctggaaggggatcttcaaatcatttaatatactcaccacctggctttgaaacgaggagtccaaggcttatagtgggatacaacttcatatcacatgttcagttggaagcagggaaagatgagaaccagcaaggtaagtgttttgatgcctgttttataggtaaaggaactgagtgagtcaacgttgaaagcagggatttgatccacagctggttgatcaagtgtcactggaggcagagccccacaacaggcccggcggatgatgcatggatggcccaggtcccgcggctcaccctccctgtctcttccaggctccagatgctggaggccatctgcaagcactgggaggggcccatcagcctggccctctacctgtcagacgccgaggcccagcagttcctccgctacgcacagggctctgaggtgcttatgagccgccacaacgtgggctaccacatcgtgtacaaggagggccagttctaccccgtgaacctgctgcgcaacgtggccatgaagcacatcagcactccctacatgttcctgtctgacattgacttcctgcccatgtatgggctctatgagtacctcaggtaaggacctgcaggggcctggccatcaggccagaaggcacatagggccatgcagtgccaggaccaaaaggcccttagggtcatcatctagtccaacaggtttcttttccagatggggcagcagagacccagaaaggggaagggacctgcccacagccacccagcaatagagttctcagtgaacagactgaaacctgagtttgcagaaggaaatgttgatggcagagcttggtccagcgaacatctctttttgtctgccagtctattgctttttctgtagcatctatgaaaacataccctcctcaggcaggcacgcgatggctctcgcctgtaatcctagcactttgggaggctgaggcaggtggatcacgaggtcaggagttcgagaccatcctggccaacatggtgaaaccccccccctactaaaaataccaaaaaaattagctgggcttggtggcatgtgcccgtaatcccagctacttgggaagctgaggcaggagaatctcttgaaccagggagtcggaggttgcagtgagccgagattgctccactgcactccagcctggtgacagagcaagactccttctcaaaaaataataataataaatagaagaaaacataccctccttcttctggttttggaccagacaaccttcatataacccaagaaagattattgcccagtcttttaaacaaatctaagtgatgatgatgcctagtgcttatggaagtgtttgctgcgcgccaggcactgttctgagtgcttgagaggtaggatctcatttcctcccccaaagtccctgccgtgggtagtattatcaccttccttttctaaatggggaactgtgggaccgagaccaggagccgttggcccggggttactcatctaggaaagggaaactggggtggaaacagccagtctggctgcagagccaagtgcataagcaccatgacaactgcttctgtgaatctccagtgtccctttccagctccccccacatcatgggacggggtgtcagcagctggagaaagcactcggctaatggaaggcttagatggctgtgtgaagagtgcatttattacagaatagtacacaattcggattgataggagccatggaagtcatatggcccaaaggtcccatttcacacatgagaaaactaaagtcacacagtatcatggtccaatgacattttaaaaaaatcctttatttactgccattggtcagcatgaattatgccaatacctagtgagtgcctgcctagatccaggtaccatgagaggtgatttgcatatatcatcccattggttctacacatcgaaccccagaggcaggtatagctacctgcattctacaggaaggaagagtggggcccagagaagcaaaataacagtccaagtccagagagctcacgccagggtgtgaaccagcgtctgcagccccaggtctgcccgtcaccctgctacacgttgttgggctgcgctggggtttctgtttgtcgcaaaccaggcaaggtctgatttctttctctctcgttctcttgctctccctccctccttctgactccgtctctctgtctcttagtatctttctcttactgcctctgtctctttctctctgaaaagagcttctaggagtctttaaactttctgtcgggaagccaaagcgtaggtttagcctgcataccctccgtgccctgcgctgtctggagcaaggtcaggcagcctgtgttctctctccagcttctgagtccgtgtccttccagggacatctccgggtttcctagtgttaatccctcccctggggcgggaggagtccctaccagactctgttaaaaacagtagggtcagcgacccctaggcagcatgaccctgaatcgggaatgggaggtgctgtggtacccagcaccatgagcctcaacccctgacccaccaggctgcagaaatggagcactccctccagccccagcgcctgtgccagtgcctgctgggtcttagaatccagtgtgtggagccagggtgcccccatgtggccagacggggcttgcagcctctgatgcctgcagattctgaaacttgggcagcttccgggatgacaggctcccaagggaacagatagatgatgggagtgagtgccaccctagactaagaaaagaggcttcaggattggacccctgcccaccctccacccctctgggactcttcttcgctccagccaattgaaagtgagctggccccgtatgagtctgtggtctctactccctgtgcaaggactatttaattatttgacctcatgggcatcatgttttaaaaagcaatacgtatgaacagtttttttttctttgtctttctatgttttattaattaaaggcatcgttcactgctaatccagaccctacttgaagtgaggtagctagtgtgcccttctacttagcacttgcttaatgcagagtcacttgaggtggtagttggccttagctaccttatcacaggaaggtatgtggttcccctcaggggttttgaaatattgcaaattgcttttaaaactttattactttcttcccagacttttcccaagaatgctgagtacaattcaatagagagaccagagccctggtctcagggagccagtcgtctctccacacaatcgtgccattattgctttatggacgcagggaaggttactaggtattcatatttttcaagaggagttgggaatctggattttcatataaaatgtttttttaatgttggcaactaatttttaaaaattgtttttagatgatgatttggagcaaaaaaatcatttcaaatgctgttgaggccgacaaaatatgccttcaggctgccttgactcctcacacccccaccccaaactaccagagtgtaacctctgacctagacaattcctaggcaccaaagtatttatgagaatcaatgaggaatgtcattctctcggaagccccaaataagcagacactgttcttttcatatgacataatcatatcaacttacccttggcttcagggacattttttctggtgagtagatggattcatttctgacccagacgttaccagtggatgccccttgtgcacaccatagcatcactggtgggagttgaggttaagggtgctgtttgctgtggcagctgaggactccaatgaagcccccagacccttctagaaactgactttctcagcactgatctcccataaaattctgtacccaagctctgtcaagatattaatattggccaggtgcagtggctaacacctgtcacccagcattttaggaggctgaggtgggagaattgcttgaacccaggaattcgagaccagcctgagcaatatagtgagaccccatctctacaaaaaatttcaaaaattggccaggcgcggtggctcacgcgtgtaatcccagcactttgggaggccgaggccggtgaatcacgaggtcagaagatcgagaccatcctggccaacatggtgaaaccccatctctactgaaataccataaattagctgggcatggtggtgcatgcctgtagtcccagctactagggaggctgaggcaggggaatcgcttgaaccccggaaggcagaggttgcagtgagctgacatcgcaccactgcactccagcctggcaacagagtgagactccatctccaaaaaaaagaaaaaaaattgctgagcattgtggaacatgcctgttgtttcagcgacttgggaggttgagacaggatgatctcctgagcccaggcagctgaagctagagtgagccatgattgtgccactgcactccatcctgaacagcagggcaacaccctatctcaaaaaaacacatttgttaattacttaagaatgatgacagttacaagttactgagcccttaccatgtgccagaaaccctgccagctgcactcagtctgtcattacctctgttcttcacactgctctttaaggtaactaccattacaggtgaccaaactgaggccccagagaagttaaatgttagcattagaggaggaggaaagcagccttcctccatgccagcctgctcactctgtcgaaggggccaggttactcccaaacccccagggtaccagagcaggccgactggcagccctcggcttgtacccccaaacactgatttatatcaccttttttggggttctatttggttaccaaaaaaagttcagcatgttagctctttgagcagttgcttagcaaccagctaatattacagccaaaacaaacagatcaattggaaaataatggaataagctgtacgcatggacaatagctgcagagttttactaaaatctccttccagccccttcatctactttttctgaagaatgagctcctggatgtacagctttcacttttgatctcagaaatgtcaggcgaaagtcagcggggcatggcagaggttgcgcagacttgcctttgaagccaggttccacaacactaatcaagtgtgtgagttggggctgcttgcttcatctcctcattctttcacttcctcagttaatataggagctaatgatagcctcctgtggggctatggcgggtgcccagcaggagttcattttctgccccttggcctattcagtattggacttctgtgctaggcccctgccccaacccaacccccgccattgcaaactctgccaccttctgtgcagcctgggtagcttcatgtgaccatctcaatttttttgctttctgaaaatgagaaactatatattgatactactcattctttcaaaaactgtgtagtgagcatgtactatgtgtcaggcagtatgctacattgtaggtgatgttgctgtccctgggggtcattcagacctgcgtttcagtgcagaggactctccctcccctttcccttccctcttttcccctcccctccactcctttccttcccttcctttctttctctctctctttctttctttttctctcttttctcattttctctctttaattcatttctttccatactgcttcctctctctctctcactctgttgctcaggctggagtggaatggtgcaatcatggctcaccgcaacctcaacctccccaggctcaagcgatgctcccactttagtctccccagtagctgggattataggcatgcgccaccatgctgggccaattttttttttaccatttgtaaagacagggtttcgctatgttgcccaggctggtcttgaactcctagtctcaagtgatccgcccacccaggcctcccaaagtgctgggattacaggcaagagccactgcttcccgcgtctctctctctctctttccttttttctttctttccatctttcctttttcttttcttttttcttttctttcttctttctttcctttacttctctttagacacagggtcttgctctgtcacccaggctggagtgcagtggtgcaatcatagcttactgcagcctcaaactcctgggctcaagcaatcttcctgcctcagcctcccaagtagctgggactacagttgtacaccaccttgcccagctaattttttaatttccttttagaaaaataaacataacccagaccctattgtccaggctagtctcaaactcctgggctcaagcagtgctcctgcctcagcctcccacaaccctaggattacaggcgtgagccaccatggctgactgatgctgagtactctttatttagaatttatttgaccttgggaaaggcacttaacttctctaacttgttttatctgtgaagtgggaatcatactgctttttcctcttccccagttcttaaggaactgagaagataagagctaacagtatttgcagagcacccaggaatgcccgaaacattctttgttccatgcctctgcgtggccaggcactgtttcaggtgctggggctagaacagtgaacaggggagacaaagttctggccctcaggtttacagcctggtggtcattgcagctgtatgtgccattgctagcatcgggattcacacagatacgaggctgagagatacaggagctcaaactaataagggaatgacccaatgtgggtgcacactgaaggtctctaaatgaggagagaggaagacgtgagacatcgtggcatttccaagacctggacagcttcactctgctgagactttccacattcatgagactggtacaggtttctgacacctttcactgaccctgcagaatcatcatctttttttttttttttttttttttgagatgatgtctcgcccttgtccccaggctggagtgcaatggcgtgatctcagctcactgcaacctctgcctcccgggttcaagcgattctcctgcctcagcctcctgagtagctaggattacaggcgcctgccaccacgcctcgctaatttttgtatttttagtagagacagggtttcaccatgttggccaggctggtcttgaactcctgacctcaggtgatccgcccacctcggcctcccaaagtgctgggattataggcgtgaggaatcctcatctttaatccatgcccaaagtgtaaagtatctctactgtcctcactgccttttgccttcttggggacaaacccttcttttttttttttttttttgagacggagtcttatgccgcccaggctggagtgcagtggcacgatcttggctcactgcaacctctgcccctcaggttcaagcaattgtcctgcctcagcctcccaagtagctgggattataggcacatgccaccacacctggctaattttttttgtatttttcagtagagacggagttttgccgtgttggccaggctggtctcagactcctgacctcaggtgatctgcccatctctgcctctcaaagtgctgggattacaggtgtgaaccactgcgcccagcccccttcttgaggacaaataggccacactgggtagagactgtattctgacactgtgtaggaatgccagatttctgttcgactcttttctccccagcttgacatctaaccacctacccccttacattttccctggcacatcatggctgttctataaatacttgttgaatgagtgcagacatgtgaacaaagccaggtagaggtggcaccaggtgaagctgactggctgcctgcccagagacattaccaggtaacatttccttgggcccattcattgtcttaactctgctgtatctataacattcaacatttactgagcacttactatgcgccaagcactgttatgagccctttcacctgtattttaccattaaggctcaccacaattcatcttacaaatgaggacgttcaggctaagtaacatgcccaagggcacagcagtactaaaaggataactggcgggctgggcgcagtggcttatacctgtagtcccagcactttgggaggccgaggtgggcagatcacctgaggttgggagttcaagaccagcctgaccaacatggagaaaccccgtctcaactaaaaatacaaaaattagttggacgtggtggtgcatgcctgtaatcccagctactcaggaggctgaggcaggaaaatcgcttgaacctcggaggcagacattgcggtgagatgagatcgcgccattgcactccagcctgggcaacaagagagaaactccatctcaaaaaaaaaaaaaaaagaaaagaaaaaagaaaaaggataactggctcatcttaggcttatccataggtgttctatgcttagcctgtttattgatccagttgcccgataggcccattttatcttcatcgtgatggccatgaccatcatcatggcttgtatttgccaaatgtatcctatacaccagggaactattttaatctttgcaccagataatccatgtagttcttacaaagtcacacagcacagctgctaatacagtccccagctcacagagaagaaaactgtggcacaaagttgtaacgtgttcaagagtatgagctggtgagtgtccatgcaagtgggatctgaatccaggcagtctgccgcacagctgccctccttagtgccaggcccccgtgatccccagccagcgtttaactctatgccagtacgtggcaagtgctctacaacgtttagctattattactaacagtaaacatcaggacagtggggtaattaaacaggaatgttgagcattacctgagatggtggagacagagtctctagcacagagcctcgcacatggtcaagtgctcagtaaactatggcaatcattactactttttatttgtaaaatttaccccaaaagctccttcttagcttctctttctcacctgcccctctctgactgacaggttcttcctctggaaatgttaatgccacccattaaggaatcaccggatcttgctcatgcctgtgagcccatctggctctcagatgacatgcccatgtctgacctcatgtattatgtgtgtattctacagtggcactctgtgggctgccctgtctccctcatttgcaagtccttgctgttgtccccacaaagctcctggaagccagtcagccaagagctcatttcctagacaactggagtagaatcgagcaaaccctattccctggcctttatgtttagggatgagacaagaggaggacagggctgtgctgaggtggcctccagagtgagcagcacaggtggctccttccttcctctctgcccacgtattgtcaccctaaggtagattgctaaatcctcaggtgtcattcacatgatttcccattgccttggtcaaaagccatgcttacgtctagcactattgaagctagtcagtttaaacagctatgagggacagctggagacaagagggcttctcgtagtctcccaaagtcacataggcacccacacgcatgtacacacacatgtgtgcccttctttgcctctcactggttgatcacacctgtgtctgcactggccctgctgcttctcatcacacatcactagctcactggttcatgcccacacaccttgccaggaataagctaaaataagaaaatgatggtgcatctcagacccaggcctctgctttctctttaacccccactggctgatccacttcttacgagcatccacgagaatatgagtgcatgaccgtctgtaaaggacccaggaaggaaaaaacactgtttataagtgccctgtctcgtggcaggtgctgtgctaggccctgggcaaatgttatcttttttaggacaacctagtcaaagataagtgcttttattcccattatacaagtgagattaaaacacagaagttaagtttgcccaaaggtcatatgtatttaagtggcagagctatcgtgtcaactcaggtctttgtcatttccaaagaggcctcttcacagtcccatcctctctaccgcatagggcagttacaaatagattcctccattccctatacacttactgagtgcctaccgtttgcctggcactgtgcaggacctggaaacgtaaccatgaacagaggctcaccccagacctcaagcccagcagggctgagaggtacatgcacaggcagccaccaccagtgagcgaaacagtctaggatgaaccagtcccaaagaagatgcagacccaacatgaaggggagcatgaaaggagacacatcaaggcccatggaggtggggaagggaggtacggggaggccggtttttctaactggctatgcactaaatcttgagagaaatcagtgctgttccagggtttctgaaacagatgcacactccagcacaggtttctttatctcctcctgtccccttttaatataactttcataggagtccctgggaacttgtatgagaaccacatggatttcttacgactcaggtttgattaaacagtgggctctctgacatttgatgctgcagaacagggctgtggaaacccagggctccgagagctgacaagtctggttctctcccagcattctgacagcagccccagtgccttcagccctgcgattcccaatagtttgtcacttgtcagcattggcctcagccatttattgcaacaccgcaaagaagtcagcacgggcatttctgttacaggcgtggaaacctgagtggcagagatggggaattccccaacccctgcccgaggagtaggggccacaagaggtcccaaatggttaccagcatccagtgggctgaaagtcagtcatcctggtgagaaaagagagagtagaaagatgccttcagaattatgggatgggcttcttgaaataaggctagtaggagtggtcattagtgctaaatgcagagataattcaaacaaggtgagaatggataaatctgttagacttgacagtgaggggacattgctgactttggccagatccacagagtcaaagacagattataatagtttgagagactcatgggtggtaatgaaaggaaatagccagtataggaggctcagtataagccagtgacatgtaggatcagtacacatgttcccaatctcataatactctttgttttctgacctccgctccactttgctcattcaaggtggaatctgccatgtggatgagattgcatttaaggagcataggtacacagatcgtagcctcctgccttctccctttttgccattcctaaccactctcccactactgccttgacccatgaactcaaagaagttcatttttccagttgcaaggttgggaagacagacacaatcactgcattaacagacttggtcccaatacatcttgtggttattgatctttcctgcttaattttaagctggtgcagacttcattaatatcattatatgatgatgatgataactactagctgtgtggtagttacttgttaacctctcagaactttaatatctttatcattaaactgaaaatatgagtatgtaagtcataggttgcaataattaagagaagtaatgcatataaagcacttagcatggggcttgaaactcaatgcatgtaagcatttattataatttatcaaccacctacagtataccaggcaggtgctgagaaattcagtttctccaatcctatatgctttctcgttatcagagctttgcaaataacctggaacaccctttcctgactggctaactcctgcttcttgattggaacacatctcagtgatgagaagtcttccatgactctgcacacagagaggagtatgcttctgtcttcctccctccctacactgtgagctatgcatggacaaagttatatgtgttcatttagctctgtgcccaaggtttaggtgttggcttcattaatattcattaattgatgaatatattatcttagttctcttaatcaccaagtccataaagcatttattattatcaagataaggaaacaaaagcccggggtgttaagaaaatggcccatgattgcacagttagggaagtagtggaattaagatggaatctacatcatccgattaaaaagatcatgctctttttttctcactgttcagcctcccttcaaactggcatgccacgagaggtacccagccatcaggtgtgctgaagataatttcagttggctcctcttgaaatatcagactctgtggctccaatcccatatgtcaggcacacagctggaattgaggagcagctaggcgtggactctcctgtttatcccatcccctgctctcccctctcccttttgtctcctcgacatgtaagcctggcatcctttgccattgaacatcgtgctctctccccatcagcctgcaccattatccacatcactggcctggccctgcagctgcttgaggttgccccccaaaccccccagtatagaaagacacaaaaaagagatacttccagaatcctttgtccctgtttaaatttgactgtgctctctccttttcttaacctcagtgatggattatttttctaattttgttttcttgaagatggcatcaaattgggtttgtaatatgtcctagttcgttttgtggtgctataacagaatactggagactgggtaattttttagaaatgtattccccatggttctagaggcttggaagtcagaacaaacttggtggcagattcgttgtctgggagggctgctctctgctgccaagatggttctttgtgggttttgtttgtttgtgtttgtttttgttttgagacagagtctcactctgtcacccagactggagtacagtggcacgatctcggctcattgcaacctccgcctccctggttcaagcgattctcctgcatcagcctcctgcgtagctgagattataggtgtgtgccaccatgcctggctaattttttgtatttttaatagagacggggtttcactatgttggccaagctggtgtctaacccctgaccttaggttatcccccaacctcggcctcccaaagtgctgggattataggtgtgagccaccacgcccggccccaagatggttctttgaacactgcatcctgcagaggggaggaacgccatgttctcacgtggaagaaggtggaaaggcaaaaaaaatgggaccaaactctctcttgtcaagcttttttttttttaatcattatgtattaaatgtattgatgtaatacattatgtatgtattgatgtaatacattatgtattaaatgtattaatgtaatgaatacattatgcattaatgtattcatgagggtggggccctcatgacctaaacacctcccataaggccccacctctgctgctgcattgggaattaagcttccaacacatgaatgttgggggacaccatagcacaatacctaagcacgcaccagtgagagaggaggaagttatttcagggaatgctgaatagaggagaatgcataagggtagacagacaggatttagggagttcttcctttggtggaaactggcaagtaactggaatcccattttcaggcaaatcgtgaccattgtgggactccaggatgggtctgattggaccacaagggtctcttctcccgggtcttcactcactgtgaaggagttaggtgttggtcgtagagttttccttatatcctctcctgtggaccaacataggttaatttttctagacacttaagatgaaactaaattggccagcgttgtgacatggatccttttcctgattagcaatccagccttgcactgtgttgacttatttttgcagaaccagaggtgaggaagggaacttctttttttttttttgagatggagtctcgctctgttgcccaggctggagtgcagtggtgcaatctcagctcactgcaccctctgcctcccaggttcaaacgattctcctgcctcagcctcctcagtagctgggattatagacacgcaccaccacacccagctaatttttgtatttttagtagagacagggtttcaccatgttggtcaggctggtctcgaactcctgacctcaggtgatccacccgcctcagcctcccaaagtgctgggattacaggcgtgagccaccgcgcctagctgggaagggaacttctaaatggccatggccctcacacccacctacttgactggtgccctagatgctagcagtcagggaagatgccaccagcgacctccatgttgccaaacccagctgccagcccccagctctcatctcatttgacttctcagccacctccaactgccggtgactcctccatggcacacgttttattttctcctggcttttaggtgctcatcgcagtctctttgtggttcttcaatcttcttggtccctcccaggagttcccattgctggctcctcttctcgttctacctgactcccattttatagatattccatgttacagatacggaaattgcagaaccaagagattaattaagtagttagccaggatgcagacccgagcagcctgcctctagaatgtgaaccactgtgactccgaggaggtgaagttgtcagaactaggcagtgcacggcgtttccttatgtcttccgagacactttcccgtaatctcttcatgccaggaacctgggctgtttccctggttacagggacctgcctctagaggaaaggatggagttaaaaagagagaatgagatggagggagggaggtgtgtatgtatgtgaaagagatcaacagccagggtcaggttgaggattggtaattccatgccaccgtagcaccagggaaacccatccagctaatactctgcccttccatccatgctgtttctttggtttatgcagaacccgggcaagcctaccatctgcacccacccctaccccttcatttggcataggaagcctcactgctcactcacactcacatcccctcccctgctcgccagttttgccagattggagcaaaagaggatacgaactacccatatacctgagtgagctgagaggaggggctcggggaaaaaagatatacagaagaggaggctgtggggggctttggaggataacctttatcaaattcacagtttccccactggttagctctgccacgctggaaaaggtgaatttactctgtgagcaacacctgaattgtttttgttacaaagagggactcagagggctggctagagaccgagatctcataagttctgtttctgtagatgagcaagcagaagtcttccctggttgtaagtagtatgttgacttctctgaatcctccttcactctcgcccattctcttgccttggatgcaccagtaggctcagctgtgacaggggaaggggacttgtttgttaatgagttaattctaagtcaggcactgctttgggctctagagccctgagagatgagagataagcctttattatctccatttaagatggggaacctgtggttgggagaggttgcagaatgggcctgaagtcaggagagagaggagcagtcaggtttggaagctgctgctgtctggctccaagtcacttatgttcacagggcttcccattgtatcagcaaggttctgagttatttatattgttttaagaactccttggtccagctgggcgcggtggctcatgcctgtaattccagcactttgggaggctgaggcaggcagatcacgaggtcaggagatcgagaccatcctggctaacacggtgaaaacctgtctctagtaaaaatacaaaaaattagctgggtgtggtggcgggcacctgtagtcccagctacttgggaggctgaggcaggagaatggcgtgaacccgggaggcggagcttgcagtgagccgagatcgcaccaccgcactccagcctgggcaacagagcgagactctgtctaaaataataataataataataataataattccttgatccaatatactatagtaggtttgtgaatgttcttgcaagtgtcttggacaagacaagggcaacaaaactttgaacctgtgcataggcagggactggagctggtctgcaaagaggagtcagaccataaggaagagactgtgtcagctcaggcccatgtaggggacaagaacagagtggcagtccaagaaggacatcaatagagcttggtatcattgaatgatgaggaggaatctggaccaggtcggaattaggacactttttattttaggtaaggtacctggtattaatttctgttgcttgcagctaaacaaccctaagcaatatattacaagacccacagtagacagactcagtaagcagcatgtcttaccagcacagtcctcaggggtctccagagacacagagccaataggagatgtatatagtatatcctatagatagtaatatatgtatcaatatgcagagctagatagtgatatgtgtactgatagattgacagagcttaagggattggctcacactgttgtggggttggcaagtctgaaattgacagagcaggccagcaggctggaaactgaggcaggatttctgtgttactgtcctaaggcagtattccgtcttctctgggaaactcagtttttgttcttaaggccttcaactgattagatgaggcccacccacattatcaagggaaatctcctttccttaaaggtaactgattgtacatgttagctattaggttggtgcaaaagtaattgcagtttaacacgtctatgaaacacttgcacagcagtgtctggactagtatgtgacccagtaactgggcgccatagcctgggccatctgatacagaaagggaaccatcataggcatcatgtaccccgtgcttaatgtgtgccaggccttgtagcaagcccttccacaagcactgtgcttatcctcatcaacatatttttcaagtgcatcaaccccaggactcaaaatagtgaaagtgacttgcccaagaagacagcctagtagagtcagagctagacgccttgtctaatgaccactacacctgactgtcctccaaagcttccatcttaataatctacatttagcaatctaaagagtaatagagtaacccaaagtcactcagcttctcagggtgggcctagaactgaagtctcctggctgttcgcccagctttctcactcatcgtcctgccccactgttcctggaagactctgcattctatcctctgcaggactcactttccagagaactaatggctgcaaattgttgacccctaagacagcaagccccatccagggtaagatgtactaacagaacacagaacagaaagacccaggctgctgttaccttctcaataaacagatgagctcagagtttgtaccatgaagccttgtttattgctgaaacaacttcataatgagaccctttcaggacatcggtattgaaacctacttgaactgactctgaaatagatctatctggtgacagatccatctttgtggcagtttgtattttagtgagatgaaagggagtttgcagaaagcactctggaatctggtgctatctatgcagagggaaataaggcttgctaggactgtaattgtgaggcatgctgcttgctgagtctgtctgctttgggtcttccagtatattggttagggttgtttagttgcaggcaacagaaactaataccaggtagcttaagtaaaatacaaacaaatcaaagaaaaacaaagcaaataatggatgggttatcttatagaatcaaactaggacttggaaaaccaacacataagacagcaattaaccagggcagctctgggcccctctgcagcagttcagaagtctttagagcatggtctgtcatcactgaaagtcaattctgtgctttcccagtctctatttctattcaaatttccaagagtaagaaactgatgtgctcagcctgggtcaagtgtctaatcctaaacaacctgcccttgccaggggtgcaggtagggcaggcagagagctctgagagcttgcttctatgtataggggcaggttgcccccatagaaaggggaattattttctagcaggaattaatctctaagaagcagctcctatagcaactgatgataatagtaacttgatccttatatagatacaaacatccatgtttgtagatctctgtatccatcgtgtatatatgtgtatgtgtctttatatcttgcccattccctttatagttctgccctcgcagccttctattctgtttctatagcattgtattctaaaataatcagctacaaatgcaatctggggccccagtttagagagatttgtccttaggcttctagcatctcgagacgtttatatgaatgtaagcaccatgcgggcagagactttgcttgttcttttcaccctgtatcttcaagtgcctggcacatcataggtgctgggtgattgctgaatgggtagcaaccacccaccaatactgggacaccttcccccctgccccagggattccaagggctttgctgtcttggtccaagtatattctttagatccatatatcccacccccaatacccagaatcaatagataaggtacccacctctccagggggaaaggtaaatagcctagctctgcccctatccaatagaggattgatacaaaagagagtgctagctgacactagatgcctggccacagaggagggaatcttggatgtttgaaaactaacattgttcagacagacaaagcgggagaagaatccaggctgggacaggctgactcaaacctctggtcctcagactggctaagtagagctcgtccacactctgtatcttgctgtcgtcctttacgaacctcctctggaatagtggtgagagagctatatattatttggtatatagttaacatgagcactatggtaaagagtgaactgcaaatgatattcagagggttccaaaatgaacttccagcccatcccaaccaccccctctctactgggagctggtgagatccattaaccacggatggttttaggaaactgtccttattctgacctgatccaggttccccctcattattcaatgatacgaagccctgctgatgtcctgtgtccttctgggactgccaccctgttttgtcccattcaggcctgggctaacttagtcacttccttatggtatgattcctctttgcacgccagctctagtccctgctaatgcacaggctcaacgtctggttgagtgaagtgactttaataatacagcaatggaggacaaggtttttttgtttgtttgtttgtttgttttgtgacagggtctcgctctgtcgcccagggtggaacacagtggcgtgatctcagctcactgcaacctccacctcccaggttcaagcgattctcctgcctcagcctcctgaatagctgggactaccagcaccccccaccacgcccggctaatttttgtatttttagtagagacagggtttcaccatattggccaggctggtctcaaactcctgaccttgtgatccgcctgcctaagcctcccgaagggctgggattacaggcgtgagccaccatgcctggccttcaatggacagttgtatggccaaggagggctgctgctttcagtggtttttcaaaatgccttacaatgcctaccttttccccaggaaaggctgctttctgtatctcagagatggaaacagacagccatgatgaccctgagacccaaaggtcagtgtccaagcaggagccagaatgaattcctaggtcctggccaagagtgatcacagaatatccaagccagggagtcgtgatagcactgcagtgtaatagtgaccacttgtcccagcatgcctgccccggccaggtgtgccaagtggcagtatatgacgaccttgttcggtccacaggaggtagatgttattgccatcattttagggacgagggaccaaaggtagtgaggagctaaatcgctttcccaggatggcaggtctcataaagtgaccttgccagggttcaaatccagtctgtgtttattaaaagcctcatgctggccgggcgcagtggtgcacacctgtaatcccagcactttgggaggccaaggcgggcggatcacaaggtcaagagatcaagaccatcctgccaacacggtgaaacccagtctctactaaaaatacaaaaattagatggacgtggcagcatgtgcctgtagtcccagctactcgggagactgagacaggagaatcgcttgaacccgggaggctgaggttgccgtgagccaagattgcaccactgcactccagcctgggcaacagagcaagactccatctccaaaaaaaaaaagcctcatgccatatggcactaaatgcttggccgtggatggctctccatgagcctttctccctttccaagtaaccaccacagagctgagaaaaggcagacaaacccaggcgtgcaggatcgggtctcggaggagcagagtggaaggccaggcactaaggcaagactttaactttctcttagggagataccagagctctgtctcaccagcactggctgcctagggtggctgtggctgctttaaaggcttggagtctggagaattcaaggagttgaggagtcactgaaatggaacctgaaagtgcccagtttggtgattctctcatcggctctctgtccacctgctctggtgcggccaggggtgcagtcggagtgattgaccagcccagggaaccaagcaggctgggctgtaacccctgtgatcctttgaagccttccttctgtgcctggctggcaggagcacacactgaaaacatgtgggaggttctcccagcccctcagtctggtctgccctctgtttattctccaggaagaccaagttctctgtctcggggacagcagatcccattccactctgggttccccaagtgtttagcaacttgctttgcctcccagggctccccatctttcttcttttcttttccttttctttctttccttctttctctttcttttccttcttttttctttctttactttttctttcttttccttcttttttctttctttactttttctttcttttcttttctttcctttcttttctcttcctttctttctttctttctctttcttccccccaccttttttttgacagaatctatctctgtcacccaggctggagtgcaatggcgtaatctcagctcattgcaacctctgcctcccgggctccagcaattgtcatgcctcagtcccccaagtagctgggactacaggtgtgtgccaccatgccccaccaatttgtttgtatttttagtggaaacggggtttcaccttgttggccaggctggtctcaaactcctgaactcaagtgatcctcctgcctcggcctctcaaaggctgggattacagacgtgagccatcgcacctggcccagtttccccatctttaattgagaggatgacctgagctttctttcccacacttccccgggccaatgaccaccccgccctcatgggggaaagaccttggcctggtgtcacagggactctgtctctctgcctgtcccctcttttcaggaagtctgtcatccagctcgatcttgccaacaccaagaaagcaatgattgtccccgcgttcgagacactgcgctaccggctgtccttccccaagtcaaaagcggagttgctgtcaatgctggacatggggaccctcttcacattcaggtgagtggctctagctgctgtactctgggggtgctcgaaggccttctttctcctgggaaacccagatgccaaagctatcgatctggaagtttgtcgctcgccttagtccattgtgaggccaggaaagcaccgctttctccagacaacgtccttgtaatctccctcctctccccatgccggtacgtgccatgtacttttttgtgcatggatgacagacgttatgtgttcagatggaagggtaggcatgtttggagggtggaagggtaggaaggtttagcttatttctgtttgtccttttttctaaactcagtttaggttcctgctgccatctcctggctccgagttctcccttttgtgtgcttgtccattcattcgtctggtaggtgggtttcattctattagcaccactgtggcagttttcctttttatttgtggtatgagtggtctgttctttgagcccctgaggcctgggggacgtgtagccgttgtgtcaacaacttcaagtcatcaaggtgacccagcacatgtggcagccagctttcctgttgcccaagtgacagtcgcaaacagaaccctgattttccttttttcccaggcccccgagtcctgcaggaacattgcaagggagctcccctgtcacctgtccccagtgtcccaggagtctgtgccaccgcacaggagcaaacaggttccatgtcctggggacaggctgcagcattacatgtagtgatccaggggaaagtaggtggcctgctaggtgccgtaactgagcagtctaaagagagggctggtacgtctgcctgctccaggtgtttgcttgtgtttgtttgtttgtttgttttgtttgtttgtttttgagacagagcttcgcttttattgcccaggctggagtgcaatggcgtggtctcggctcactgcgacctccgcctcctgggttcaagcaattctcctgcctcagtcacctgagtagctgggattacaggcatgtgccaccatgcccggcaaattttgtattttttagtagagacggggtttctccatattggtcaggctggtctcgaactcctgacctcaggtgatccacctgccttggcctcccaaagtgctgggattacaggcctaagccactgcgcctggccctgctccagtgttaaagtgaggccacccttgtgaatgatgtcagaatggccaacacttcctggaagctaaaaagcatacgtttctagaccatcggaattttactgaaaacattatagtcttaataacttgggttttcctaccacaattaagtttctagaaatttctagcaagtttcctcaaataaactttatcttgtgaaaataactttatgaggtgggttgttcgttcaacagttcagaggctatcatttttcacattttatacagatgaagaaactgaggagtggagaggtcccagtagagccaagactcaaactccaggcttcttcctctatccagaattctggaaagtggcctggaagagttagtaaccccccacccaacccaagccttccttcttttctgaaagaaataactaccacttattgtgtgcttagcatgtgccaggcaccgtgattacatatttaattctcacaataaacctatgtgacagatactatcatccccattgcatggataatgaaactgaggctctgagaagtttaataacttgcccaatgacacacagccagtaaatagcagagcctggattcgtaccaggtctgaggaacctgtgttctcagtcagaatgccatccagctactgattgagtcctgaatttttttttttttaaccagtgtttaaagatgcagagtaaaaacttgctcctcagaattgagactttcaaaccaaaccttaatataagtctcccatgaatgccatagtctgatggctgagcacctgacacatttccaaggcatccttcctgccgtcttcataccacagtgaaccgagaactcatttcacagccacatttgtggccacaagagctggggtgtggcctgctgtgtccgtgattgctgctctggccagcagcttgccagccatcatgccaagtgctaagttacagcccttgtctccgagaaattgctattgtcacctgctctccaaataacaaactcttcagcctctgagcagccgaaatctgctccctaccacacctggaatgagaaaacatccacacccctacaagtcctctagggcggtggctccagaatgcggtccctggaccagtggcttcagcatcacttaggaacttgttagaaatgcagaggctcaagcctagcccagacctcctgcatcagaaactctggaattggaaccagtcttccagataattctaatgcatactcaagtttgagaaccactgcttaaagcaaagtgccccaaatctcttctccccagtagcatcctgtaaggtgtacctaggaaacctctctcatcttcccatcccttttttagcagggaaggaggctacctggcatttggcaataggtcattcacaggctggggcttgttttaacgagaggttcattgtaacttgactgcaccctgtgctgcccagcctttctgcaagctgccagtgtccaggctaaactgatcaaagctgcctcctcagccagatgactagaactgacccagctgtccctacaatggagtgcaatggcgccgtctcccccattgttttcccttccttttcacattataattttctgagagtttagattctaaaggtggatgaccaataacatggctgtcaatatcactgagagcaagaccaccaggaattgacatcatatctgggaagcaaacaaggagaaataataaagagaattttctctttctctttttttttttttttttttttgaggagttaccatatatcagaaactactctgagtactgtatgtgaattaagtcacataatcatcataaatctatgaagtagatattgctgtgtccgttttgccaagagaaggaaacaaaggtgccaagtagttaatgtacccatacctgttgaatgacagaattggaacccaggcaggcagcctccagaaccattgcttttaaccactttgttataaaactagcatttattgaattcctcttagatgtcaatactgcgccagactctttatattttctcacttaagctctttggcagttcaaccagataggtattcttttccccagttgacacaaaaggaaattaacggctaattaaagcattttgttctgcaaggcattcagctcctaagtggcagaggtgggatttgaaccctggcctgatggctccattgtgctttaaaacctcatacaagttcacggccatcagctgtgctgtgccagttctgttgaaggcatcaggtgttaagactgcccattcagcaagttcacaaatggaaaagcaactgcttctgggcctaattgttggatcatgcccgaaattgacatctcccgcaatatcccttttccacactccatgaaaatggcattgcttcacctttcatttttcttccatttaagtggctttggttttgatggaagttgctgtgttgatggagctgaagttcaagttcctgccctcccctagcctggctgtctcacccaacagcacaacttgatcaaagcccacccattggccagtgcccattcagctgcactggccagttccctgagggtttggggggagtccagcctcagtggtagaaaagcaaaagaaggaagcagttgcattccctgccagaaagtgtcccattggccacacggaacactcagtctcacttagcgcctcccttgctttggagagactgcccacaggatgagatggaacccagacttccacttcctctctccctgcagctatgctcttgggttcccacccttctgtcttgttttcatttcatgaagcttttctttccagctctggatactcttcctaactcttctcttgggccctgtctagtccttcactagatgcccagcttcctgccgtctctctgtagcttctagaggcatattgccatctcacacatggacctgtctcaggtgcctctcatgttgttaggttactcattcattcattcagtttagtgcacaattgttgagtactcgttcaacaggccaggaagtgtgggggacagggacatataagagaggtgacccagccggccgtggtggctcatgcctgtaatcccagcactgtgggaggccaagacgggcggatcatgaggtcaagagatggagaccatcctggccaacatggtgaaaccccgtgtctactaaaaatacaaaaattagccaggcgtggtgatgcgtgcctgtagtcctagccacttgggaggctgaggcaggagaatcgcttgaaccggggaggcagaggttgcagtgagccaagatcgtgccactgcactccagcctggagacagagcgagactccatcccaaaaaataaaaaaataaaaaaagagaggtgaagtgcttaaggaggctcctggcctttgagcaaggcttcccgggtttgaatcacaactccaccactgactacttgtactttgacatttggtaagttataagaatttaaaacaatatctgcgtgtgtgtgtgtgtgtgtgtgtgtgtgtgtgtgtgagagagagagatttaaaatagtcccagtacacagtaagtggttaactaatattagctgcttcttattgtggttatatgattgtattcatttgctactactgtataacaaattaccacaaacatagcagcttgaaacaaatttgtgatctcacagtctctagggatcagagattcaggcatggaatgactggattctctgcttgggatctcactgggctgaaatcaaggagtcagcagacctgcatttctcctcttcccagatcactggtggttagcagaatttctctcctttcgttcctaggcctaaggtcccattttcctgctggcttttggccagggactgctctcctagagtctagttaatttgccacatggcccccataggcagctcccaacatagctccttgctttcttccagacccaggtctaaagggtcacatgattcaatcatctcccattttcacacaaagtaaagtggtgagtaaccttatttatatctagaacaatcccttctgccatataatgtaccataatcccaggagtgatcacatacatactcacaggttctgcctcaaggggagagcattggacagggtgagagtcatgggggaccgtctgatactcctaccacagtctggcagcaatcactacacaagctcacctgcagtcaattcctgagaaatgacatggagccctccaggagttccttttcatagtgagaatctcctcgttagtgaaatgtgcagatagcagatgggattagggtttcctgcagctgctgcagcaaaatactacaaactggatggcttaacataatagaaatttattctctcacaattctggaggccggaagtccaagatcaagctgtcagcaggtccatgcttcttccctgaggtcctaggcctccgtctggtgattgccagcagtgtttagcaatctttgatttatagatgcacccgtcatccaatctctcccaatgtctatacatggtattcttgctgtgtgtctctgtgtctaaattttccccttcttataaggacaacaaatattggattagtgccaccccaatccactgtgatctcatgataacctcattatatctgcaaagatcctgattccaaataggtcccattcacaggtactgggggttaggacttcaacatagcttttgggagggagacagttcaactcacccgaggactacatcagtgtacaccccttcttcctccacatcggctgcatttggagagcttggcttccttccctacacccaatggcttttctccgtgtgtctcaggtaccacgtctggacgaaaggccacgcacccacaaacttcgccaagtggcggaccgccaccacgccttaccgggttgagtgggaggccgattttgagccgtatgttgttgtgagacgtgactgcccggagtacgaccggaggtttgtaggctttggctggaacaaagtggctcatatcatggagctggatgtgcaggtgagaagaacggagcatccacctggtatggtcgacgggggagaggcctagatcctagagcttaagggatccttggagacaagaaagcagagagctaagagggaacaagatatgcttgaggaccagtggtagtactgatccttgggctcttgatcccaaaccattgctccttcctcaacccttgggtgagagttgggttcttggccaggacccaggtaaatgtgagtttcctgtgacaaaccatttcatcttctcatcctcacccaacctgatgatgaagacaagcaaatgtgaccattcatcacttggtctttgagtcacgtaacagacacgaagcatccttagagttccatatacatgacaaagcatgctgctaagatgcagctagttattccaccctttactaaaagattaatagatgcatccatcattactaaaagagtggcgactttgagactgtgtttaatcacgaactccttcattcatccaactgatacgtattgagctcctacttcaaagtatgaatcttctacagaattctagtaggtgaaaccaaggatcagcacacattttctgtaaaggaccagatagtaagtgttttgagcttcatgggacctacaggtctccttttcaactacttaactctgctattgtagttcagtcttacagtctttaaacaaatgggtgtggctgtttcaataaaactttgtgtacaaaaacatgaaatggaccagacatgcttcaatttttcagcccctgtgttaaacaaacaaaagcaaaactgctctggttaaattagaagaaggattcctcggtccctccagcctttttttttttttcttttcttttcttttgtatgctcttctccaagatctctcctcctggtgcacagtgcaaatatttttcaacaagagcacctccaattcagaaaaagctaaggttggatactgagcgctggccgttcatgagaatcaccaggagaactttccttccaatagttccaatatgtttgagaacagccccaggtgattgagaggcgttagggttgagaacactgatgtagataggttatagaatcatgtccatatttaacaacagaaagcagggctgtcagtatccatattttttataatactttgaatgagcagagtgccactcacagacaacagtgttcagtcagcctcagcttctgcttaaaaggaatgtcatgttcatgtgtccagcagtgctgtgagatgaactagttcaaagaaagttaatttttctagccatgagacctgggctttgtttgttttggacagttttgacagaattcttgaaaatacgttgcatattttcttttttttctttgcgaatagcatgtcccagacatactcttaaccttttccagtaccttaaggaaataatgagtgcacacctgccaggtattaacacccacacccatggggctagtgcggttggtggggttctttgtccctccattaaatgtcccagacagttcagctctgggagatcttgcattttcttttgatggtttttctcactcattcctcaccagcaactgtcttttcttgctgctgttgtattgttctacctaaaacagccgcctttccccatcccagttatccctgagtttattcttatctgctctgagctgggaaactagataacaaaagcttgtcagacaatatgtccaaaatgagagtaaatagatctgagtaaaagtgtgctgagttctcctctaagcgatatgacctaaatctgggtcacctgttttggctattcagaggccttttatttttggcctgagtattaagctgtattctgccaagttgagaatactgggtgacagtgtgacctgcgataaagatgtgtcagggagaggtttgttcttggtgagcttaggtccagcaaaatacttgtttttatttcatctggtctctcattcctgttttgtaccctcttttgcactcatctgttgagactgtcagatcgcatcaagtcctatgaggaatcataaacagatgtcagttaatcgagcaagagaatatcccatggcgtgtgtcatcctagactgtccatgtgggtgtgagctcacatctatttatcaagaaaccttttctaggccatgagctcggctcagcactgtttatacagtattggcttctccgtcatggtcatcattcaagaatattattactttcaccttatagatgagaacatgaaggctcagagaagccagtttcctggtccaaggtcatggaaacagccctgaattaccccactccaaagctgttgtgctgtcctttgccatctgcttgtgggtgccattatcaagtcattcattcactagccattcaatcattcgcttgggccttcatcatgcatgaccctcggctcttgcgggttctcacgctgctcttgtcttcttccaggagtatgagttcattgtgctgcccaacgcctacatgatccacatgcctcatgcccccagcttcgacattaccaagttccgttccaacaagcaataccgcatctgtctcaaaaccctcaaggaagagtttcagcaggacatgtcccgccgctacggctttgctgccctgaaatatctcacagccgagaacaacagctagcaccaagaagcccaccactagggggagacatgctgtaggggaagtgccactcgctgtttggggcccggccttcaaattcaaaattgagccatgctttttcggtttgtttttatttatctctttggcccagccaagctgccctcactacagagaccttggacaaggatccagccagtccctctctgccccacaaccctgcattcccagaggttagctatgcagcccacctagatgagtctcttcaagaatgggaaatcaaggggtgacagggagtaaaagggttatcatcttactgcaaagccacaagatcagggcagggctttaggatgttctggatgctttttaataattatgcttcccatcataactggggagaaagggaagtcagggttctaggggttattcgtcccaggaaatagaagtgaaattgtctttattaagtgaaaactttcccctttgccctgcaatgtagctgggcattcaaacggagggcaaaccgatgatctaaaccaaccacttggaaaaacccaatggggacattgtaaccagagggtcctggaggtggggttgatgggtttccttatccccaaagtcactcctgttttgttttgtttttctttgggggttttgtttatttttggggctggcaatccaaaatagaaaatctgatcctttgaggctctaaaggaaaatcagctgcctctaccaaccaccctctatcagcagtggcccaggaaggaggtcaagcatcttcggccgatatttaaacatgggcagcttccttcaggatgatcaccgaggctcccgtgactttgaactccctactctccagaatccaggggctatagcgatggggactgcggaattacgagggctggctgttttacaccggtcacattttctattggcagtgactgattcatgggaaagggctttgaaggaactacttcagtgcacacacaaggtacgaacctctcaggcctttcgaagaactttcataattcatgaaagcccagttctgaagattcacgtatccatctggagacctacaggaagaaagtgattgggttcctctggttcttgcctgcttcactgtggatgggaagaggtgacaacctcagtctccctttgggacctgtccaagggtaggcaaccaccttcaccttcacacagattgaggagacactggactttttacccattttctttaatcttcaatattaatattgtgtttacattgatgagaacaagagttaatgccctaccctctgctgggctgtttgtattgagttgcaatgtgaccagcgaaagctgcatttaataaatgaaagtacagactgtttcttccccattcccctcccactcttgcaggaagctactgagacacaccttgacatagagagctaaattgcagtggataaacagcaacttcacactttctgttcccccattctatttttctcatcatttgaactttagccttttttttccccttttgcctgaagttagatcccactctgtctctaactcaaaccatcttcaagttttccattccgcatctttctc

SEQ ID NO: 38094 - DNA, 502294 bp, Homo sapiens
gtgctgtggcggcggcggcggcggtagtggcggcggcggcggtgcctgggcggcagcagcagcagtagcggcagccctgaggacggtgagacggccgcggcggcggcgacagcgcggaagtcgcgcgggacccagagcttcccccctgtcgctagtgctgaggctttcgcctttcctacccagcttcttgctcacggcccgggctgggctgggcagggcaacgcgcccccggggaggggcggagctgtaggtgaggcttcgcgaccccctccccctcctcggcagcccggggggtggggaggggcgggccccacccagaccaccggcgcccacccgcgggctccacccagccgggctccgggatcgggcgggagccgaggcggtagatgtggggatcctggggcgggaggtgggggagtggggactggggctctgggcacttggggagcggagggggggaggcttaggactagtgaagccgcggacgaggtagtggggagacggagaaattggggagccatgaggttggggtgcggtcagggtggatctttgggttaggtgagtgatgtaaaatgctgaagatgattcttttcttttcgatgaaatggtgagataaaagatgaagtgtatttcaaaaggacgatgagctgtgcatgttgcctttgaggcagttgcagaacctattttattgcactagatctcacgtttctactttagggttcgattctttttcttctggcggggtgggtggggggtcggagagggaagagaatccccttactttggctcaggtaaattgtgagcgtggatgtatctgaaagttttacaccgaagaagagggagatcttcggtttagacaacttcgttccggcagccaccatttgggtcgcattacgcttagctccttcaaggtggtgtcttccagttttttttccccccaatgcctaaaagatctctttataccacccttttacaggctttatcctggccccttgagagaaggccccaaactcaggtggttgctttggaaggcacattgctgaataatagttgcaggtggttgtggttgactgctttgggtggataaagtgaacaattggaatagttctgttggagctaattatatgaaaaatgcttaaatgttttaaagtacaaccgtcttttatagcgtgttgcttgctcagtacaccttgacttttagacattttgtgttcagtgctaaattgttgaaattttatttctcatttgcagttatgtttcttgcagtctttattaaaacactttaaaatgaaatggaactctttttttttggtaggctcctcaatttctgagaaatgttcttggagtcaagtgctttaaaaacattttgggggcaggtgtgtcactttgtatggaaatattagagtaagcagtgttcaatgttcttcacatcactctttcacaacttagcactgtaaatcagaatcttcttttctggattcttgctccctgttagattacagtattctctggccctacttatcagttagtgtcatttaagctatttcttgttcagaaaacaggtcccatgatggacatgtattatgtaatggatggaagtagacatggctctcaataattcatttatggaggaagagaagctgtcagaaagtgggatttaagcagtgactttcccaaggcttgcctagtttatttgggaaaatagccagagaagtgctttcttgtaacccaaaagagaaatatacagataagaatttcagtagttgcagatcgttgctttttctaagtgcctacttaatgagcagattattgtcttccagcaaatacttctactttatagagaggtatgggaaacaggacataataggtattaagtgagaaagtgtgtgttccaatttttaattataaataaaagatttaattaactgtattcagttaattcatttggtaaagtgaacagttttgactttggattagttagaaggaaaacaaaattgacatatctagttttcgcttttaaattatacatagacttaattaattgggacaaatgtgaactaagatactgggtaaaacttgtgtgtactcctaaaatgacatttgcatggctggtagtaagctgtgattcttgtccttgtaggaatgaaatcacataatttggggaaagtcttaaggtaaaagtaagctatttcgtttagcatttcttgtgcctgaaattatgcctacattttatttttcaaaaaatgttgcttgctagtcattacttgtgatatccttgttgagtctactgaggtgttttttttccttcattacctgtgtcatagataagtatgccagtctgttaattcaacattaatactgcaaacttaaaagtgaaggttcttggccgggcgccgtggctcatgcctgtaatcccagcactttgggaggccgaggcaggcggatcatgaggtcaggagttcgagactagcctggccaacatggtgaaaccctgtctctactaaaaatataagaattagctgggcgtggtggcacatgcctgtaatcccagctactcaggaggctgaggcagaagaattgcttgagcctgggaggcagaggctgcagtgagccgagatcatgccactgcactccagtctgggctacagagcgagattccatctcaaaaaataaaaataaaaattggctgggtgtggtggtgcacacctgtaaccccagctactcaggaagctgaggcaggagaattgcttgaacctgggaggtggagcttgcagtgagccgagattgcaccactgcactccagcctgagtcacggcaaaactccgtctcaaaaaaaaaaaaaaaaaaaaaaaaaaaaagtgaaggttttcatagcaacagctgctcggttttacactatgtttacatttagaagtatgagagttgttaaatgtgtattttacacatatttcatcagaaacattaatggaaaaagatcaagaaatgaagtattttggtttaagaatcagtagtacattgattatcagttttcagagacatatagtaaaataaacttagcatacagattatgtggaatataatttgtttttttttcttatttattttttgtgtgtggaatgtaattgaaatctgttgctcaccaagtctttcagtgtactagagtttgggttctggggtcagagtgcctgagttcaaatcctggctttgccatggtatgatgtagggcaaactgcttaatgttgtttatttcctaaccttaacctgtaccttaatttcttcatctgcaaaatagaaataataacagtagtacctaacctcttaagctggtcaaatgaattaattcatgtatttagaacagtttgggcacataattagctggttcactaacatcatttgaagtttaactgtgtatactatttttacttaataagtatatattaaatacatattatgtaccacatattctagatgctggtatcatagtagtgaacagttctcccagcactttgggaggccgaggtgggaggatggctgggcaacatagcgagaccatgtctctacaaaaataaaaaaattaggccgggtgcggtggctcacgcctgtaatcccagcactttgggaggccaaggcgggcggatcatgaggtcaggggttcgagaccagcctggccagcatggtgaaaccccgtctctactgaaaatacaaacaattagctgggggtggtggcgcgtgcctggaatcctggctactcgcaaggctaaggcaggaaaatctcttgaacccaggaggcggaggttgcagtgagtggagatcgtgctattgcactccagcctgggtgacagagcaagactctgtctcaaaaaaaaaaaaaaaaattagcatggcagtatgtgcctatagtctcagctactcaggagactgaggcaggaggatcacttgaacctaggggttcgaggttgcagtgagctgtcattccgtcgttgcactccagcctgggcgacagagtgagggaaggctatctcaaataaataataaataaataaaagtacgggcagtagtcaggagcttatgctgtattgttccaggtgagggtatctctgaccaaggtgaaatggggaggaggggttggattttgtatgtattttgagggtagacctatagaatttgttggtggttgtttgcgggatgtgggccaaacagaagaataaagaataaggtttttggcctgaataactggaagaataaagttgccagtaactgaattggagatggtaattcatggagcatgtttgtggagaaaccagaagttcagggtgatgtccaggaagagtgagaaatgtggctgttttcagcttctttgtagtatttatgattatgagataggtgagatcatcaggggagtgaattttggtggagaagagatccaaacatctgagcctaggggactgattcattcacttattcattcataagttacttagtgagtatggttcttctaggtacctttttaggcattggggatataaacctgacaaaagttttcaccttcatggaacttaccttctagatacgtgaggggaaatcaagaggaaccagtaaaggagagtgataagaaatcattgagttaggagggaaaccaggggagtatgatattctagaagtgaaggaaaggaagctttcaagaaggagggaacggtcagcggtgtcattgtttaaagttgtgtcagaatgttgagtaagagagaattctgcttgattatgatgtctaataacagggaaatgactaaataagttttagtgtgagatagatgagacaaatgtaagagtcttttagttttttacttctctgttttttttgtttttttttttgagatggagtctctctttgttgcccaggctggagtgcagtggcgcaatctcggctcactgcaatctccgcctcctgggttcacaccattctgcctcagcctccggagtagctgggactacaggtgcccgccaccatgcctggcttttttttttttttttttttttttttgtatttttagtagagacagtgtttcactgtgttagccaggatggtcttgatctcctgacctcatgatccgcgcgccttggcctctcagagtgctgggattacaggcataagcgaccacacctggcctcattctccgggtagatttttaagaaatatttcagccaggcacagtgtcacatgcctgtagttccagctgctctggaggctgaggcaggaggattgcttgagtccaggagatcaaggctgtagtgtgctatgattgcatatgtgtatagccactgcactccagcctgggctacatagtgagaccccatctgtaaattaaaaaaaatcattcttttcagaacaaaataggcaacctgggagtgctaaggaaaggcacatgacttcttattgttgttgttaattttatgtacacttattttaagaaataggtaatatatgtactaaattagaaggtataagagaatacacagttaaaagtctctcctatcccatctagttctttctgaaggcaatcactgtttgcagtttcttgttttttctttttagccagtgaaattttgtgtaataggacattacctattctaaaattgcatacatataagaaacattttatcttccactctgacactgaacactggcaatattttatactttttgagaagggtcttggtctgttactcagtctgaaatgcgatggtgcggttatagcttactgcaaccttgaattcctgggctcaagcgatcttcccacctcagcctccagagtagctgggactgtagccatgtgccaccatgcctggctaattaaaaaaaatttgtagagagacaaggcgtcattatgttgcccaggcactattttagaatagcttatttaaaagatagttttagaagcctgtcaagggaaatagtgactgctaggatcaaacatggattcactaagtcacatcagacagtagttgcctagaattgacttggttacttgactgataaataaaggaaatgcagtagttggaatttatgtatacgtcagctaggctttttcatgtcgtctttgtggaaagtacgaacatatgtgtcctagatttcttgaggacaggaactatctattagatacttattaaatacttgatgaatgaatggatgctagcataataatgtgaattcacaagttgaatacccaggaaataaagaggtgcttgttgaggatcttgggtttgaggaacttggtgttagactcatccatacatttattgaaatgacacaggatggtagcaagactggtggcatagaggataatggcagctgtgaactagttgccagcatatccttactgagtatgggggatgtccaggtggtcattagctgatagtgaagaggtagaggttgaagactgtgctgctgaatagcatgagaattagactaagattttacgtaagggtttgggaatagtggtctggaactggcactggcaggaaggaaggtaccagcctcatttcccagtattgggtgtggagtggaagagactgagtagctttcacttaaaaggactatatgagaagaggtgtcctgattggaaagtcagctttcagttaaggcagagaggtagcaagaacatttcccaaggaagttgaagacttttagaggagtttcttgataaaagaatgaagttccatgagagtgtatttttccaccctattggcttgttatcatcatttaaactttaaaatgtctcttcatcttaataaaaaactccagatttatactttattgctctaagttgctctctgctttacacacttaagagttttctgcatttgctgtgtatctccatttcttcacctgtgacttctcaacctatttctgtcttgtttctatcgccattatttcagtgaaactgaaaatagctagtgaaaatatgtatgaaaatagccaatgtctattttactatcctgttcttatttaacctcttagcagctgtgctagtttctattggctatataacaaattaccccctaacttaagaaacatttattgtttcacagattttgtagatcaggaatgtgggtgcagttggcacctatgattcagggtctctcacaaggctgcagtcatctcaaagcgctacttggggaggctgtttccaagctcactcatgcggcaattggcaggcctgaggtccttgttggctgcttgctggagaggtgagtcccttgccatttgggtttctgcgtacgactacttaaaatatgatatctcagtgcttctgtcttcaaaagaggacagatattagccagaatctttttgtaaccttatcttggaagtgatgtggtatcacttttgttgtattctgttatcagccagtcactaggtccagtgcactcaaggcaggatttcacaattgcatgaatgctgggaggcagagatcactcatagccatttcaggactgtctaccacagcagcatttgacagagcggatacccctccttcctttgtaaagctctctcttctcttgaggtcttcagagcacttttctgtttttcttgctggttctctgggctctttctctgtcacttttttttttttttttttttttttgaggcagagtcttgctctatcgcccaggctggggtgcagtggcacaatcttggctcactgcaacctccgcctcctgggttcaagtgattctcctgccttagcctcttgagtagctgggattacaggtgtgcaccaccacacccagctaatttttgtatttttagtagagatggggtttcaccatgttggccaggctggtctcgaactcctggcctcaggtgatctgtctgccttggcctcccaaagtgttgggattataggcgtgagccaccgtgcctggcctctcagtcaccttttgagtctttctgtgctcatttattaaatgtttgaatttctttgggctttctcatcgctttctatttcatttttcatctgtgtgctgagtattcatttttatgtcttcagtttttacctctctcctgagtctgaggaccactctatcgaattgctactgaatgtttccatttggatgccccttaaaccgaacacatccagaacggaatgtatgattcctacacttcctctggtgtttcttaatttgttaaatgacaccactgggtgcttaagccggaaatgtgtgtggtgttcttgatttctccctctcctccaccttccattttactattgctttttatttttctagagccatggctgttcagtgatggtgtgaatgtttctatgaggtagtgcatcctctgccaggttgcaagcattgaacctggtgctaggtgatttttttttttttttttttttgagatggagtttcactctgtcgccaggctggagtgcaatggtgcaacctccgcctcccgggttcaaacgattcccctgcctcagcctcccgagtagatgggattataggcgtgcaccaccacggccagctaattttgtatttttagtagagacgggatttctccatgttggtcaggctggtctcaaactcctgacctcaggtgatccgcctgtcttggcctcccagagtgctgggattacaggcgtgagccactgtgcccagcccgctaggtgatttttaagattccttccaatcttgagatactgcgtgtgtagctattgaagatttctgagtaggagatgcatgatcagggctgtgcttcagaaaggtggcaactcttgaacagtcatttttagttgttcaccaaagaatgaaactaaacacctgtattctttttaactttattatggtgtgctaagtgatgaatagataatttttatgtgacagcccttttgtatatattagtttcattttttctcattgttaatgcatttatgtttggaagcccttttgcatggaaataagataatcaggccaggcacagtggctcacgcctgtaatcctagcactttggcagactgaggtgggtggatcacttgaggccaggagttcaagaccagcctgagcaacgtggcgaaaccccatctctactaaaaaataaaaaaattagctgggtgtggtggtgcacgcctgtaatcacagccactctggaggctgaggcatgagaattccttgaaccctggaggcggaggttgcagtgaactgggattacaccactgcactccagtctggatgacagagcgagaccctgtctcagaaaaaaaaaaaaaaataacccaatgggatgaaaattttgggatgaaaatttgtgtgaacttaaattaagtgtctctgccatcctggccaacatggtgaaaccccgtctctactaaaaatacaaaaattagctgggtgtggtggtgtgtgcctgtagtcctagctatttgggaagctgaggtgagagaatcgcttgaacctgggacgcacaggttgcagtgagccaaaatcacgccattgcacccagcctggtgacagagcaagattctgtcttaaaacaaaaaaaattaagtgtctgaaattgtaaaaacttctcaagaaataaaattcagaccttaaacataattttactgtaggaatataacttaccttttgaaggaattctttcttgaagccattatttgtgtatttatttatttttaattaacttttttgtttgtttgtttttttgagatggagttttgcccagactggagtgcagtgatgcgatctcgtctcacggcacctcccaggttcaagcgattctcctgcctcagcctcccaagtagctgagattacaggtatgggcaaccacgcctggctaatttttgtttttagtagagatggagtttcaccatgttggctaggctggtctcaaactcctgacctcaggtgatctgctcacctcggcctcccaaagtgctgggattacaggcgtgagccacactgccggtgcttgccaccttgcctggctaattttaaaacttatttttgtggatattgagttttggttttttgtctaggctggcatcgaattcatagcttcaaatgatcctcctgtcttggcctcccaaaatgctgggattacaggcatgagccactgtgtccggccttgaagcccgtcttgaatgtaacacatatgtagaaaagtatgtaaaacaaaagtaaagctttacaatttatgaatcagacacttgtataaccatgatgtaggtcaagcactaggaccttactgacattccacaagctttccttgaagcttcccaatcacaacccagtccttctctcataaaggtaatctctgtcctgattgtaggagaatcaccttctttttttgtgtgtgtagacctttttagttttggcttagttttgattgttttgcatctttatatgcatggaatcatattgtatgtattcatgtctggctttgactcaacattttgtttgtaagatttagatttgtatgtagctgttcgttcattttcattgctaaatagtattccattgtataaatatactacagtttattgtattattgatggatatttaggttgtttctagttttgggctattatggattatgccactatgactattcttgtaaagtcttttttttttttttttttttttcctgagacggagtctcgctctgttgcccaggctggagtgcagtggcgcaatctctgcttactgcaaccaccgtctcctgggttcaagtgattctcctgccccagcctcccgagtagctgggattacaggtgcccaccatcacacccagctgtttttttgtattttaagtagagatgggtgtttgccatgttgaccaggctggtctggaactcctggcttcaaatgatccacctgcctcagcctctcaaagtgctgggatcacaggtgtgagccaccatgcccggctttttttttttttttttttttttttttttttttgagacagtttcactctgtcgcccagactggagtgaagtgttgtgatcatggctcactgcagccttgaccttctgggctcaagtgatcctcccacctcggcctcccaagtaactgggactacaggtgcataccaccatgcttggctaattttttttttttttttggtacttttttgtagagatggagttttactatgctgctcaggctggtcttgaactcctgagctcaagtaatctgcctgccttggtctcccaaagtgctgggactacaggtgtgagccactgcaccttgccttgtgcaagtcttttagtgcatatgtgtatgtaattcttttgtgtatttggccaggagtgaaagtcctgggtcataggatatgcatatgtagaattttagataattgccaaacagtattccttctttgtggttctacaaattacatgccccaaagagtgtttgagagttcattttgttccatatctttgccaatacttagtattgtcactattattaactttagccgttctggtggatttgtagtagtatctcttggttttaatctgcatttcacttattactaatgaggttgaataattttatgttggttacttaggaaaccttttgtgaaatgcttattcacatgtcttgcccaattttatcttttttttcttattataggagttccttatatattttggatatgaccccttctttggttatttgtgttgcaaatatttccaccttactctgtggcttgccatttaagacttcttaaggaggccaggcaccgtggctcatgcctgtaatcccaacactttgggatgctgaggagggtggattgcttgagtccaggagttcgagaccagcctgggcaacatagtgaaaccctatctctatgaaaaatgcaaaaaaaaaaaaaaaaaagactcaaaaaaaaaaagagaaaagaaatgtgttaggaccctaattggactttaattggatttgtagattaatttgggtagaattacttttttgtaatgaggaatctttgactaattcaatatgatatccctgttatttatgttgtatttcatatatctcagtaatgttttatagttttctgtgcagtattacacatcttttgttaaatttagtcctagtatctgatggtattataaatagaattctaagatcaatgttattttccattacttgttggtatattgaaataaaactgaattttgagtgctgactctgtattttgctaatcaagccttataataattttatctgtagattcttttggctttccaacttacataaccatatcatttgtgaataattactgttttctgtttttcttcgcaattcttacacctttttcttttcttcactggctgggatttctggcatgttgttgaatagagataggagacgtcattgtcttttcccatctcaaagggaaatctttcaacttttcattgttaggcatgatgttgtcaagcacacttacacaagacaaggcaaggctaagaccttgcctgtctgatttgactggcaaagacacagagagcctctttagactcagacagtttatctgttacatagtcggcagaaagaagaataagccaaaggttcctgctccctgtgatctttgtcccacataccaaaaaggataacaccacaacaaaaggggctgatgcctgcagtgtgagctgggggatactctgttgatgaggagcctattctaggctgctgctaagtggttttgtattctacagcgctgttctaagttaggcagggctgaaggttcaatgccttgtcagaacccaggatgccatgagaaactgtctcatggcagcttctaaggaagatagggaagaggtgacctgggagagctccatataggccttccaccatctcctgttatgggaggatcacagggcattcctccaagactcagataagctgcaggtcaccagaacaccatggtggaactgtttccctacagatgtttgttatagttgcttttgcacatgtcctttattagattaagaaagtttcctcctatacctagatttttattcattagtaaatgttaaaatgtgtccagtgtgtttcgtatctattggatgcttccccccctttcaacccattattatggccagttacatggatttaaaaattcatttctgctggttaataaatttctttctttttttctttctctttttttttttttttttttttttgagacggagtcttgccctctcgcccaggctggagtgcagtgacgtgatctcggctcactgcaacctccgcctcctgggttcagacaattctcctgcctcagcctcccaagtagctgggattacaggtgcccaccaccacacccagctgatttttgtatttttagcagagatggggtttcaccgtgttggccaggctggtctcaaactcctgaccttgtgatccaaccgccttggccccccaaagtgctgggattacaggtgtgagccaccatgctcagctggttaacacatttctaagcatttttttcctttgaaagattttacttacttgaaaaaaaattgctgttgatgactttcttttctctggctgcctgcctttttctgtgtgtgtgtgtgtgtgtgtgtgtgtgtgtgtgtgtgtgtgtataaattttttttttctcattgttcatatagaattcaggtatagaattcaggttgctgaacttttcaaggaagaaagaccgtatttaacttctgattcatcattaagaagttattaatggtcccagagactcataggggtttcttctgaagtaagaagaagccatgttttacatcttcagatgccacgtaggtgacttttctaccttcatggtagtattcactttactttcattaaaggcaagtaattttgagtacttcaaattagttcccatcccttttctaaactttaaacatttttaaagaaatctttatttattttcacctggggtttcactctgtcacccaggctggagtgcggcagtgctatcatggcttactacagcctcgacctcccaggctcaagcgatcctcttgcatcagccttcgagtagctgggactgcaggagtgcaccaccacacccagctaattttttgtagagatggggttttgccatgttgcccaggctggtctcaaattcctgagcttaagtcatctacccaccttggcctccgagtgttgggattacaggcatgagacaccatacctggccccttttctaaacttttatatgaaatttaggctgaacctttgcttgacgttattctcccttgcatttagatataaagttattaaacagaaaaagttactgaaggtagataattattggctatttcatgtgatttttctggtggttactgtagtcaattttatagtattgccaagtttctgaatccattctgaataatgtgattgtttattcttatgctttgggcctgataatttttgtagagcagcagttcttatctggtttcctgttatttttaaaataaattaattgaaaatgggcataaattatttgttaagtttgaacttgacaaatgcaggtaaagtataatgatattatatttcttctgtacagcaagtatatacatgtatattttaaatcatcaatcaggatttccttccaaagttcagaattaggttttgattcttaacagtttatattaaaattcttattattattactttttttttgagattcttaacagtttatattaaaattcttattacttttttttttttttgagacagagtctcgctctatcgcccaggctggagtgcagtggcatgatcttggctcactgcaacctctgcttcccgggttcaagcaattctctgcctcagcctcccaagtagctgggaatacaggcgcctgccaccacacctggctcatttttgtatttttagtagagacggggtttcaccatcttggccaggctggtcttgaactcctgacctcaggtgatccacccgcctcggcctcccaaagtgctgggattacaggcatgaaccactgcacctggccagtattattactattttttgagacagatttttctcgctcaggctggagctcattgcagcctcgaattcttaggcttaatcaatccttctgcttcaaccttccaagtagctgggactgtaggcatgcgccagcatgcctggcaaatttttttttgtttttgagacagagtgttactctgtcacctaggcgcaatttcagctcactgtagtcttgaccttccactcctaagtgatctacccaccttgcctcctgcatagctgggactacaggggcgtgccaccatgcccagctcatttttgtaattttttttgttttgtttttaagagatggggttttgccgtgttgcccaagttggtctcaaaaccctgggctcaagtgatcccctcaccttggcctcccaaagtgttggtattgcaggcatgtatcactgtatctggccttttctttttttattagagacagggtcttgcagtccaggctggtcttgaactctttggcctcaagtgatcttctgtcttggcctccgaaagccctaggaaacaattcttgtaaatagtatagcaaaaatgtctgctttataaatttttcatttttatagttgttcaagagtacatatgtatttccttttttctttttctcgttcctcattcaaaaaatatggaaaatctaatatacaatatatatgtgtatatagtatatataatatagtatatatatggtgtatagtatatagtgtatatatagtatagtgtgtatatatatgactctgtattgtgttccatcttggcagtacagtgtttgaggcactgtctccgccctcaggatgctggtgaccagggagggagacagtaaacaggcaattacagtagagtgtgataagtgttattgatacgtgcaagaactagaaggtttaaggagtggccaaagaggcttgaaattgggtttggatcatgaagggctttgtaaaccctgttaaaatctgacttttaccttggagcaatggcaagactttggagacttttgagtaaaggaaataacaggagtatatttgtattttacaacaaatggttaagaggaggctatgtgaggaagccaactaggaggctgtggacctgttcccactaaagcctaaaaactaaagtagtgacagtggggatagagacgcgtacagagttaaaagctttaacaggactgggtaattcattctctctctctctctctctctctctctctctctttctctctctctcactgggtaattctctctctctctctctctctctctgtgtgtgtgtgtgtgtgtgtgtgtgtgtacacactttgtggggaaaggacagttagttgatggggaggaagaagactaaagtgactcccagactttcagatggaacccctaggctaggaacagtgctattgggtacagtagccactagccatgtatggccattaaggtatgtctaaactaatttaaataaaataagatttaaaatgcagttattcagttgcactagccacacaaatatagaattacagactcttaaattctgtaaatttcatccagagtactatgaagttataaattcaagagtatgcacagagattcaagcagaaaataatatctggctacatgtgtttaacagcagtatgggactggtggcctctgtattggacagtgcagatatagaacatttctgttacagaaggttcagtgggacagcagtggtctgcagtttttggtttctactttcttttccccgccagaggagagtcagaataacaggtggttttctctcgtctcctaagaactttggttccacagtattctgttgtgtgatattgttacccagggattctgctagataccgttcactactgtcaaccaccatcacccagtcatcaggtataggacgtttctgtaatcagagaaggttcttttggacggcactgagctagagagatggtgatgtcattcatcgagctattgatggttgtggtgggacaacagtagctgccagaaagcgctgtttattagaaatatgagccacatatgtaattaaaaaatttttagtagccacattaaagagtaaaaagaaacaattggattttataacttatttaacacagtatgtccaaaatatgatttacaacacattaaaacatttaaaaattattgatctatttacataattttttttaatttttttgagacaggctcttgctatgttgcccaggctggtctcgaactcctgggctcaagtgatccatccgcttcagcctcccaaagtgctgggattacaggtgtgagccaccatgcccggccacattattttttaatactagctctttgaaatcaattgtatactttcatagtatatcttaattgaaatactaatttttttgttctttcgttattttcaaatgcttagttttatcagaaatatttcatctgtatttatatctgtaaatcataaaatttacagttgaaaaagtagatttatatgcccaggttattccaaacatgcttaaaacttttccagtaatggaattaagtatcggtttttaaagtttcaattcccgtgaaataagaataaaaattcagttcctcggtctcactagccacctttcaagtgctcagcactcagcagctgcatatggctagtggctaccatattggacaacacagctctggaataactgctcactggatggttggaaattcaggtctggagtttaggaaagaggtagcaagacagaagttagaagggaggagctgtgaggaacatggggatttaaaaaaagaagtttgtgactttgagcaaactaattttaaccttggtgctccatttaaaacaaaatcgataaaagcatcttggtgagagtataatagtagatgaatatgcagtatcttgtggtggtaaagatttttttttttttttgagacagagtctctctctgtcgcccaggctggagtgcagcggcactatctcggctcactgcaagctccgcctcccgggttcacgccattctcctgcctcagcctcccgagtagctgggactacaggtgcccgccaccacgcccggctaattttttgtatttttagtagagacagggtttcaccgtgttagccaggatggtcttgatctcctgacctcgtgatccgcccacctcggcctcccaaagtgctgggattacaggcgtgagccaccgcgcccagccaagattttgactttagagtttgatagagctgtgtgatcttgggcaacttactgggcctaatacaatctttctccttgaaaggggtttgctgttgggattaaatgaaatattgtgacaagtgttcactgcatataatacgtatttctttacttttaagttgccatttctttttggtgaggtgtactatcaacttaataattcattctttttagaaaaaaagaaacataatttagttatacatgttaattataagctgcatcccaattcagaaactttaaaatatgaaaaactgtttatcttaaaatattaatattgatgagtgttcattataaactagatactgtgttaaatgctttatatggtgatgtaaaaggtttgatttttataaatatgcaatgtaatatgatatttttgttataaagtttcatttaagtagattctgcaatacaaatctcttctggaaactttaaaatgcatgatggtataactccttttttcagttatttcaggaaccactgaattctgcttgaatctctttggatacttctaaatttatgatttctccaggctaaatctgcagaatttgagtctgtaattctaccttagtgagtacacatataaagaattactatttaaaaaactgccttggtagagtttattcagagaagcgtggtaaccgaggggaggaaaatggacttttccaggtcgaagagaaaggaaatattggctgggtgccatggctcatgcctgtaatcccagcaatttgggaggctgaggtgggcagatcacttgaggtcaggagttcgagaccagcctggccaacatggtaaaaactcatctctactaaaaatacaaaaattagctgggcgtggtggcgggtgcctgtaatcccagctatttgggaagctgaggcaggagaatcgcttgaacccgggaggagaggttgcagtgagccgagatcatgccactgcattccagcctgggtgacagaggaagactctgtctccaaaaaaaaaaaaaagagaaaggaaatatgatttttttttttttttttgacagagagtttcattcttgttgcccaggctgtagtgcaatggcatgatctcatctcactgcaacctccacctcccaggttcaagtgattctcctgcctcagcctcctgagtagctggcattacaggtgtgtaccagcacacctggctaatttttttttattattattagaaatgggtttttaccatgttggccaggctggccttgaactcctgacctcaggtgatccgtccttcttggcctccgaaagtgctgggattaccgaacccggctggctatatgatttttgatgctctgcaaattcttttctgaggtctttttcttaagtctcatcttctggcagtgtgccattccacccgtttcttggagaagaccagaaacatgtttataatgcgtacccatgcgttatatacacagtgtgtactaggaaaccttactgccttatttgtggtagtttcagtagacccactcaggtctgaaataatattaggcattttacatccgtattattggaaataatgaaaaattttatatgtgccaactgcatttggtgatagcaactgcaagtgctgtgttgaaaatgactttgagactaggtacaaaaggatgaagtgttcaccctggaattacagtggctctccttttgtttctgtttaagtcttcttaacatttttcctttttttgttttttgagacaaggtctcactccgtcacccaggctggagtgcagtgttgccatcaccgctcactctcacagcagccttgaccttttgggctcaagctatcctcctacctcagctcccaagtagctgggactacaggcatgcaccaccatgcccggctaattaaaaaaatttttttgtagagacagggtctctccgtattgcccagattggtctcaaactcctaggctcaagcgatctgtctaccttggcctcccaaagtgccaggattacaggtgtgagccaccttgtttggccaacattttcctttttaaataagtagtgtttacctgtttggaaaattttgacaactattaggaaaaaactaggtttcagctcatcttttggctgtgcttatatttgcaaaattgagagtatactgtagattaaaatatattcttgaaggctgggcacagtggctcatgcctgtaatcctagcagtttggaaggtcaagttgggcggatcacctgaggtcagtagttcaagaccagcctggctggttagcctagctaacatggtgaaaccctgtctcccctaaaaatgcaaaaattaactggatatggttgcaaatgcctgtagtcccagctgcttgggaggctgaggcatgagaattgcttgaacccaagaggcagaggttgcaatgagcggagatcaccccactgcactccagcatgggtgacagagtgagactctgaaaaaaaaaaaagcatatcctttttcattattgtgttataaacgttttttaaatggcagacattggtttgtaaatggtttttgtaggcttcatgttaagtcataaagatttcacttaaacatttctcaatgaagtgagtactaataaagctggtgtatctttataaacttttctctacattttggatcatttgagtagattggtttttcctgttcatagaattactggatcaaaagatatgtttttaagacccttactgtaaccattttcaaacttgctgcttctcagatacttttattatttttgggaagaaacaaatacttactgggttcctataatttttcacttaaacccttttaaacttatgatatgcttcagacatgcaaaaagatacagagaatgatgtaattaatatctgtgtatctaccacctagcttaagaaataaacagtcacagacttaaaattcctgtgcagctcttcctgattataaatgtctgtatttaccaacagtgatgtggatatttaatcttttttttttttttttttttgagacagagtcttgctctgtcaacaggctggagtgttgtggcgtgatcttggctccctgcaacctccacctcctgggttcaagctattcttctgcctcagcctcccaagtagctgggactacaggcccagctaattgtatttttagtagagacggggtttcaccatgttggcaaggatggtctcgatctcctgacctcgtggtctgcctgccttggcctcctgaagtgttgggattacaggcgtgagccactgctcccggctgatatttaatcttaaccattaattcaggtctgcgtccaagatcttttggaccagaattcagaatttttttcagatttttagagagatgacatgcatatattatatataagctaacttttcaagtatgttttgggaatggtccctaatttcttcattaaacactttgggattactgacccagtccaggtctggttttactatcatattagttataaatttttggatttttagacatttttgttattcagtcttgtgaatagacgtttgtgaacaggtacatctgttttactttgttcagcttaatcactggtagaatttgttgaactttgtgttgagctgatcacgatgtagtatgagatgtataaaatgcaaggtaacataattttatgtccaaacaatttaatattttaggattttatgaaatcaggttatcagtgagcactagagtcgttggggaaggctacacaacctagaacttgacttgtttcaactaagtggcgcagattgctgttacaactggagaacaactatgattaacaaccttgtgtttatttctaagtatctagcttgacaaaatatttgtcatgatgagaactttgagagaacttataattaacttgattaattgataagaattattaaaaactgcagttaacttgattgtaaactgagttacccttccattaaaaaaaggcgaaatagtaactgacaagtgttaagattgctcgtttacaattgatgtgtcattgctgctccaagcagaggtggcctttcagataggtatgctctgaaacagtgctgctttagccacactgtcgtgtagttttagtctctagtcagtattggagaatcagattaaggttatacaactagatgcgtagtgttagcagacttaatacattttagttacatgctgagtgtagaggcagagaaatctgtgccttcattaacttgtagatttattttctttctgtctttctgtctgtctgtctttgggtctgtctgtcttcctttgtcacccaggctggagtatagtgatgtgatcataggtcgctgcagccttgaactcctgggctcaagctgtcttactgctacagcctcccaagtagctagggctaaagatgtgtgccaccacacctggctaattaaaaaaaaagttttttgtggagacgaggtcttgccgtgttgcccaggctgatctgaagtgatcctttcgccttggcttcccgaagtgttgggattataggcataagccatgtgcctggtgattttttttttttttaaacttcctgctacttacagagatattagcaatctgtctatgcctagcccattaattgctgtgtaaattagtgccgaatggttgtggaggtctttatttaaacctgtagtttataatgagacttaaaaaaatgtaagtttttttttttgtttgtttttgagacagggtttcactctgtttcccatgctgggatgcagtggtgtgttcttggctcactgtagcctctgcctctggagttcaagcaattcttatgactcagcctcctgagtagctgagatcataggcgtgtgccatcatgcctggctaatgttggtatttttggtagagacggggtttcaccatgttgcccaggctggtctcgaactcctgagctcaggagatccacccatcttggcctctcaaagtgttgggattacaggcctgagccaccacaccaggccaaaaaaagtaaagtaatacacactcactataaaaagaaaatggaacagagaagaaaagtatgtaagtaaggaaaaaggtgattccatctggtctttcagaaataggcttttaccgtacaaatcatttctgtgtatatacaaacatacgtgtatatatcctttgtacacaaatgagattgcctcgtaagcattcttctgtaacctggtttttttcccacttcacaatatgtttttgcatgtcagatctatatcttagatatagatatttacttaatttttttttgtttttgtttctttttcctttttttgaaatgaaatctcactgtcacccaggctggagtgcagtggtgcaatctcagctcactgcaacctccgtctcccaggttgaagtgattctcctgcctcagcctcccaagtagctgggatcacaggtgtgcgccaccatgcctggctaatttttgtatttttagtagagatggggtttcaccatgttggctaggctggtcccgaactcctgatctcaagtgatctgccctccttggcctcccaaagtgttgggattacaggcatgacctactgtgccctgcctctttttctttctttttttttttttgagacagtcttgctctgttgcccaggctggagtgcagtggcatgatcttggctcactgcaacctctgcctccggagttcaggcaatcctctcacctgagtaactggtactacaggcacacaccaccttgcccaggtaagttttgtattttggtagagacaggaattcaccatgttgtccaggctggtcttgaactcctgacctcaagtgatctgcccacctcagccttttaaagtgctgggattacaagtatgagccaccatgcctggccattgtttttcttttcttttttttaaattaggattgcctgaaagaaattttttttaaacagcagcattgtcttttgtagttgagagatacataaatttattcaactaatctctttggaaatttaagcggtctccttgctggtacaaacaatgcaataattgaatatcattgcacattatgtccttgaacctgtgaaaatatattttatggagaatattttttaaagtgaaacttctagttcaacaatgtgcacattttaaattttgatagattgtgccaaattgtacctcagtgggattttaaatttttggtttattgttcatcttttcacagggagcctaggatagcagcatatttctcgtccctagtaatatttataaccctttaagaaaatgaacaggatctttaaacatgttgaaatacagtattaaaaatatttgactcgttgatgagcataaccccattacatcaggttgtactagtaattttgagatttatgtgagaatttcacatataattatttaaatagctaatgggtggtatattacatcaggttacatcaggttggactagtaattttgagatttatgtcagaatttcacatataatatttaaatagctaatgggtggtatattacatcaggttggactagtaattttgagatttatgtcagaatttcacatataattatttaaatagctaatgggtggtatattacatcaggttggactagtaattttgagatttatgtcagaatttcacatataattatttaaatagctaatgggtggtatattacatcaggttggactagtgattttgagatttatgtcagaatttcacatataattatttaaatagctaatgggtggtatattacattttctggttcaacttacaaatatagcacatctgtgttagcctagtccattatagttagtttgaagtaaactgctgtgttgctattaaagaatttttttgctttcatttgtcttaatgatatttggtgttcctttggagactcagttcataaagagctattattatttttctaatctatgaggagagtgagagattgctgtctgcagttgcatgttatgctcgtagctatttgtgggaagagtgagaattaaaggctaacatataatcattgtgggtagaagtatttttatttttagacttctgagtataatggatttctgtggggtgaggcgagactggggctgtttttctctcacagtatgtatataaccattgggatcagtgcttttcttttctttttttttttttttttgatttttttggatacactgtttcactctgtcacccaggctggagtgcagtggtgcgatctcgatctcggctcactgcaacctccgcctcctgggttcaggcaattctcctgcctcagcctcccaagtagctgggtttacaggcgtgtaccaccatgcctggctaagttttgtattattagtagagatggggcttcaccatgttagccaggctggtctcaaactcctgacctcaagtgatctgcctgccttggcctcccaaattattgggattataggcgtgagccaccgtgcccggcttcagtgcttttcttagggaaaaatgattctggaatttttgaatatttttatttattatttttttgagatggaatcttgctctgtcacccaggctggagtgcagtggcatgatctcggctcactgcagcctccacatcctgggttcaagtgattctcctgcctcagcctcctgagtagctggggttacaggtatgtgccaccacgcccagctaatttttgtatttttagtagagacggggtttcaccatgctggtcaggctgatctcaaactcctgacctcaggtgatccacccgcctcagcctcccaaagtgctgggattacaggcatgacccaccatgctcgtcctgaatattctttgtgtttttttctgacaggctttgtgatgtgaatagtagtgaattgatagtgaaactgtattgttaataaacacataatttaagataagccagatttctggtaatattcttctcagaattagattttaggaaatttctctaaatgtaaatcctggaaagcttgcagagatttaaatgttgttctggtattttttttttttttttttttgagacggtgtcttgctctgtcacctaggcttggagtacagtggcacagtatctgctcactgcaacctccacctcccgggttcaagcgattctcatgcctcagcctcccaagtagctgggactagaggcgtgcgctatcacaccccgctaatttttgtatttttcgtagagatggagtttcaccatattggccaggctggcctcgagctcctggtctcaggtgatctgcccgcctcagcctcccaaagtgctaggattacaggcgtgagccaccatgcccagcccatctggtatttttaaaaaactcaaaatatagggtacaaaattcatcttaagtgcttggtacatctttagcttggtaggtctctgacatagagtttaatagagatttttttagtattgagaacccatttgtccccacagacatattttctgcgtgtgattgctctgtgtgtatgtgaatttttaatttctttcttagatgagaggcattagtctgtttttgagcttatgccatcttcttggaattaagatttagctacagaagtttgtattcttattaatgcaggaagaacagttttttaaaaaattgaaatcttgcccatttagttaattattttcaggggatagatgacaaaagtaaattgcaagacatgtacagaaggaggttgtcagttcatggaatttgttttatttatttatttttattcagagtctcactctgttgcccaggctggagtgcagtggcatggtctcagctcactgcaacttccacctcccggcttcaagcgattctccaagttgattctcctccctcagcctgtggagctgctgggagtacaggtgtgcgccaccatgcctggctaatttttgtatttttagtagagacggggtttcgccatgttggccaggctggtctcgaactcctgacctcaagtgatccgcctgcctcggcctcccaaagtgctggggttacaggcgtgagccaccacacccagcctaattcataaaatttggatactgtttaaagatagagaaaactttcttaacttgaggaaaatgttaaaaattgctttcattatatttgttttagattacatttagttgcaggttccataaactacattcaagattagtactgctttttaaatgtatatgaactatctaatggtttttacgtggatttaggttaattgtggcgttggcaaacacttactgcctgcttgatttgtattagacactgtgctaggttttggagatggagtaagacattcctttacttttaaggaggtgattaactaaaacaataattacattattttaaaagcccctggttacctcagaggagcacctaaattagactgaggggcatgaaggtttgtgtaggattgtgactgttgaacttagtttggaaaaatgagcagtagttagccagttgatggggcagaagaaggtcatggaaaccagagacagcttggtatttcagggaattgcatagacctgattatggttgtcacgtggagaaggacagtggataagtagtagtttcagagagataggcagggccaaatgatgaaaaatctcatatgcactaccaaggaattcagattaaaaaaaaatattttttgagacaacgtctggctctgtctcccaggctggagtgcagtggcatgatctctgctcactgcaacctccgcctcttgggctgaagttaccttcccacctcagcctcccaagtagttgggattacaggtgtataccacctggcccagctaattttttgtatttttagtagaaacgggattttgccatgttgcccaggccagtcttgaactccttagctcaagtgatcatcctgcctcgggttcccgaagtgctggggttataggtatgagccaccgtgcccagccaagacatttttaaaatgtgagaatacacaagcacacattccattagctgtcagtgggatattatcacatgtcatgtagctctggaaaacactatcatgcacttgtgagagaatcacggtgaaaaaggccaatgacatcatccttttatggaaatagttttgccctcatggacctcctgcaagggggtcttgagcacccctggaatcccttacccatctggagaatcatattagaagatcattatggcactggtgttgagaattgtttagaacctataaaaagaatcacatttatttttgcttttttgagacagggtcttgccatgtcatccacgctgtagtgcagtggaactatcgtggctcgctgtagtgcagtggcactatcatggctcactgtagccatgaactcttgggttcaagcaatcttcctgcctcagcttcctgagtagctgggactgcaggcatgagccactatgctgggctatttttttttttatttttaaattttttttgcagagataggatcttgccgtgttgtccaggctggtcttgaactcctagactcaagcaattctcctgccttgtctcccaaagtgctaggattacaggcatgggccactgtgtcaggccaagaaggacatttcatattgtgatccaatatgcgcactttaaacatcgcagaaaacaagactgtattatctcttgctgctttacaaattacttcaaaacttactggatttaaagaacatctggctggacacagtggctcatgcttgtaaccccagcactttgagagaccaaggcagatggatcgcctgatatcaggagtttgagaccagcctggccaatatggcgaaaccccatctctactaaaaatacagaaattagcagggcctggtggcacatgcctgtaatcccagctacttgggaggctgaggcaggagaatcgcttgaacctgggagacggaggttgcagtgagccaagattgtgctactgcactccagcttgggcaacagagtgagactccttctcaacaaaacaaaacaaaaagaaacaaacatctcagattttatgaagagtatgtattgggtgattctgactcagggtatctagtgaggttgcagtcaagatgttgactgctgagtttacactcatttcaattcttgactgggattggaggatctttgaagctatctcacgtggctgttggcaggagacctcagtttctgaatatgtgactctcttcacagggtagtttgaagtttgagtatcctcacgacatggcagctggattcctgagagagagtgatttgagagagtgacgaagacagaagccccagtgtcttttaagagttagtcatgaaagtacatcattggaagcaagtcattaagtccagtccacactcaaggagaggaaatttagtctccctcttgaagggaggagcattaaataatttatgaacatactttaaaactaccacaaataattgtcaggagaatgaatcttccatgagcttcttatttcttttgtttgagatggagtcctgctctttcacccaggcaggagtgcagtggcgcagtctgggctcactgcagcctccacctcccgggttcaagcgattcttctgcctcagcctcctgagtagctgggattacaggcacatggccaccatgcctggctaatttttgtatttttagtagagacggggtttcaccatgttggccaaactggtctcaaactcctgacctcaagtgatctgcctgtctcagcctcccaaagtgctggggttacaggcatgagccactgcatccagccgagactcttatttcatatacaccctgttgagtgtgccaggaatgcaagcaaggccttgactgttcctaggccaggccatttttcaggattgtgtttgcagcgggccactttgcgggaggaggtaatgtcttccattgggacaaagagcaggcctacttactacttactataaaagtggtggattccggccgggcgcggtggctcatgcctgtaatcccagcactttgggaggccgaggtgggcggtcaggagatcgagaccatcctggctaacatggtgaaaccccgtatctactaaaaatacaaaaaattagccgggcgtggtggcacgcacctgtagtcccagctactcgggaggctgaggcagaagaatggcatgaacccgggaggcggagcttgcagtgagcccagatcgcaccactgcactccagcctgggcgacagaacaagactccgtctcaaaaaaaaaaaaaaaaagtggtggattccctaagcccaatgttccttagctgtgatgcaaacccactgcctgtgtagcatccatctgagcccctccatgtcaccttatgggacttggggataacagggagacagtgcaaacatgttcatgcttgctgcgctgtgagtaataaaagttctttgtgtttgacccaggagactcatgtattctgtcagtatccatgaaatggtcataggctaatgtattaacctgtaagtagggttaaataaaatcctagttccttcacagttctcaacattacttatgtttactttagtgtgatacactgtgaaaataagctatacattttattttctgttctatttatctgtttattttagagatcctatctctattctcctatagataggatcttgctatgttgtccaggctggtcttgaattcctggactcaagcaatcctacttccttggtctcccaaagtgctgggattacaggcacaggctattgtgcctggccaagaagtacattttatattgtgatccagtatgcacatgtgcatgcatatgcacacctgaaacattgcagaaaacaatactgttatctcttgttgcattacaattacttcagaacttactggatttgaaaaacaaacatctcagatttcatgaagagtgtgttgggtgattctggctcagggtatgtagtgattttatttcatttaaaacaaacaagaaaacaagcttggttgcagcttatcaagctgatttcacaacctactattgggtcataattctaagtttgaaaaacactgactggggactgttaccgtttggctgtgtccccagcaatctcatcttgaattgtagttcccataatccctacatgttgtggagggacctggtggtagctgaatcgtggggtcggttaccccatgctgttctgatagtgagtgctcacgagatcgattttattttttcttttttgagacagagtcttgctctgtcacccaggcttgagtgcagtggcataatcttgggtcactgaaacctttgcctcctgggttcaagtgagcacgtctgggtaatatttgtatttttagtagagatagggtttcaccatgttggccaggctggtcttgaactcctgacctcaagtgatccactgaccttggcctcccaaagtgttgggattacaggcgttagccaccgcgcccagcctagatctgatggttttgtaaggggctcttccccctttgcttggcacttcttcctgccgccatgtgaagaaggatgtgtttgcttccccttctgccatgattgtaagcttcttgaggcctccccagccctgcagaactgtgagtcaattaaacctctttcttttataaattacccagtcttatgggtagttctacatagagcttgagaatggactaatacaggactctgaggctagaggcaggcagtcaggttagaaagttgttttaattcaggtaggataggatggcataaaccaaggtaataattgtgggaatggaggaagaggatcaatttaagaggtacctagaaatcaaagcaacaggaattgtattgttttgataatatgtgtgtatatggagtatgaagattttgggaggactctcaggctctggcttgagcagctgatgttattcatgtgaatagatgttgtccactaccatgttctttttttgattttttttttttcccctgcagcagcaggtttggttttggaatggggagaccttgatacggagttcagtttgggggcatggtgtatttgaggtgcatgtgaggagtataagtgaagatgtccagaagtgggatacatagttttgattctcaaaggagaagtaaaaaagtactggagaagtagtgaatttggagtctttgttgtacatatgttattttaagctggtggaggcagggagaaaggatttcttaaggatgatattgtagtgtgagaataacatagggatgaagatcagaaacatttaagggaggaacgaacaaagaaggaggagggttagaagaaaagagcatatgatataaagaaaccaagagaggagagtgtcaaaaaattgggagtgcttaagaaacaagatgtattatagacagaagttaaaaaggcattagagaggaaaagtgttcattaactaaggtttctctggagaagccagagggaatggggactaaagtaccctgtggaaggattagctgtagcccacttccatcagaatagaggaagttaaggatggttgttgctgtcaatgaacatgtggagagagaaagttgagatagttcctgtttgatttctttgtttctctcttatgtaggagatgagatacgtaaatttgatagggctgctgtaagaaagtaccatcagctgggcacggtggctcacgcctgtaatcccagtactttgggaggctgaggcaggcgaatccgttgggcccaggagttcgagaccagactgggcaacatggtgaaaccccacctctaccaaaaatacaaaaattagctgggtgtgctgatgctcgcctgtagtctcagctactcgggtggctgaggtgggagaagtgcttgagcctgggaggttgaggccacggtgagctgtgattgtaccactgcactccagcctgggtgacagaggagaccttgtctcaacaaacaaaaacacaaaacatctcccgcctctccaccccgctccccccacaggtttgaaaccacctgcctgttatttcaaaccacctgtgtgttcacatttttgaggacttttaacctgtttgaccagaatagatactgtctttagaatctcatttttgacaatatgatttacttggtactgttttcaatgaagaaacacttataagaatcaatttacataacaatggattttgggaaaatattgtttaatatgctgaagcctgttgttacttgacctaagccaatgctttgaaatgatgctaggaaatcagagagatctagtttagatctatattgtctttgaaagaagtctataaagttgatagctatagtttagtgggttctgcatccacagctcaaaccacctgtggaccaaaaatatttgggaaagaatcttaaagtcaccttgaaaaaaaaagtggaaaaaaaaaaaaaaagaaaatacttgggaaaaaataatacaacatggaaaaataatacaaataaaaaacacaataagtataacaacgatttacatagcatctacattttattaagtattataagtaatttagagatgatttaaagtatgctggaggatatccataggttttatgcaattactgtgtcattttgaatcagggacttgagcatcctgggatttttgttgtctggggcagtcttggatatctggatacgttctactggagccagtccccagcagataccaagggacaactgcctgtggttttaaaatttgttttagttatacttgtagagtatgaacatgttttcttttttgaaaaaaaaattcaggtgctttatggtagtttgagtgtaaagctttctaagttgagctaaagcctccacaaacatttttcccctttataacacaagtttccttccctctaattatcgctgtttcaaaattggcatttcccgtgtaggaattctttacatactctgtttacagatcattatacttatgttcactgtatttttcacctagcttttggtttatcttttaattttatttacagcattttttggtataatactttgtcattttgacataattaagtgtgttggttgtttttctttatggtttttgcttctggttttttatttaagaagccttttcctaactcaagttcacaaggatattcttcaaaattttcttctagtacttttaatggcttaaaaaatttatatctttaatgtatatggaatttattttggtgtactatgtgaagacgagtatacgttatgtttctcaaagagcaacaagtatttaaacttcatttattgagtgatttttcatttcctcactgtattagtctgttctcatgttgctaatacagacatacccgagactaggtaatttaaaaaggaaagtttttttttttttttttttttgagacggagtctcgctcttgtcacccaggctggagtgcagtggcgcgatctcggctcactgcaatgtctgccgcctgggttcaagcttcttatgcctcagcctcctgagtggctgggattacaggcacctgccaccatgcttggttaatttttgtacttttagtgagattgggttttgccgtgttggtcaggctggtctcgaactcttgatgtcaggtgatccacccgccttggtctcccaaattgctggaattacagatgtaagccactgcaccctgccaggaaagaggtttaatggactctcagttccacatggctggggagacctcacaatcatggcagaaggcgaatgaggagcaaaattatgtcttacatggcgacaggcaagagaacttgtgcaggggaactccaatttataaaactatcagatcccatgagacgcactcactaccaccagaacagtagaggggaaactgcgcccatgattcagttaagtacacctggccccacccttgatacatgaagatgattgcaattcaaggtgagatttgagtggggacacagccaaaccatatcactcactgtttggaaacgttacttttaacatatattaaattcccatatataatttagaccctgttcttgggctagtactatacagttttcgttattatagttttacaaggctacaatactttgtaagaaaccttgcaggtcagatgtggttttgttgtcaggaattttttccagtaatacttagtggacattatgtagtatccagtaatcacacacattgttttcttaatgaaatatatgaagtcacactatgtgggatacatataaacagtaagtaagctcagatcaggtcaaggtttgctgctagatgagttaaaaggaaaatcttattttcagaggtttttggatttttgcagtacaaatgaagaattatggatttgtaatttatgttgctgttgagggctgtcttccttccttgttcatctattttaaattgtttggttactcttgtatctttactctccatttgaattttagagtcagcttgttgagttacttgaaaaatccttcaacacctgtgaaaggaagggatctatagctggttagcaaaatcctgtagagatttttcactgggattgtgctaagtagttggggaagaactaaatcttagcagtgtttgtcttctcatccatgaacacagataactttgtttaggtgttctttcatgtctttcagtaaaatgttatagtttttttcccccaaaattcttgcacatttctgttgatttacatcaaagtacttttatggttttgttgctgttgtgaatgggatttaaaatttcctttaaattaaaaactgcattttctagttgttactactgatgtatacattgatacttatatattgatattgagtttgaccagtttgttgagttctgttattctaataacttgtcagttgattatcttgggttttcagttagcaagtcagatattcagacattgagtttaatcttttccttgtcaatctttatacttcttgtttttttttctttttcttttttgtagacagggtcttgctatgtatcccaggttggtcttgaactcctggcctcaagcgatcttcctaccttggcctcccagagcgctgggattataggcatgagccattgcacttggcactttttttgtttgttttccagttgcatggtatgttttcagcgttcagttttgagacatctaaaatatctctaaaatattgtttactatgagtacattatgctgtaatcacattctgaatgcgtgagtacatacatggtagaagggctagatcttctttaagtgggggtaatggaaagtctctgagaagggaaatatttattattggaggatttaatgtgtgatcttttcattacagatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccaggtaagttctacgtgtgtttacctttattggctgaattcatgtatataaatgaaatagcctttttttcccctttcctagatttttcccttcgtagtatatgtatcttcctttttcctattgattttactgttttgtgtcctccatttctcagccctttccaaatttggtcctgtaccctgttttcttctagctgcccatgtctccttgctcccattcttgcttggttcttttctctggtttctctttctcttcgtgtctttcctttcagcatatgttatcttttttttttttttccaattcttctgagagtataattttgccacactctctaatatctattaccaaatgtattttagagtaggtaacttaaatgtaaggtataccattaagatttgtcataatgtcaaaaagtcattcttaaaaacaaaacaaaatgactatcacaggataagtcagtgttgtcagctgagaacagaaattacttttaaaaagttaatgttggccgggtgcaatggctcacacctgtaatcccagcacttgggaggccgaggtgggcggatcattgaggtcaggagttcgagaccagcctggcgacgtggtgaaaccctgactctactaaaaatacaaaaattagccaggtgtgatggcgtgtgcctgtaatcccagcttctaaggaggctgaggcaggagaatcacgtaaacctgggaggcggaggttgcagtgagctgagatcccgccactgcactccagtctggagtgagactctgtctcaaaaaagaaaaaaaagttaatgttgatgatgtatttattaagtacaaacaataagtacctgttctttttgttgccattcatggaagtttaacttcaggatgcttttgtagcttttcgttctgtaattctttacatttaaggtggaggaaaggcaacttggtgtgattgtttacttgtagaaaataaatgagatgactgggcattataattatgggctttgcaatttgagagctaagtgctgtcacattagctacaggaaatattcacttatttttctgtgctcctccaggttatagttgatgtttgatgatagccatgccacattcagtgaggaagctgatgactccaaagatgtgaacaaatcatattcaggctctactagttaaaatgttaaacatactttttttttttttttttttttgagacggagtcttgctctgtctcccaggctgaagtacagtgacgcaatctcagttcgctgcaacctccacctcccaggttcaagtgattctcctgtctcagcctcctgagtagctgggattacaggtgcccgccaccacgcctggctaatatttgtatttttagtagagacggggtttcaccgtgttggccaggctggtctcaaactcctgacctcaggtggtccacctgccttggcctcccgaagtgctgggattataggcgcgagccaccgccaggcccatactttttgtttaaaagacttttagaatttttctcttttcacatttttttcccccatggcccaagttgtctgtacttttagaagttttcttaaacttgcaagcttgagtttttttcctccttaaaaaagctgtcttatactcttaaaggagaatatgtaattagctacctcattgttggtattacactttatttttggattaggttaataaaaattataaagaaagcaactgatatcaatttctgcagtgttcttaaatgatactaagaagtaaagaagcaatcagaaatgatctgtgtctctgatgaagaagtcatctgccacacaaagatgtttaggtcaatgatggacctcatgtatcactgtggtcccataagattacaatatagtgttagccaggtgtggtagctcgcacctgtactcccagcactttgtgaggctgagagggtgcggattggttaaggccaggagtttgagactagcctgggcaaaatggtgaaaccctgtctttgcaaaaaaatagaaaaaaaattagcagggttttgtgatggacgcctgtactacttgggagactgaggcaggaggatcacctgagcctgggaggtcgaggccacagtcagccgagattgggccactgtactccagcctgggtgagagtgagaccctgtctctaaaaacaaaacaaaaaacaaagattataatacagtgttttcactgtatcttttctatgcttagatgtgtttagatacacagatatttaccattgtgttacagttgcctacagtattcaatacagtaacatgctgtacaggtttgtagcctagaagcagtaggctatatcctatatcctaggtgtgtggtaggccgtaccaggtggatttgtataagtccacttgatgatctttgcacagtgatgaaatcgcctttctcagaacatatctctgtcattaagcaacatatgactgtaaatctaatttaagatttcggttgattgtcttaccattcttactattatgcagtccagatattcagatctactgttttggctacttgaagatctctagttacattacattttgtatgttaaagctccagacacattttcagctataaaaatagctcaatttttctgttcataaatataaaacagaaaagcatagatatgaaagcaaaatatattccagatcctcccatctactgacaactttgctattccactgttaacattttgacatttctctttactgaaatatctctatgcatatacacgtaacggatttacctgaatggaatactgttggtattatgctgtgaccttcttttagctaacaacatttctactgtatattagaggcctctaatatatatctaaatcgttatttttaatgcctcctaccattctattgtatctattctagttaatatcacagggccaaaattcttcagatttacttggtagtacaacgcaaattaaaaaccttgaattcatttgaatcagatttctaagtaattagaaattatgataattttattctttctcagatacattataacttcaaactactttgcttttactttttaatcaattattaagttgtcactactcaaaatttgaatgttttaatatacttaaatctctttcttagagacttagcttctttaaagaagagaaattgtcctttaaaaaatattccttagaaagttctttgagtttgagtcattaagactttaagaatgtgtaaagaaagaaaaaaagctaaaatagaccccactgatggggtctaaaattaaggacagggttcttaaatgctggctcagaaacatcagcatcaacaggcatatttggttaaaacatagattgccaggcctcccttcataccagctaagtacaatctctggagatggggtccaggaacttatgtttcgaacaagcttctctggtggttctgatgagaaaccactcttgggatctttagaatttagtaaatctaatctaattcttttttttttttttttgagatggagtctcgctctgtagcccaggctggagtgcagcgatgcgatcttggctcactgcaacctctgcctcctgggtcctggttcaagcagttctcctgcctcagcctccttagtagctgggattacaggtgccccccaccacacctggctaatttttgtattttagtaaagatgaggtttcaccatgttggccaggctggtcttgaactcctgacctcgtgatccgcctgccttggcctcccaaagtgctgggattataggcaggagccactgcgccgggtgtaaatctaagtcttaaacttgtctgttgcctgtttgtcaatttgtgatggttctgttgtggcacttttgagctcaaccatgaaaggaaaagaaacaagggaccatttgctcagtgtgtctcatcctttattctaccactttatatctcagggatgtgacctactcttgttcgtaatgatcattaactgtgacagggaccctcagtggatggggcatgtgtaggggaaaagggtgtttaaaattttagatatgtttagttacaaagagccctccaggtgattttgatgtctcttcaccttgtgaatcattgatgcaccagataaatgttcaaatgatatatgacagcagagcagagaagtacattttcttcagttgacatttttgagttgtcagtacaatactgactttagtttttaatttgcattgcactaccaagtaaattagttgaatttgtcagttgaagtacaacaccaaaaagaataattcctaaatataaaatgatagtacattctcaggtttttttttttaattgttgttgttttgagacagagcctctctatgtcacccaggctggagtgcagtggcgtaaccttggctcactgcaacctccatctccagggttcaagtgactctcctgtctcagcctctggagtagctgggattacaggtgtgtgccaccatgcctggctaattttttttttttttgaaacaagagtctcgctctgttgctcaggctggagtgtggtggcgtgatctcggctcactgcaagctccacctcccgggttaatgccattctcctgcctcagcctcctgagtagctgggactacaggcgcctgccaccacgcccagctaattttttgtattttcagtagagatggagtttcactgtgttagccaggatggtctcaatttcctgacctcatgatccgcccacctcagcctcccaaagtgctgggattataggtatgagccaccgtgcctggccaattttttgtatttttagtagagacgagtttcaccacattgaccagactggtcttgaactctcaacctcaggtaatccacctgccttggcctcccaaagtgttgggatcacagtcatgagccaccgcacccagcctttttttttttttgagctggagtctcagtgttgcccaggctggagcgcaatggcacaatctcggcttactggaagctctgcctcccgggttcaagcgattcttctgcctcaccctcccgagtggccaggattacaggcgtgtgccaccatgcccggctaatttttgtatttttttttttgagacggagtcttgctctgtcgccagctggagtgcagtgacacgatctcagctcactgcaacctccgcctcctgagttcaagcgattctcctgcctcagcctcccaagtagctgggatttcaggcatgtgccaccacgcctggctaattttttgtattttagtagagacgggattttgccattttggccaggctggtctcgaactcctgacctcaggtgatctgcccgcctcaacctcccaaagtgttgggattacaggcatgagtcaccatgcccagcttaaattctgtttttatagtttggtattgaattgtaaatatcaggagaaaaaaatgagtttgctttctttagttttgtggttaagtatcaatataacctaggtcttggaaactgtatctgtatttttaggggttgtattgggttctttttctttttcttggtaaaaatgagattggtaaatttggagtatgtaatggtgtatactagtgcccaaatatgagattctttatatgtatttagataattatcatagtgtatcatatttgaatattatacaatttcaaatgtattgttaataaaaaatcacagtttgatttaattgaaaagtggctgagacataattttttattataagaaatattgtgagctgggtatggtaatatatgcatgtagtcttagctactcaggaggctgaggcaggagaatccctcgagtccaggagtttgagtccagcctgggcaacatagtgagaccttgtctcttaaaaataaataaaaaaataaataaaaatttaaaataattaagaaatattgtggaaaaattgcatgtgaataaacacttctttttaaaggctctacttttcaagaatggattgacagtatatgtgtgtgtcagattatacgtgtgtgtgtgtatcaaatttagagtagatttgaagttactggatttatcaccattatacctggaattagctagtcaccgttataccttgttgatgatgctgaaactatgcccctcactaagatagtttttattatgaagtgactcagaaatgtcaattttaatgaaaaaagttattggcgtacttgttcattttggaataattgaagcaattgtttatgcctgtacttcagaagctgtgtggaaaatacgtaatatcctttctaagtatcagtctgcattcaaagacaaaatatttgaatcttctgaatacttcagttccagtgaaacagtccacaggattttcatgccaaaaaacccatatgtgctgaagaatggtgaacaccgccttatctagattccaccccttgccctaattaaacaccagtgctggcagcgatgcattctccgtatacccactgtaattactacacaatcctaaaattgtataactttggtccaaaaaacgaagggtgcaattttaaagtaaagtgaaacactgcaatgagatacagagacagagaatgctaattaatagattatagtcagccagcagtggggcctaattaaactctgcattcattataccctccatagccctcagaggtcaggcatcttccacttgataaagaagattggtttaataggatttacagtaattaaatggtttccccatttcagtttgagactggggatttaggtccattctaaatattggatctgattggaccatagagatcttgttctaggatcctattagatgtaaagacgcatttgcttagaattacttgatatgtgtggttctttattatggagttcttttagaagatgtttctgatataaatactcagcaatttttatgtctcatccttttgttactgaactttcaaatactgctggttggagagttagaatagtatgtaacagggaaggctttttctttttcttttttaaaattgggagtcaggaaggtttttggtgtatgtttgacaaagaatgaaaatctagctgtgagcttggtggaactgcagagctactaagactttggatggggccgggctcagtggctcatgcctataatcccagcactttgggaggctgaggtgggcggatcacgaggtcaggagatcgagaccatcctggctaacacggtgaaaccccgtctctactaaaaatacaaaaaattagctgagtgtggtggcgggcacctgtagtcccagctactcgggaggctgaggcaggagaatggcgtgaacccgagaggcggagcttgcagtgagctgagatcgcaccactgcactccagcctgggagacagagcatgactccgtctcagaaaaaaaaaaatactttggatgattttttttttaaattctaaacagcatttaaccagattatcatcatactttttaaattatgccttgaaataattctgtatgttaaatttagttggaagcttattttaaaaatgtttatttaaagcactgtcattgaaatatttcatgaacaaaatactgtttaatattataggacggcaggtgaatttaatgttttttgccttgtgtgttgtgtttcttctctttttggagtctgatttttatgttgctcatttacttaggaatcgagaatttctagttcagaactgcaaaaagataaccttgtgtaattctttgtcatttttttttctcattatttggagacttttgactattaacatttatataattttaggttgtatcttgatttgccgcatgataaaagccattattatttgccattaaataaactttttttttttttttttgagacagagttttgctcttgttgcccagcctggagtgcaatggtgcgatctcggctcagtgcagcctccacctcccaggttcaagtgattctcctgcctcagcctcctgagtagctggaactgcaggtgcacgccaccacgcccggctaattttttgtatttttagtagagatggtgtttcgccatgttgggcaggctggtctcaaactcctggcctcaggtgatctgtcaacctcggcctcccaaagtgttgggattacaggtgtgagccactgctcctggccttaaataaactttgtcatgaggttgctagttgtttcactgtcatttaaagtctgatcttaaaatttgggatctatgtcttagattattgttttaattttctttttgataattctgttttaacaaggagatgtagataaattggtatccttgtttattgcccagataagtttaatcttttttgttgtttcagaaggggaatgtgttaaaggcactatgcagagtgccatgagaaaatgaaatcaaatgtaaaatggataatgttccttttggggagttaacaatcatttcgagaagcaaaatttgtacatgtatggcttacagaaatttgaactatgcatttatcaggtcttgatcataggtgaaggtatttaaatcagtgtgggaaatttgcttcttttacagttggtaagtttgcttatctggaatgtagtgaagtatgaaaaataattaagcagagctaataaaaatgttgcacaaatatgagatagggcttatatgaagaaataagggcagagtttgccagataattgcagtttctctctcactttttattttcctctgtctttttggatctcatagtgcagtgtagtgtgtgatctcatctcagtgaaataaaattgtttttagagatttgctaatttacagcaaatttgcagatagcatcttaaatataatttgggggtcctctttattgtgcaaaagaaatcagaaaatgggtttagtttttagttacattaatgttaatcagtggaggtcatagtttcattttttaacatttaaaaccgtaccaccctctggaacttgccatctgttatgagtgcactgttatgcccagaagagtataggaggtgcttagaaaccatactttataagaaatggctgaaggaactcaagaagagaagacttgcaacattttaattatactcttaagtatttggtggacagccatgttgaaggagatttttccttttttctttctttgttagtattgtttttggagaacaaacactggaaaaatgagcacaaatattaaggttttaaattttggctgcaaggaggaatggatttttgaaaaaagctatatccggcctggcgcagtggctcacgtttgtaagcccagcactttgggaggccgaggcgggcagatcatgaggtcaggagatccagagcatcctggctaacatggtgaaaccctgtctctactaaaaatgcaaaaaattagctgggcttggtggcgggcacctatagtcccagctactcgggaggctgaggcaggagaatagcgtgaacccgggaggcggctcttgcagtgagcccgagattgcgccactgcactccagcctgggcgacagagcaagactccgtctcaaaaaaaaaaaaagaaaaagaaaaaaactatttccatttgatgaaagaacagtttcacaaagtaatgcttcatcatcactagaagtggtcactgggaggtcagattgccttctgacagctgcgtgggtgccctaagtcattgaactcttcacaacgcccaagggggtatggcatcaagtggtactttgtggagaaacatttagggagtttaccccatcctcccaggtccttttgtcctttttctccctccccatctcctttccttcttttatgacaattttgttgagatataattgaattcaccctttaaagtatagttttttctttttttttttgagacggagtctcgctctgttgcccaggctggagtgcagtggtgggatctcggctcactgcaacctccgcctcccaggttcaagcagttctctgcctcagcctcccaagcagctgggattacaggcacacgccaccatgccctgctaatttttgtatttttagtagagacagggtttcaccatcttggccagactggtcttgaattcctgacctggtgatctacctgcttcggcctcccaaagtgctaagattacaggcgtgagccactgtgcccagccttttctttcctaatctgatttactcaatgaagattttgaagaaagtaatagtaagttgccctagggagttcttgaacgagggcataaatgatgtaataaaaaatactgttcaggagcagcttttactgctgtcagcagagtggattgaagaaaaggtggggaaaggaaatgagtttcttgtagaagacctggattaaacagggtaataggaatggagaagaaggtgcacatccatgagattttcaaagaaatatttggatataggcagggaacgatggctcgtgcctgtagtcccagcactttgggaggccaaggtgggcaggttacttgagcccaggagttcaagaccagcctcggcaaaatagtgagaccccatctcttaaaaaacaaaattagggccaggcacggtggctcacgcctgtaatcccagcactttgggaggccgaggctggcggatcacgaggtcaggagatcgagaccatcctggctaacatggtgaaaccctgtctctactaaaaatacaaaaaaattagctgggcgtggtggtgggcgcctgtagtcccagctactcgggaggctgaggcaggagaatggcgtgaacccgggaggcggagtttgcagtcagccgaaatcgcaccactgcactccagccctgggtgacagagcgagacgttgtctcaaaaaaaaaaaaaaataaaaataaataaataaataaataaaaaattagctggcatggtggtatgtgcctgtagccccagctacttgggaggctagggcaggaggatagtttgaccgcaggaggtggaagctgcagtgagctgtgagtgcactactgcacttccacctgggtgacagagcaagagtctgtcaaaaaaaaaaagaaagaaaagaaatatttggatatagacggcaagagagaagaatacagtgaaccatggtattgagattggggaactcttttccctacgattaacaacggaaatggattagaaagtggaactaaatttagagtaaggaatgatgaatttggttttaattatttgaataaaagtttttcataagaatttggagataagagactaatgactgtgacctcaggtacatgcatatagatgttataaaggtgtgcttgttaatgttggggaactcacttttctagttaattcagtatcagctacatgcctctgcttatgggagtaagaagtggagagggagaagccattagaagatacagttttatatatatgttctcatccagctcgatttgtgttttggttctctgtctttattgtggtatttttgtttgacagcagataccttgagtgattctctcaattcctgaaagttattatttattaaagttaatactgatttatgatttttttacaaacttctactattagatgtcccttattttgttttagttaacaacaagtttattggagatcatgtacctacctctgttgtgataaattaggagtgactttgggaaaaagagaaatattacaaaaaatgtgctttcagtgaggaaatgataaattttgtttttgaaaatgttcttttcttcccttatggacaagattagaaatgcttttatgaactgtttttgtgctaccatacacatttctaaaaatactcatttttctttttctttttttcttttttctttttttttttttttgagacggagtctcgctctgtcaaccaggctggagtgcagtggcgcaatactccgcctcccgagttcatgtcattctcctgcctcagcctcccgagtagctgagactacaggcacccaccaccatgcccggctaattttttgtatttttagtggagacgggatttcaccgtgttagccgggatggtctccatctcctgacctcgtgatccgcccacctaggcctcccaaagtgctgggtttacaggcgtgagccaccgtgcccggcctaaaaatactcatttttctttccagatttggaaagttagtctttaacgtagatcttttcctttgatttttccatatattaacaatacttactgaaccctttccccctttattttgccagtcttttctacgtaataggctttccttcctaatactggattgcagtgacacttgcttaatttcatatgtggtgactgtataggccgagaaagtgagatagttcagccttaatgtacacagtgtaccatctcttaccggtggctggtagcttatgtactttcagagaatgtggtatgcaaagatctgtgtagctttgaagtcatcctgagataactgctctgatcttaaatgatcctcagatacttgaagagtcctctgtagcagtaattcttaaacttgttggccacaggacctctgtatattgtaaaaattattaaggaccccaagcagcttttgtttatgtaggttatatctaccaatatttgtcatattagatactaaaataaaaaaataatatttattagtacatttagaaacaataaacctaataaatgttatcataagtaacgttttaaaatgaaaaacagttttgcaagtctctctttctttttttttttttttgagacagagcctttgcactgtttcctagactggagtgcagtggcatgatcttggctcactgcagcctccgcctcccgggttcaagtgattctcctgcctcagcctcccaagtaggtgggactacaggcatctgccaccatgcctggctacttttgtatttttagtagagacagggttttgccatgttggccaggctggtctggaactcctgacctcaggtgatccacctgcctcagcctcccaaagtgctgggattacaggcgtgagccaccgtacccagcctagttttgcatgtctctctaaggaaaggaggactacaaatctaaaggccttatgtgggtcttctgcctcttgtaagaggctgccactagagtgctcactaggtcactctttagctgagatctctgttacttgttcagtattgtaataaaatattatgacctgtgacatcaacatggattaacaagtatctggcttcttggtcaagggttaggaagttacactgttctttagtaacagtgagcaatgggaaaatgctgtgagtaatggtgaggaatggtaactttgttgatttgttgttgatagcatgtatttcttgacccttagagaggttctttgggtgggctgtcttaaggaagcccttatattgtagttggctaaccaacaggcctgcgccatcacacccagctaatttttgtatttttagtagagacggggtgttgccatggtggccaggctggtctcaatctccagacctcagatgatccacccgccttggcctcccaaagtgctggcattacaggtgtgagccactgcatctggcctaccagtactagagtctggctctgttgcccaggctggagtgtgcagtggtgtgatctccgctcattgcacgctccgcttcccaggttcacgccattctcctgcctcagcctcccgagtagctgggactacaggcacctaccaccgcgcccagctatttttttgtatttttagtagagacggggtttcaccgtgttagctaggatggtcttaacctccagacctggtgatctgcccgcctcagcttcccgaagtgctgggattacagatgtgagccattgcgcccggcctgttttttttttttttttttctttttttgaaatggagtttagctctgttgcccagatggagtgcagtgacacgatcttggctcactgtaacctccacctcccgggttcaaccggttctcttgcttcagcctccagagtagctgggattacaggcacctgccactatgctcacctaattttggaatttttagtagagacagggtttcactatgccaggtctcaaactcctgaacccaagtgatccacccaccttggcctcccaaagtgctgggattacaggtgtgagccaccgcactcggcctagtatttttaatttttttttttttaaacccagttgcattgtatttatgtgataaacctacagcatttgttgtatttcaaagaagcatttttgggaactaagtttgttttataggacttaaaatttgaaaaattgggagaatacattcaaaaaatgttcttttgattatctttcatggatttgatagcctgcataataagtaatttcttcttttcacatgactcctcttcctgggcataggaacttaaagtaggtactacattcttaggagagaagcatattgtaatgagtgtttccagtctttcctgtcttgtaattttaggagggtctatttcttatttttctatgaaaacatgttatctatggtacagagtatcttctttttctttctttttcttttcttttcttttcttttttttttttttagacagagccttgctctctcgcccaggctggagtgcagtggcgcgatcttggctgattgcaacctttgcctcccgggtctaagcgattctcctacctcagtctcccaagtagcagggactacagacgcctgctaccacgcctggctaatttttgtattttttagtagagacagggtttcaccatattggtcaggctggtctcgaactcctgaccttgtgatctgcctgccttggcctcccaaagtgctgagattacaggcatgagccactgcgcccggcctgtacagagtattttcaagagatgaagcaggtaaaaggttatttacttaaatggtagcagataaatttttggatttctcttggtatttctgatgaaagatacttattttaaagggatagtgtattgggtctcaattgttggaaagttgtgggaacactggctgttagaataactgggggcagaaggtgtttctaggatttagggtggagaggtcttaaagttaccacattcccctcactgcttaggacaggtctgcatactgaaaagctttccctcataccatatgattttcatatgtcttgctaggaatttgataggtgaaaaaaatctgcttatagtcatttgagccaagatcctataactaaataaatgtgtgtaagtgcattagcattgtttgactgaggacgaagttgatagaagattatacttcgttttgtttgtaactttacctagaacttttgccattttggaaaagcacttcaacagcaacattgcattgttgctaatgctactgtctctttagcttctgtttgcatagtcttttggtgtagttgtgccctggcatttacatgttaacatacatactattttattataaattctttcttttcatttttccttcatacagcattatataatttttttttgaaaccgtatgtgggagtgggcttattatctgtgcatttcaggatagtgaagggcatatttacaaaatgtttgttataaaatgggagagtattaagtctgataagcctgaaattcactggtgtcatagatggaacactgaatcaggagagctgcattctagttctgatcctggctttgccaggtgtgtagccatggcagtatttaagcgttttgaatgccagtttcctcatctttaaaacccatagagttggactaggtgatctttagagtctttcttctgaaattacttgattttgtttttgtcagttatcctagtggaattctctaagagtctgttcactttgatcataatgcccaaattcaaaactgattcatatgaccaagttgagtgcttctgggaaggagaaatacatgactaatgaagttcttttcaaggtagatgggagaaaatcagtgtttacatctaaagggcaaagagccttcatgtgaatttcatcagttgacaaatggggatcataatacttgtattgttgttggaatatttaagtgagattaaagaagataatatttataaattatggacaagactacctgacataataggtatgcagataaaagttgaattaaaattaagtcaaacatttcttaaatacaaatacattttataatatattttgaagtatgaaatatacctttcatgatctgctaccagaggcaaacagtagcatgggacctataaaatttttttagaaagtgggtcacagtggataataagtttcatttggataactaatcactaccagcccagccttaatattcctgtaggagttatcaggaactttgagtagagtaattagctctcaggattttcagttacagtcatattcattatttaacatttttatttccacaatgactcatccatgaattatggagtgctttcccaaaaggaatgtagtattgctggaaatgaattttttattgctctattttctttctttggtaaggggttccttgttggttagttgggcccaaaactctccacaaataatttaaaatacgtgcttttgtatgaagatgacttaacaaggcagtggagatttctcttgaatgggcaacatagaatgcttaaattttcttattctgcttattttaaattattaatttttgtactgtggtcctgtactgtgctttttaaattcttacatgataagtgtatgtcactaaaaggtatactttgctcacaatttccctattatttactccactgacattaaaattgtagcattacatctgaggttccctttggtttttatgtatcatttgctgttgtatcctttaaaaaatagtgtaatagatttgtcagtgaaaatgatgtcttactgtgatgctgttatcaaaggcatctctgagtacctatgatagagaactagtgaaggggttaatatctattgtagatatagatgctaatatatctagactcttatagatgctagtaattattatagaacatttatagataccatcctagatgctttcatatacattgcttctaatccttactaacagttctgtaggtaagcaatgttgtcctcatttataggtgaggaaattgaaaattaagagaggaatttgttcaggtttcacatctagcaagtgacagatattggtccgtctggctacaaagccaaatgtcattgtgtttttgactaaggacaaatgaatgaagtgtacatactagtttaaaatatttattgaaaaattaatattcagtcatttattaaatgtaaaagatggcattaaaattcctctgtgttttgttggaggaggaaatacaagaataggtgtatcataggatccaaaggctcctgagaaggggttaacattgagagaaggggtagagaaaagagataataggtgatcagttgagaagatgataaatataatttgattactttaaataatcagtcaacatcagcaggtgtaaatgacatacatcagtacttttcttgttttgattaggcaggaagcagtagagtaatgattcccagacttgcattttgcacactagcaaaataaaatataaataacagaaaaaaagtgggggagactggcataggattgtcaaataaaaacaattaaaaagtgatacatgactacatagtattactgttgttttataaggggaaggtcaatctaacaccaaaggaattgtgcatcattccacaataagagacagttctttcaagaaaatacagattttaactttgtagtgacagttttattaaggcaacttggtcatggactggctttgagaaacattagtttataatagggaacaccacattatagccaaatccttcctacaggagttgtacatcctataagcaaagaatggcttttacatttttaaatgattaaaaaattaatatattgtgatatgtgaaaattatatgaaattcaaaattcagtgtgcataaataaagttttattgggacacagctatgtttatttttgtattatatatggctgctttcacaccagtggtagatagagtagttgtgatagagtctatatgacttactagacctgaaatacagtgtctactctctggccttttacaaagtttttcaatactttgtttggataacagagtaaataataatagctaacacttgtgtagtgtttactaagaaacaggccctgttttatgtgctctatgttattaaccatcataacaattttatgaggtaggtactgtttattgaagtggaaactgaggctgagagtaagttgcccaaggtcacatggctgttaggtggcagaggcagccttctgcctagatggtgccactccacggtacatgcttcatcactgcacttggctagcagagaaggaaatcagagacttcaggatgtgacgcacccttcacatttgccgtagttgttttaggaaaagaggaaagtagccttattctatagttgcctgaagtgttatcactgagtagttgaatgaagaattcagcattaattacttcatgatgcatgaacatttggtgtatttttatgtgacccagtggattttccccagaggtctgttgattgaaatgtcctacttattgatgtcctacttattgaacttttgaacaaataaatctgttatttctgaactattgagttcatttttggtataattagaataataaattacactattaacttggtggagggtaactgtttctctatcataaatatttatcgtgttgttcttaaggagcataaggcataagccccccgtcattgatttaatttaaaaataaaacatttattgacacatacagaaatattttaattaaaaattgttaaatggcttttttaatgtctatatatattctaccccccaccccccaaaaaaagccattgtatgccaaagcccgaaagaagaattacattaccagtagttggatttttggctgaatctattcaaggggaaatcactattttcgttttagagatggctttgggtggaggaggtaaggtttcaagaactggttgaatgaaagaatattgacaagtaagtgaataaactagaattagtgtgaccacttctgatttctcaaataatgtgtttacaaacagtgttcctacattgtaatggcagtataaaatgctgatttaaataaatagaagtttagtggctacactttttcttagttaaacctcactatattctggatttaaaaatgacagtaactaatgttagttttgtgctcctctgaaggttagaaacctgttatatgtgtctaaaacgggttttaatgggtttaagaccacagagaagataggactgacactttagtaagattctttttttcaatctatttaattgttctatgattttaccttattcaaggtgatggagggtgaattagggtgggtaaagggtagggggaattgagacagtggttaaggttgatttttgacttgtagttcgctttcatctttaaattgtggaagtcgccttcctttgttcattttgaagttttgggcaaaatgttctcaggctagatgcaggtaatgcaggtaacagcggccagcacttcccatactagagggcgttgactttctcaaagtgttgactcgtttgtgatgtttttgcatttgtttggtttctgtttgctgctatgttgttgctcttcccagtatgggatagggttatggtattagtagaattacagtgttagtggtttttcttcctcttcccattccatccataaccttgacactcataattttgaaacctatcgttcattacaagggttaaaatctaaaatgtgactgtgcaggttgagatggcatgttacagctcctgccacctctttttcttgtgacagatggcttcccctcctggttgtaatccactgctgatttttttcaaagagcgaataccatgtgttccccattttggctctggttgtgttctgcccactcattggcttcagaggatcttgaaacaggaggtacttgctgctggcatttatggcaggaagtggatacaattgcgatactttgtgccaagtgttcatttattagaaaaattgtgcttcctaaaattaaacattatttctctgtcacatcaagagtaaagctaaattttattactttttagaatatgcttttcccttaatgttgtattataaaaattttttggtggcaaatttattacaaaatagatttttaaatctgaatttcacatactcaaagatttatagtctgtgcaagacattgaatgagtagctctaattgcactagtataatataattacgaaagggatctgtatcacagagacttctgatcacagaaacagttggaattgtttgtgatgtgtggtattgaacttgtgattgcatatgctttgtggtacctatagacagtagtgtttgtctattttaactctcttgcttcggatctccccttgagtagattcagctaaataagttataaatttcaccatcttaggccttcttgaaaattataagtatctgagacagcttaatttcataaagctactgtgcatatttggaagtatggtgtttggttttttaaaaaaacctggcaggccagagtaagcaaattgtttttttatgtttttgtcaagaaacaccccaagataaatgtaaacaaatatttgcgcattaccgtcattgatactggaatttgacatttctgtcctcagaagtcactgttctgtcagagtctgctgtacttgcctgagtgaatagtgcaggattggcaaaaacgttgcctgctcatggcagatcatctctaaatctctcttgacaacatctctagctgaacccagatcagtgattctcaaccttggctgcatattggtatcactgagaaacttaaaaaacaaacaaaccaaaacctgatgcctgagtctcacccaaaccctcagataatttgatttgattgggcttgggggtggtcttgctgtggagatttaaaaaatctccccaggtcattctaatgtgaagtcaaggttggttgagaaccactggctactacaaatggataagagttggtagtgtgaactgaaatgtatttgccatcctcagtctagtgaggggattttctaaccatgccacaatatataaacaatttgcagtttgaatggatagaggttggttatcattggaatttgaaaggacaaatgacaagtaacatcggatgatttaccagtgttttgtgatcttttttttttttttttttttttaagatggagtctcactcttgttgcccaggctggagtgcaatggtacgatctcagctcactgcaacctccacctcccgggttcaagcgattctcctgtctcagcctcctgatttacaggcatgtgccaccatgcccggctaattttgtatttttagtagagacagggttttaccatgttggccaggctggtctcaaactcctgacctcaggtgatccgcccgcctcggcctcccaaagtgctgggattacaggcgtgagccactgcgcccggccaatgacattttaaaagaattgccttcagagggtagctggaaaagcaaatggatgtgggacaagaggttgttccacaacctcctggggtggggatacccgttctgtgatggcattaaggagaacgagagggctgagaagagagcaaaatgatcagccctggattttgggacttggccaaaaaagaaaggatggaacaggacgtcaggataagatctaagacttgaagcagaaactgtacttcttcctgacccaggaggtgtgagacagggaagtggtggtagcaaacaggatagaatgagaggttcccttttacacccaaacttgttctttgcttagtggcagaaggctcaatttttctttattagagcattttctttattacagcactatgagctttactatatgtgaatcacctgtgagcacttgttaaaatttctggatccctcccaaagtttctggtttaggactgctgggggaaggctcaggaatctgtatttgtgaaggttaactgaaccttttttgtttgcttaccatctattcagtgttttccctattctttgttctatttatttagtaatttaaaaaattgactcattttaaaaaactgaatcttattttaaaatgaaactgtcactactacacgtggaaaacatttgccaaaaaataaaaaatgaaagtgtaaatacataactattaagaaaaaggtcaggccgagcactttgggaggccgaggcgggttgatcacgaggtgaaggaatcgagaccatcctggccaacatggtgaaaccccatctctacaaaaaaatgcaaaaattagctgagcgtggtggcgcgttcctgtagtcccagctactagagaggctgaggcaggagaatcgcttgaacccgggaggcggaagttgcagtgagccgagattgtgccactgcactccagcctggcaacagagtgagactcagtctcaaaaaaaaaagtcatatatgtaccactctgaagattatttttaatatcattttgggaactactagcgattctgatacagatagttttgtcatcatacttggagaaatattgaactagagacaaaaagtttcacttagattgcatgattttcagctactgttgcacacttggaatctggggcatttttaaaatacttttggtcagcccccatcccccgatttaattggtgtgggctacaacctggacatcaggatttttaaaacactctcctaaggtaatcgtaatgtatattctgggttgaggatttagaggttaaaaagcatataatgcagttagactaagaagcataaattcatgaatactaaaatacacttatctcggtataattagaaataaagaagactggctgggcatggtggctcatgcctgtaatcccagtggtttgggaggccgaggcaggaggatcacttgaggcgaggagtttgagaccagcaagggctacatagcaaggcctcgtctctaccccaaaaaaaaaaaaaaaaaaaaaaaaagggcagaagaaaaattagacaggtacagtggtaggtgcctgcaaatcccagctactcaggaggctaaggtgggaggattgctggagtccaggaggttgaggctgcagtgagtcctgatcctgtcactgcactccagcctgggtgacagagcgagaccctgtctcttataacaagaatgaaaaacaccacagtgaccacctgggggatgtgggcagggggagaggaaaagaaggtgaattaataaagcactaaggcaccgtgtccttatgatcgcctctgctcctgcctgcttctcttgttttctgttcttgatgaatagcgtgaattaataaagcactaaggcaccgtgtccttatgatcgcctctgctcctgcctgcttctcttgttttctgttcttgatgaatagtgtgaattaataaagcactaaggcaccgtgtccttatgatcgcctctgctcctgcctgcttctcttgttttctgttcttgatgaatagcaagagcttttaaattgtcagctagtccccaaacgtaagtgtgcatcagaattaactggagggtttgttaaaacacagattgctgggactcatcctcagaatttctgatcgagtaggtctggggtggggcacaagatttaatttcccaggtgatgcttctgctgctggtcagggaacaacacttgaaacactcatctagttaaccaagctgaaaactttaggacattagcctgacatttattgtctctgtgtattttatatatatccagtgaactttaaaaataattacgtaaacacaaacctgtgtttccatcacctagaattagtaaatgttaatgggtgtgtggataaatattaattatgaataaatattgcctttttggtgataataaaccgctgtgttttatttcacacttttgagtacaaggaataaaaaaatacaacttttctgggcttgagataagtgctctttaggttaagctataacaccgaagagaaaatagtgctccattaacttgtttcatcagtcttttaggcaaccaaatgagaaaagcaaagaaaaacagtacagtctagattgtatactccatctgagaaaaaacattaaaaagtattacgtatctgaaaatgaaattgtcggacaggcgcggtggctcatgcctatagtcccagcattttgggaggcggaggagggcggatcacctgaggtcgggagttcaagatcagcctggccaacatggtgaaaccccgtctccactaaaaatacaaaaattagccggacatggtggcaggcgcctgcaatcccagctactcaggaggctgaggcaggagaatttcttgaacccaggaggtggaggttgccgtgagccaagatggtgccgttgcactccagtctgggcaacaagagtgaaactatgtctcgaaaaaaaaaaaaattgtcagctgcaatcattttatcctgtttttctgtttgaatagtttatttgaatagttcatggaattaataagttgaatttatttctatatctagaaacttgggaggggaagggtaaactgttatgtatggtataaaaaatttaaaagtgttgtgaaaatactattttcaattctaaaacgcttgttcaattctaaaatgacttgtttcccctatgcttgatatagatcaagagggaaaaagtattaatgggtattatttattcagcaaacattgagtttacattcaggactgtcaacttgactatggaacaattcaagtagctttcgttagtcttgcctagcttttcgttatgcattaaatatgtgcttcattcaggaggagatcaccccaccccagccaggttagttttgtcaggtagaaataatgctgtttttatattctcatgaagagtgtatgtattttttcatcgtggagctaatgctaggattccctgaacttgctagcttctataaatcctcctcaccattcttcgaagcaagggctttggaaagtatggacttaactgtctcatgaaaatccttgtatagcttcaattgtcctccctcctatttatttttcatgaaattattctcttgacacacttgtttattttctatttagtctttctagactcttctatttgcttccttcttggactatttgttccctcttgctagaactctttatcttcactcattaactaaactttaagaaaagagtccttcccatgtttcctttaacagggaggccagcttgtttttacagctcatataatatatgcaggtagtagaagacagatgaaagcaaatactttgcaaattatggtatgtttgcttcagttttcaaaaagtctgggagcttggtctcttttccctggaaaccacctctgttttgtcttgcagatgagagtgtgatctttaagctagccttgaccttttgggtggtctgtgcttatctttcaagtgtttgcagtaattaggaccagtatatcaaaaaaagcatgctacctatgttatttgtattgtcctgatcttctagattcagaaaaaaagagaggttattatttttataactggatttcctatatttgtggataagaattccaaaactaacaaagagaaaatcatcttgactgttacgtgctgtaaaaatcatgtattcaaagtttgtactatcacaattctggattcatgaggatttgccagacattcaaattaaagcctaatcaataactttcttcttcgtagagggccattctaaggccagtgctttcccagggcctgggtatattatgtagtatgatgaatatcacagagcaattgcccttgtttaggaactgtgtattgggattcctttaagatttttgttttaacatacttacatttcactaggattcttccctaccgcacccccggctctttttaaaaaatttacctagtttgtcccttgcctgtttggctactagatatatttaactgaccttagacagtgctgcaggcagagttcagcatttaggcaaaacggatggcagtgttagctgtttttctcctggcatgtcactgtgcattatctgggatggcatgctttgtgagtatctgtatggtttcccaatgagagaagggaggtctggctgcattcactcgcacaaggtgacctttgtttctacacattctctgctttaacaaagcattgtctaatcagtctgtcaatacatatttattgagtgcctactgtgaatgcccagtagtatgctgtgtactttgagagatttttttcaaaagggggcagggtagaaagaaagagaaatatgcatttgagtttagaataatgttaacatgaaatatgtataccgtgtgtgattttataaacatgaatttctggaggagcagaattctagagtattctggcccacattagcttcaagaatggaattattcttaagagtaaaatcacttaagctagaagttccaggctgctgtgagcagtgcctctacactccagccttggtgacaggagacccctacctaaaacaaaacaaaacaaaacaaaaaaagaatgaactgtttcctcattaaggtgcaacttattcatgtaagagagatgtttaatgttaaggatttcctttcctttccttttttctttcctttttctttcttctttcctttcttttctttgacagagtctcactctatcacccaggctggagtgcagtggcgcgatctctgttcactgcaacctctgcttcccggcttcaagcaattcttgtgcctcagcctccccagtagctgggactacagtcatgtgccactacacccggctaatttttgtatttttagtagagatggggttttgccatgttgcccaggctggtctcgaactcctgacctcaaatgatctgcccacctcagcctcccaaggtgctgggattacaggcgtgaaccaccatacttggcctgttaaggatttctttaaatgtggtatttgatatataggcttacacaattagtatatcttaaattatgtaatgaatttcccacaatctcagcatttaaaaaaatgtttggaataggaagatgctcataatattttaggggaaatacatgtatatatagtgtatatatgtatgtatacaatgatcaatctttggagcagcatagtgtaaaaagcgcaagctacggagtcagactgctggatggttctgccacttcaactgacctagggacaggtagattttattatttgtttccttttttgtaaaatgaaaataatggtacatcatgggtgagatgtaaactttaaatgagttagaatgcataaagcattcagaaaaggagctggctgggcgtgggtggctcatgtctgtaatcccagcactttgggaggcccatggcgggagaattgcttgagcccaggaatttgagaccagcctgggcaacataatgagacccctgtctctaaaaaataaaataaaataaatgaaaataaaaataaaaatagaacatggtctggcctgtggaaaacattaattgttacttttattgtagcctttttttttttttaaaaaaaaggtgaatgtcagcagagaaaaactgttttaaaggatatccataaaattttttttgtgatttttctcagattcataggattattaatttttctttttatctgtaattcctttttcccccgtaatgaacacgtttctagtgtaataaagtagaagataatgaagaataagatttagtctgaatatttatatgaatccttatgaagaagtgtcgttgtctgtcattgatacccaagatttgttgtctcacggccatggaaaactaggacgcagacacacaaagagtgaggttcagagtggaagtttaataggcaaaagaaagagaagagctctctgcgacagagatgggtcctggagaggctggtcctggttctgcggtggaatgcaaggggttttatagataagcttgaggaggtggtgtcatgatttacatagggcatgaaagattggttggaccaggtgtgccattctggaaaactggttagggctaggtgttccatttgcctagggtgcaaaaatctggccacccccaccctaatcttttattatgcagatggcttctctgtctgcccagcgcagtgtctgtttctttactatacatgtggtgacaaagaaaagggaaggtgaagcctccatgttgaacatacctggcccccaggtagccgttttctgttagcatagctgctgacattcacccatgcaagcttccagcttgcttttttatgtttgcagcatgatttttcaggctgctctttgttagaaaagaaattcttttggggctgctttttgttaaaaggggaaattacgccgaggactctattgcccttattatctgcgtaaataatttctttctacctcctgtatcaatgatacaacaaaatctagaatttgttgccaggaaattagtaaatatttgaatgatattgaatggtctacataggtgatgttattttatcttgaagctgttcataatttagcataggaaacatggcaaacatggcagaaataccatggatcatatgcttgttttatttttagtgtttttttgtttgtttgttttgttttttttgagacagtctctcactttgtcagcgcgatctctcggctcactgcaaccaccgcctccagggctcaagtgattctcctgcctcagcctcctgagtagctgggattacaggcgtacatcaccacacctagctaatttttgtgtttttagtagagactgggtttcgccctgttggccagggtggtctcaaactcctggcctcaagcagtccatcttccttggcctcctggaaagcgctgggcttacaggcatgagccactgcgcccagcctgtatatcttcttttgagaactgtctgtttaaaatataaatgaaaataaaaatagaacaggggctggcctgcagtaagcattaattatgacttttattgtactttttttttaaaaaggtgaatatcagcatagcaaaactgttttgaaggatgcgcatggtttttttttttttttttttttttttccttgaggtggagtcttgctacgttgccaggctgaagtgcagtggcttgatttcggctcactgcaacctctgcttcccgggttcaagcgattcccctgcctcagcctccttagtagctgggattacaggcacttgccaccacgcccagctaattttggtatttttagtagaggtggggtttcaccatatttgccaggatgctctcgatattctgacctcgtgatccacctgcctcggcctcccaaagtactgggattacaagcgtgagccaccgcacccggcctaaaatttttttttagtgatttttctcaggtgtgtaggattattagattatttagatccttagatctagactatttagatcctttgcccattttaaaatcagattaggttttttttgttttgttttgtttttgtttttttgtttgtttttgctgttgagttgtttgaattcattttatattctggatattagtcccttctcggatgcatagtttgcagatgttttctctcattctgcagattgtctcttcactctgttgattgtttcctttgctgtgcagaagctttttaagtttgttatagtcccatttgtctattttggttttctcaccagtgcttttgaaaccttaccaagaaagtcttttcctagaccagtgtcctcaagtgtttcccctacatttttttttctaatagttttatatgaatagtttcaggtcttacatttaagtctttaatcagttttgagttgactattgcgtttggtaaaaggtaggggtctaatttaatttttctgcatgtggatatccagttttcccagtactatctattgaagagggcgtccttttcccaaagtatggttttggctcttttgttgaaaatcagttggctgtaaatatgtggatttatttctaggttctctgttctgtcctattggtctatgtgtctgtttttataccagcaccatgctgttttggttactatagctttgtagtgtattttgaagtcacatagtgtgatgtcttctgctttgttcttttttgttcattattgctttggctattcagggtctttctggttccatataaacttgagaattgtttttttatttctctgaagaatatcattgatattttgatatggattgcattgaatctatagtttgctttggaaagtatgttttttttttttttttttaagagacgaggtcttgctctctcatcccagctacagtgtagtagtatgatcatagctcactgaaacctcaaactcttgggctcaaatgattctcccacatcagcctcccatgtagctgggatgacagtggtcattttaacagcattcttcctatccatgaacatgggatgtctttccaattttttttgtgtcctcttcaatttcttttatcagtattttgtaattttcattgtagagctctttcaccttcttggttcaatttattcttagagtttgttgttgtagcttattgtaaatgggattgcattcttggttacttttttagctggtttgttattggtgtatggaaatgctactgatttttatatgttgattttttatcctgcaactttagtgaatttgtttataagttctaagattgttttgatggagtctttaggtttttctagatataagaacatgttgtctgcaaacagggacatttgactgcctcttttgcaatctggatgccctttatttttttctctagcctaagtgctctggctgggacttccagtactatgttgagtaagaatggtgaaaagttggcatacttgtctggttctagttcttagaggaaatgcattcagcttttccctattaagtgtgatgttagctgtcactttgtcatatgtggccttgattatgttgaggtatgttcctttattgcctagtttattgagagtttttatcaggaaggtatgttgaattttatccaatgtttttttctgcatctattgagataatcatatggattttgtcattcatgctgttgatgtgctatattacatttatcgttttgtgtatgttgaaccatccttgcatccctgggataaatcccactttgtcttggtgtattgtcttttgaatgtgctgttggattttgtttgctagtatgttgttgaggatttttgcatctgtgttcatcagggatattgaccatagtttttgttgtttctgtacccttgtctggttttcgcatcaaggtaatgctggctggccctatagagtaagttacaaagaattacccctcttcagcttttgggaatagtttgagaagaattggtgttagttctttaaaagttttgtagaatttagcattaaagctatctgatccagggtttcctttgttgagagactttttattaaaattgattcagtcttgttacttggtgttgttctgttcaggtttactacttgtattagtctgttttcatgctggctgatgaagacatactgagactggagagaaaaagaggtttaattggacttatagttccacatggctggggaggcctcagaatcatggtgggaggcaaaggccacttcttttttttttactattatactttaagttttagggtacatgtgcacaatgtgcaggttagttacatatgtatacatgtgccatgctggtgtgctgcacccattaactcgtcatttagcattaggtatatctcctaatgctaaccctccccccttcccccaccccacaacagtccccagagtgtgatgttccccttcctgtgtccatgtgttctcattgttcaattcccatctatgagtgagaacatgcggtgtttggttttttgtccttgtgatagtttactgagaatgatggtttccagttgcatccatgtccctacaaaggacatgaactcatcattttttacggctgcatagtattccatggtgtatatgaaaaggcacttcttacattgaggcggcaagagaaaaatgaggaagaagcaaaagcggaaacccctgataaacccatcagatctcatgagacttattcactatcacaagaatagcatgggaaagactggccccatgattcagttaccttcccttgggtccttcacataacgtgggaaatttttttttttttttttttgagacggagtctcgctttgttgcccaggctggagtgcagtggtgcgatctcggctcactgcaagctctgcctcctgggttcacgccattctcctgcctcagcctcctgagtagctgggactacaggtgcccaccaccacgcctggctaattttttttgcatttttagtagaacgaggtttcaccgtgttagccaggatgatctcgatctcctgaccgcgtgatccacctgcctcgggccccccaaagtgctgggattacaggcgtgagccaccacgcctggccacatgtgggaattcttggagatacaattcatgttgagatttgggtatagtacactatatcactgcttcttcctggtccgatcttggcaagttctatatatccaggaatttatccattccttctaggttttccaatttgttggtgtatagttgttcataatggcgtctaatgattctttgtatttctgtggtttcctttttcatttcagattttgtttgagtcttctctcttcttagtctagctaatggtttgtggattttgcttatcttttcaaaaaaccaagtttctggctgggcgtagtgggccatgcctgtaatcccagcacactggtaggctgagtccgcagatcacttgagcccaggagttcgagatcagcctgggcaagatggtgaaaccctgtctctactataaaaaaaaaaaaaaaaaagttgctgggcgtggtggtgtatgccagtaatcacagttacttgggaggctgaggcatgagaatcacttgaacctgggaggcataggttgcagtgagttgagattgcaccactgcactccagccggggtgacagagcaagaccctgtctcagaaacagcagcaacaacaacaagaacaatccccaaaacaagttcttgtttcattgatgttttatatgtgtctctctctaattatctaatctaattgaatctctctctccccccccatatctccatatctccatctcttgctttctctttctctctctctggtttctattttgcttatttctgctctggtctttatttcttacactaattttgagtttggtttgttcttgcctttcaggttccttgagatgcattgctaggttgtttatttaaaatctgtcttcttttttgatataagtatttattgctgtaaacccccctctttgtactgcttttgctgtttcccagaggttttggtatgttgtgtttttttttcttcttttcttctttttttttttttttttttgagacggagtcttgctctgtcacccaggctggagtgcagtggcatgatctcggctcactgcaagctctgcctcccgggttcactcccacctcagcctccctagtagctgggactacaggcacccaccagcacgcctggctaattttttatatttttagtagagacagggtttcaccgtgttagccaggatggtcttgatctccagacctcgtgatctgcccgcctcggcccccgaagtgctgggattacaggtgtgagccaatgcgcccggccttttcttttctttttttgaaaatgaagacggggttttgccatgttgcccaggctggtgtcgaactcctgagctcaagccatctgcgtgcctcagtctcccaaagtgctgggatttcaggcatgagccaccacaccttgtcattatgttgtgtttctatttcggttttttttccaacaaatcttttgaattccttttaaatttctccatagacccagtggtttttcaggtgtttagtttccaaagttcttgtttttgatgtctagttttatcccactgtggtctgggaagatacttgatatgattttagttttacaaaatttgttgagacttgtttcgtggcctaacatatggtttatcctagagaatgttccatgtgctgatgaggagaatgtatattctgtagctgttgcatggaatgttctatgaatgcctgttagttccatttggtccatagttccactgaagaccagtgtttctttgttgattttctgtctagatgatctgttcagtggtgaaagtggggtggtgaagtccgcaattattcttatattgggatctatgtctctagctctaataatatttgctttatagctgggtgctttggtgttaggtgcatatgtgtttatagttgttacgtccttttgctgaattgatccctttatcattatataatgtccctttttatgttttttgacttgaaagtctattttgtttgatataaatatagctactccttcatgcgtctggtttccatttatgtggagtatctttttccattccttcattttctttttttttgagacggagtttcacccttgttgcccaggctggagtgactgtagtagcatgatcttggctcactgcaatctctgcctcccgggttcaagcagttctcctgccttagcctcccaagtagctggggattacaagcatgtgccaccacgcctggctgattttttgcatgtatgtatgtatgtatttatttatttagtttttgagatggaatattgctctgtcgcccaggctgtagtgtggtggcatgatcttgcttcactgcatcctccacctcctgggttccagtgatgcccctgcctcagcctcctgggtatctgggattacaggcatgtgccaccacgcctggctaatttttgtatttttagtagagacggggttttcaccattttggctaggctggtctcgaactgctgacttcaggtgatctacctgccttggcctcccaaagtgctgggattacaggtgtgagccaccgcacctggcttattccttcattttctatgtgtgtttttacatgtgaagtgagtttcttgtagacagcatatagttgagtctttttttaaaaaaaaatccactcattcagcctatatcttttaattggggaatttaaaccatgtacattcaagattgttcttgatatgtgaaggcttactcctgtcattttgttgttttctgattgctttgtatatcctatgttccttttttcctctcattgtttatccttgctgtttggtggtattctgtagtgataacatttgactagtttctctttctcatttgtatatttgctttgccagtgaattttatacttttatgtgttttcgtgatgatacatattattctttcccttccagatgtaagactctcttcagcattttgtatggctggtttagtggtgaattttttcagttttcatttgtctgtgaaagactttatttctccttcatttctgaaagatagctttgctgggtatagtattcttggctaacaatttttttgctccccacccccttcattcagcagtttgaatatatcatttcattctctcctgacttgtaaagtttctgctgagaaatctgccattagtctgatggagattcccatacatgtgacttgaggattttctcttgctgtttaaaaaactttttttttttttttgagagacattattctgtttcccaggctggattgcagtggctagtcacaggcacaatcatgtctcacgacagccctccaactcttggcctcaagcaatcctacccactcagcctcctgagtattctcttgctgttttcagaatattcttttttattactgtgattattattatttttagagatagggtcttgctccattgcccaggctggtgtgtgatggttcagtcatagctcactgcagccttgaactcctgtgttcaagtgatcttgcctcagcttcttgaatagctaggactacagctaaaagattggccatccctggctactttttacattttttgtatagatagggtcttgctatgttgcccaggcttgtgtcaaactcctggcctcaaagaatcctcccgcctggcctcccaaagcattgggattgcaggagttagccaccgtgttcagtgtagaattctgtttttatcatttacttttgacaacttggcaataatgtaccttagagaggactttctttgggctgaatatgttttgggatctgtgaataccaaagattcgagggatatatgcctgtatctctgctgagacttcggaagttttccgctattatttcattaaacaggttgtctatgccatttaccatctcttctgaaattcccaaagtgcaagtagttgttcacttaatggtgtcccatatgccatgtgggctttattcttttttatcctctcttctttttcttctgagttttttctttttttttctttttctttttttgaggcagagtctcgctctgttgcccaggctggagtgcagtggcacgatcttggcttactgcaacctccgcctcctgggttcaagtgattctgctgcctcagcctcctgagtagctgggattacaggtgtgcaccatcacacccaactaatttttgtatttttagtagagggagggtttcaccatgatggccaggctggtctcaaactcctgacctcaggtaatctgctcacctcggcctcccaaagtgctgggattacaggtgtgagccaccgcgcccagccctgtctgagattttgcaaaagacctgtcttcaagttcagaaaatccgcttgatgtagtctattctattttttatttcactcattgaattctttaatttcacaatttgtttgtttgtttgatatatatctccttgttgaatttttcactgatgaattgttttcctatttctttgtaccgtttgtgtgtgtgtgtgtgtgtgtgtgtgtgtgtgtgtgtgtgtttgtatattgctgagtttccttaagatcattatttttcatttttttcaggcatttcagagatttctttttttggggcggggggggacggatttcttcctagagaattaattgagtttcttttgaggtgttgtatttcccttgcttttttatgtttcttgtgtctactttggcatctgtgcatctggtgcagcagctgctccttccaattttatggagcagcttttgtgcagaaatactttttcctgcaggtatatctacagtattggctggataacgtgctttggccgtacaatagagtagtattcagccatgaaaaggaatgaagttctgatacatgctgcagtgtggatatacctccaaaactttatcctgactgaaaggagccagatacaaaagatcacttattgtatggttccgtgtatatgtaatatattttgtagataaatctacagatgtagaatgctaattggtggttgccagaggctgggaagaatgaggaatgggaagaaactgctgggtaaggagttttaactttggagtgatggaaatattatggaactaggtagaggcagtcattgcggaacactgtgaacgtactaaatgttactgaattgttcactttaaaatggttaattttatgttatatgaactacacctcaatacattattttttaaaagttttatgaacagtcataaattaaaacaaatattcgctatggcgattaatataattgccctgtgttgaggatttaccgggagctggagccttcacatatattgattctaagccttatgtcagcattgcaagatagattaggaagaacaaagaactatattagtagtttaaaataatggctttaaactgctttacaccttgtttatcaaatcaagtgagcccttgaaatttaatcagggactggacggtagggggcacccatggtacttatgttgctctggctatgttgagagcgtcttaagtcataaacacagatttgttgaatgagtttgatactttgaaaattatcacctagaggctgggtgcggtggctcacgcctgtaatcccagcactttgggagactgaggcaggtggatcacgtgaggtcaggagtttgagaccagcctggccaacatggtgaaacctcatctctactaaaaatagaaaaattatccgggtgtggtggtaggtgcctgtaatcccaactattcaggaggctgaggcaggagaattgcttgacgctgggaggtggaagttgcagtgagctgagattgcgccattgtagtccagcctgggcaacagagcgagactctgtctcaaaaaaaaaaaaaaaaaattagcaagaaggatcttattacgaacttatgtttatttgagtttggtattttatctttcagttttaagttttgtagttgaaaatatggaactataggcatgtgccaccacacccagctagtttttgtattttttatagagacggggttttgccatgttgcgcagactggtctcgaactcttgggctcaagcaatctgcctgcctccacctcccaaagtgttggaattacaggtgtgagcctctgtgcccggccaaaacataagttttatgatataatacttgctctatggacgatgttagatgttttaagttttattttcttttaatgaaaaaagattggcaaccactaaattgtttttacaactcattttttaacaagccagtttgaaaagtttttagtgtaaaatgccagtgtttctgctatccgatgaaaagcatcaggttctataaaattttactattggaaagttagggtttggggaagagtattctaaatatatgtaactttgtaatcataacacaaacagaagtaatgttaataaatggtacctcaggagattacttggatagcactaggatgccaggtgatagtagccagagaatgcttcaacatatattcaaaactcaccgaagtaatttagtagaaatgcttgcttacagtgctgagaaattgctgatggaagtggatctctgagcgcaggaaaaagtgcagcctgtcttgagcagagggccatgagtgctcaggggtgtgcccctgtaggaagggagccctggatacaggtgctctgttttagttttctcaaaatagagctgaaaggatcactatttattcagcagccaagcagagggcattttcctttcctgctgaaggctgcaattctgcctgtctttgtagttctcttgcctaggaaaaggtacatatgaatcagcacagctttgttataatgatagttctctatttatcatgatcatgtatgagctaatttatattgtaaaaaatatatttagaacaaaactgtgtgtgtgtccagtgtagtttgccaattttactgtatttcattttagccactgctttttttttttttttttttccttctgagacagagtcgctctgtcgcccaggctggagtgcagtggcgcgatctcagctcactgcagcatccacctcccgagttcaagtgattctcctgcctcagcctcccaagtagctgggactataggcgcccaccaccaagcccagctaatttttgtatttttagtagagatgggttttctccatcttggccaggctggtctcgaactcctgactttgtgatctgcccacctcggcctcccaaagtactgggattacaggcgtgagccaccgcgcccggcgatgctgagatcttaattaagactctaagttttggagagagatgttcaagtttttcatctttacctgagaatccctacaaaatgccaaatactgtaattgtacactaaggtgccaaaattttgatctcaaagatccgtatgaaattatcttggagataaggaacctgaaggcttaaaagacacaagaatcaagtttctcttctggccctttcttatttattacatacaaaaataattacttttccctttaggaattaaaaaaaaaagtagtcactcagggatacctgattctttactgatgcttagcatttttttgtgaataatttttatccctctaacagtaaaatgatgttaaaagcccttgaaaaaatgaaaattaattgcatttcatacccttgaagctctgattttattgataattttgttttttaagtgaacaaaacctcaaaatatactagcaaggtaaatttattgatttctcctcttatgcccgattgcttatcaatttggttcttttgtctaagaatgatccaattagcagactaattttttttcaacagggaactttcgccttcttacactgtgttctcattggagcattgcatagtctctgcatacgtagagcgtgaagatggtgtctttatgtataccttcttaagtaagctaaactgtcttgaaaatggcagtaagtggcacattaagacacaaaaggttatttcttttttggcgaatggttgtttgtttaaatggagaaacataaggtcttatattgagaggtagatttatttaatattccatagatgtaattttaaaaatatttctcctgtctcagaatgaagtgagggttctgctaagacagctttgtaattcacagctttctttgaaaatgctgtacctctattccttattgatggacttgaatgcacaatcatttgtggggtttttttgttttgtttttatgaaatagcagtttgatcatttataccaaaagttagtgctatatgattagatatcaaggttccttagatagaagcattccaggctggatatctgactccttttatcatctgcatggtgtacttagctgtatataaaatggaaaagtagcaagtttaaatgactggtaaagttggaggcacactctgctacccagcggttctatttctgtgtcttcttgagagaaacttttacccatgtgctcaaggatctatatagatggaggtgtaatttattataatggtgatctagataggatctagatagatggaggtgtatttattataatagtgaataagtacaaaaatacttaactgttcctcagtaagtgaatggatacattgatattattcgtatagtggaattcaagtaaacaatccttatctccagaatacttagggcagatgtattttggaatttagaaatttttaaactttaaaggtaattcggtatgtataccatttattgtataacactcccattgggatttgggaaacacctcataatcaaacatactaatttttctgtagcaaaatttatgaatattcatattaagtgggataaatagattttaaatggcttcatactatttgggttaattacattttttaattaggttatgggaaaacttaagagctttttggattttagatttttggaaaaagaattgtgaacccatattataaagttcataaaatgaatgaaatcgagctacatgtatcgatgtggataaatctgaagcatattatgttaagtaacaaaaggaagttgcagagataaccttgtgcaaatgacatcatttatgtgaattgttaaataagcaacagtgagagagagagagagagctctgaagcaaataaggcaaattattggtagtggttttcttactttgttgtatgtttgaatgtgtctttataacctcaaacttcagcttttaaaccttctgttttaccttaagaatgtaaggttacattgagttaggcaataagagtatgctacaaagcatgtcagaactggaagtgttctttaaaatcatttaaattatcatcccttctttttttcttactttctttttttcttttcttttttttttggaggcagggtctcactctgccgcccaggctggagtatagtggcatgatcatggttcactgcagcctcagactcctgggctcagggaaacctcctgagtatctgggactatagatgcatgccactgtgcccagctaatttttttaatttttttgtagagacagtgtctgtgttgcccaggctggtcttgaactcctgggctcaagcagtccttcctcctcggcttctcaaagtgctgggattataggtgtgagccactgtgcctggtctactcttccttcttctaatccaagtcattcctacttgttaagagattctcttgaatatttatttattttccctttttaaaccttagaccttttacttcttttcaaaacatattttggttgagatatagtttccatacagtgaaatgcacacaccttaagtatcttgtttccatgagttttgacaaatgccaacacccgtgtaatccacaattctgtcaagatacagaacatttccatcatcccacaaagttcccttgcatctctccccagttcgcatcatccctgccccgcagcacaggtagtgttctgattcctttcactttaattttacgtgttctcgaacttcatttaaatggaatcatacagtctgtaccctgttgtgtctggcttttgttgctcagtgtgttgttttttacatttatccatgttgttgcatgtatccatagttatccttttatatactgagtaacactccattgtgtgaatgtggtactatcagtttatccaatcttctgttgatggacatttgtgttgtttccagtttttggctcttatagataaaaccactgtaaacatttttatatggttgtgtttattggtacatgttttcatttctcttggggtgatacctaagggtggaattcctgggtcctagggtggtgcatacttcacttcgtgagaaactaccagagcagttttcagtgttgcttctggctgcttccatccttgccagcatttggtattgttaattgtctaaattttagccattctagtgggtgtgtagtgatatcttattgtggttttgatttgcatttccccagttactaaagatactagtcactttttcgtttgcttattggttagttagttcaattgcttattgtccttagaagaacgttcatcttccccaggaatgtatttttctttttgaagtatctaagtcttctacccacttttaaaaagttttttttttttaattgagttgtagaagtagtttatatattctggatacaagtcctttaacagttatatgtggcatgccaattttatttttatagtggtctctttctttttaaaatttttcctcatcactctttccatatgatacaatgttctcttttgataagcagaaattaaaaattttgaagtctaatttgtgaatttaaagttttatcattagtacttcctaagataaccatccaaatatctttcccttaaaagtataaagtctgaggctgggcacagtggctcacacctttaatcccagcactttgggaggccgaggctggcagatcacctgaggtcaggagtttgagaccagcctggccaacatggagaaaccctgtctctactaaaaatacaaaaactagctaggcttggtggcgggcacctgtaatctcggctacttgggaggctgaggtatgagaatcgcttgaacctgggaggtggaggttgcaatgagccaagattgcgccactacactccagcctgggcagcagagcaagactctgtctcaaaaaaaaaaacaaaaaagtgtaaagtcagctgaagtgatatgaaagcttttgtgatcatagacctaagcatttgaattgcaaatataacttggtgtgtgaaagctctgcagtatgcatgcaggaattaaatgtctgtctggaaataatgccaacaaatatatttattggggtttgtgtgatagaattggcagataaccaaggaagcaaatttattttccttttaaatatgaaggaaaatttatgaaggaagagcaaatttattttcctttcaaatacgaaaacatgaagtaatcttttgtaatgtttactacctacattgattgcctttctctgcattaatttctcaaaaattttcttcattaattttcttgaggagctcttttatctgcttaatgtctttacaaacacatgtgcaaaagagtctcagacgcatcttatttgatgattgtcatggaaaatattaagggtttgtgtacaaatgtttatactgcagtgttttgcttcaagaaaaatgtatggtcttctctatgcaagttttatcatttttgttgttgtttttatttccaagtcctttctgtgttttaattttaatttttacttttatttttgagacagagtctcgcactgtcaccctggctggagtgcagtggtgcgatctcggctcactgcaagctctgcttcctgggttcaagcagttctcgtgcctcagcttccctagtagctgggattacaggcatgcaccaccatgcccagctaatttttgtatttttagtagagatggggttttaccatgttggctatgctggtctctaactcctgacctcacatgatctgcgtgccttgccctccctaagtgctgggattacaggcgtgagccactgtgtccagccaataaatactttaaaaataaattttcaggccaggtgcggtggctcatgcctgtaatcccagcactttgggaggctgaagcgggtagatcatgaggtcaagagatcgagaccatcctggccaatatggtgaaacctcgtctctactaaaaatacaaaaattagctaggcatggtggctgtgcacttgtagtcccagctacttgggaggctgaggcaggagaatggcttgaacccagaagacggaggttgcagtgagctgagatcacgccactgcactccagcctagcgacagagcaagactccttctcaaaaaaaaatttaaaaaaatgtttttttcagcaatgtgtggaaaatatacacaagatataagaccaataaaatgctactgtctaggagatgaggtgcctcatacctgaatccagcaccaaggtgggcggataacctgaggtcaggagtttgagaccagcctggccagcatggcaaaactccatctctactaaaaatacaaaaattagggggtggtggcgtacacctgtaatcccagccacttgggaggctgaggcacgagaatggcttgaactctgaaggcggaggttgcagtgagccgagatcacaccactgcattccagcctgggcgacagagcgagactctgtctcaaaacagaagggacttggaaataaaaacagctaacaacaaaaacccgtaacatagtcatttattatcattatcaagtattatgtactgtatataattgtatgtaccacacttttatatgactgtcaacgcattaggtttatttacactaacatcattgcaaacacatgggtaaggcatgtgttacaacattatgatggctatgaccaatgtgataggaattccccaccctcccacccgagacggagtcttgctgtgtcgctaggctggagtgcagtggcatgatctccactcactgcaacctccgcctcccggataagcgattctcctgccttagcctcctgagtagctgggattacaggcacgcaccactacacccagctaatttttgcatttttagtagagacggctttcaccatgatggccaggatggtcttgatctcttgacctcgtgatctgcccgcctctgccttccaaagtgctgggattacaggtgtgagccaccatgcctggcctgtgataggaattttttagctccattgtaatgttatgggaccaccatgatacatgcagtctcttgttgactgaaacgtcatgtggtgtatatagaatgcatttatgacagtaggacttacccattttgatagtgttttcatttattcctttttcttttttttccgagacagagctttgctctgtcacccaggctggagtgcagtggcgtgatcttggcatcctccaactcctgggtgcaagcgattttcctgcctcagcctcccgaatagctgggattataggatgccaccatgtccagctaaggttcgtagttttagagatggggtttcaccatgttggtcaaactggtctcaaactcccccaccccaagtgatctacccactttggcctcccagagtgctgggattacaggcatgagccactgcacccgaccacattttcatttattctttaacttctattctgggttgtggtagcataaagatggattatgtttattgctgaaataaacctgttgtccaaattttgatgttttccagccattatcttgctacttagatttatgtacagcattcgcagagcaaaaagatagatgatcttatttttcctggattcagaggcagagagtagttgttagaattctagtgtaattgctcattcattttcttgactctgacatctttttttagaggaaaataactttggttagtaagctccaaataatgggtgagaatgttaaacaatttaatccatccctttgagttctagtgcgggtcttttttgcattttggtgagtctcctgcttgtgtttagattagtctgaaaactttgatttggtttaatatttgagggctttcagtgtgctttgctgtacaggaaataaatctctgtcattaactcaaagaatactaaactaacaataaggaggagtaaattaccttggaggctcttcccctgtctcattctctgtggttcagactcattaaattagtttcttcttttaaaatgtttcttcttttaaaattatggaaattagaattcagttgacgtttgtacaaagtggggttatatctgtgtataagttttgacaccccccaaatttaactattaatagcctactgttgaccaggggcctgataacatagttgattaacacatattttgtatgttatatgttaacatgtattttatgtatatactgcattctttaaagcaagctagagaaaagaaaatgttattaagaaaattgtctgggtgtggtgcctcatgcctgtaatcccagctctttgggaggccgaggctggtggatcacacggttaagagatcaagaccatcccggccaatatggtgaaaccccgtctctactaaaaatacaaacattagccaggcgtggtggtgctcacctgtaatccctgctactctggaggcagaggcaggagaatcgtttgaacctgggaggcggaggttgcagtgagctgagattgtgccattgcactccagcctgggcaacaaaagtgcactccattgcactccatctcttggaaacagagcaagactgtctcgggggaaaagaaaaaaaaagaaaatcacaaggaagagaaaatacacttactattcattaagtagaagtggaccatcacgaagatcttcatcctcatcatttttgttttgagtaggctgaggaagaggaagaagaaaagggattggtattgctgtctcagatttggcagaggcagaagaaaatccatgtgtcagcagaccctcaaagttcaaacctgtgtggtacaagggtcaactgtactttgttttcatagagatatattaaagttttatgagtttagctcatagtgatcttataggttctaagcttcatttgaatatattgcatgtaaaataaatgctttatctgtgttccttttgtctttcttgaatattgttgttaatttaaaatttgtaataggttataactcttatgttttacccatttgtgagctttatttttggataagaactttatcctgtacttttgctgtgcttcgtatagtacaactatgaaagattcttgttgactgttgattatctgaaaatgcttctttttgcttcaggtcaaatattgaataaacctagagcatataattaacatttttattaggactgtggtttgtattttggccagttgggatttaagaattacttgtattggttggtgtagaactgattttttttttctttttcttttttttttttttggagatggagtctcactctgtcgcccaggctggagtgcagtggcaggatctcagctcactgcaacctctgcctccccggttctagcaattctcctgcctcagccccctgagtagctgggtttacaggcgcgcaccaccatgcctggctaattcctgtatttttggtagaaacggggtttcaccatggtggtcaggctgatcttgaactcctgaccttgtgatccgcctgccttggcttcccaaagtgctgggattataggcatgagtgatttttttagaataagagtaattggctgcattatttttttaaggaagaggtataacttcccagatacttgcaatgcggctaatatacagtagccatttactttcaacataatttctcaacatttaatttttgtcagtttttcataaaaaatttatgacagggtaaaaagatgacattcctaagtcctagaaagtttattgatgataaatacaaagaattaaattgcagatcagtcttagaagtgctattctgtggataagcatacagccctgggcagcacagacgggaacatcagatagcccaaccaaaccggaagcttgacttggttgacttaagaattctttaaaactcttttgcgtgttacattaataaagtttatttaatacatgtatttatatgtttcagaaaaaaatgttcttaatttaacatttgtaaaagggtacaatactggtgttttctctgactctgatcttcttgataaacagtgtactgagttctctgtgatatattttgtttgtaatcatgaccatttcacgtgtccataattttttttctctaaaaatatctctagactacatagttctgttattttaggaatgagaataaacgggatcaaagtgtactcttgttctaagaaactaatgacagtttatttgttggaagttctgcctcagaagagcttctgatatttatctaaaatatatgaatagtagttgtgatctgtcattgtttttgcagatatctaattgttgtaataaaagtcataggccctgtcagatagttaagaattttcattattgttgttcacaatatcctaccatttcattgagatatagcttggtgtaataatagtacagtccctggagtaaattttagacaaatactttcccagcctttcaaaatcaagctgagtgttagagtgagaagtagactagtgagtgttgctataaaatttggagtgtgagatcattttgcagtgtgtcgggaacagacttcccaaatagacattctagtattatcttacaactcgatctttccttaaactcaatgtatctgtttttggttgatcattatagatgtctgtgatgtgtgaatatgcccattttatcttctgtatgaatatgctggagaaagagtagccttgcttgtagtctgcttttttccttcttctaaaggagttggcaggaatttttataaaataaagctagcctgattgtagccaaaagaggaaatgttggtttatattttagtggagaaaactgctgtatagacttctaggctaccaagtcagagcattgttttatttttatactatagtaaaatgggtgcaggcggagctgaagaaccagacacactagtagttaatgttttctttctttaccaaaatagtaattgccatgctacatttagccatatgtgccaaagcgtatgtgaaactgttaactgtagccaacatatatttctcctgacttgaatgaattgatgacgaatggtcagaaaaggaggaacagtcatacctagaaatcagcttccctgttgaatttcacttctggtatttccctttgggatatattcactcaggagtgtcaggattttttttgacttccaagggaaagaaactaggcttcagagaattagcattttgatacatctttttattgaaggtcttttgaactccagcaactgttaatctttaaaagatgatgctggtagtgaaatgcattttaaaatttatattcatgaatttaaattcctgatttttttttttttggtgagtttattcttcgaaagaaatagcagtgcttttcaagtgtttgaagactaccagaattgaaagctcactgcttgctaaaagcataatacccaaaccggaaatgataaaggaaaatgtcattgtctttgtattaaaaaagaaaatatctattaaaagtcatcataaacaatgttaaaagaaaaatggcagacttggaaaaatatttgtaacatacacagcaggtgaaaggttattttcctaatatgaagagctcttaaaatggattaagaaaaaatgttcaataacaaaatgggcaaagaacaaggagagaggagtcacaaaagttgatatacaaagacacagatagaaatgatttgtaatatgacaaaagtcgatatacaaagatacatatagaaatgatttgtaatatgacaaaagtcgatatacaaagatacagatagaaatgatttgtaatatgataaaagtcgatatacaaagatacagatagaaatgatttgtaatatgacaaaagtcaatatacaaagatacagatagaaatgatttgtaatatgacaagtcgatatacagagatacagatagaaatgatttgtaatatgacaaaagtcgatatacagagatacatatagaaatgatttgtaatatgacaaaagtcgatatacagagatacatatagaaatgatttgtaatatgacaagtcgatatacagagatacagatagaaatgatttgtaatatgacaaaagtcgatatacagagatacagatagaaatgatttgtaataagacaaaagtcgatatacagagatacagatagaaatgatttgtaatacgacaagtcgatatacagagatacagatagaaatgatttgtaatatgacaaaagtcgatatacagagatacagatagaaatgatttgtaatatgacaaaagtcgatatacagagatacagatagaaatgatttgtaatatgacaaaagtcgatatacagagatacagatagaaatgatttgtaatatgacaaaagtcgatatacagagatacagatagaaatgatttgtaatatgacaaaagtcgatatacagagatacagatagaaatgatttgtaatatgacaaaagtcgatatacagagatacagatagaaatgatttgtaatatgacaaaagtcgatatacagagatacagatagaaatgatttgtaatatgacaaaagtcgatatacagagatacagatagaaatgatttgtaatatgacaaaagtcgatatacagagatatagacagaaatgatttgtaatatgacaaaagtcgatatacagagatacagatagaaatgatttgtaatatgacaaaagtcgatatacagagatacagatagaaatgatttgtaatatgacaaaagtcgatatacagagatacagatagaaatgatttgtaatatgacaaaagttgatatacaaagatacatatagaaatgatttgtaatatgtatcagaattacaattgtacatactttgtgatccagcaattccatctttgagagttcccaagaaaaatgtggattcatgtgtaaagatacatatgtgaaggtgcatcttacaatagtgaaaaatgagaactaacctaaaatatccgtaagtggaattttatgaccaacatcttctctccaaccaatttttttattatggtaaaatatatataacataaaatttaccatcttaaccatttcgaagtgtacagtttagtggcattcagtatatcccatctatctccagaactcttttcatcttgacagactgaaactgtatacccattaaacaataactcctcgttctgtcccactcctatgtcctggcaaccactgttctagttccttctttatcaattcgactgctctagatacctcatgtcaatggatacatatagtgtttgtctttttgtgattggcttatttcacttagcacaacgtcttgaaggttcatctgtgttgtagcatgtgtaagaatttctttcctttttaaggctgaaaatcattagcaggtgatatggtttggctgtgtctccattcaaatctcaactggaattgtatctctcagaattcccacatgttgtgggagggccataggaggaggtaattgaatcatgggggccagtctttcccatgctattctcgtgatagtgagtaagtctcacgagatctgatgggtttatcagggggttccgcttttgcttcttcctgattttctcttgctgccgccatgtaagaagtgccttttgcctcataccgtgattctgaggcttcctcagccatgtggaactgtaagtccaattaaacaagtgccttttgcctcataccgtgattctgaggcttccttagccacgtggatctgtaagtccaattaaacctctttttgtttccagttttgggtatgtctttatcagcagcgtgaaaacgaactaatagagcagccaccttatttccaaaaaaaaaaaaagattttttcaatggataatgcaggtatttatacccttatttaaagtatgagggatctgaaacccagaaagatggtgacatgtctaaatgtcataactagtcagcgtgagagtcagaactgaaactcatgttttctcatcacagtttcgtgttcttcccagtatggtacactgcttaggccttgaatacaaggaatgatcttttattgttgcttcttcattcctaaaaataagatttttgatgtcacagccttttggaattcattgtataatgtgctggaatttacataaccattcagattaaaggttcgtgtaccttctttagggatagaagctaaagatctaccctctcaaacattttagtagttcatctgcattaacacctttatttaattagccacccatgttgttaccgtcccctgtataaaaagctttgcatattctaacttaaaaaaactttgctatattattatctttgggtattaccagttttgatttctgcaatctgctctgtttttgctactagaggaggaaagctgatttggagttttctttttttcttggttctagttttagtgggctgcaaggattgctttgaatgccagctctatcacttactctgtgatcttggacaagtgcttaaacctctctaagcctcgtgccctcatttataaaattaaataatagtacatgtgttgggtatctaaaatagtcaaattcacagaatcaaagtgtgtaatggtagttgccgggggtagggggaaatggagagttactaatcaacaggaatataaacttttggttgagatgaataaactctacagatttgatgtataacattgtacctgtagtcagcagtaatgcattgtacacttaaaagttgttaggaaagtagatgtcatgttaagggtttttactacagtaaaataaaaaaagagtccatgtgtcataatgaagattaaataacataaaaaatgtgtggtacaatctggcatatacaaactacttgttaaatgttaatatttattatttaatgtttataatacttaaaagtcattttgtatttcgctgtccttcggttttgcttgtttgtttgtttgttttgacacggagccttgctctgtcacccaggctggagtgcagtggtgtgatcttggcttactgcaaactccacctcccagttcaagcaattcttctgcctcagcctcctgagtagctgggattacaggttcgtgccaccatgcctggctaatttttctatttttagtggagacggggttttaccacgttggccaggctggtcttgaactcctgacctcgtgatgtgcccgactcggcctcccaaagtgctaggattacaggcgtgaaccaccgtgcctggccaatttttgtatttttagtagagatggggttttatcatgttggccaggctggtcttgaactcctggtgatccgcctgcctcggcctcccaaagtgctgggattataggtgtgagcccccgcgcctggccatcctttgtattttttgatgaaaaaaaaaaattttttttttttttttttttttaagacagagtttcactcttgttgcccaggctggagtgcaatgagtgcagtcttggctcactgcaattcccacctctcaagttcaagcgattctcctgtctcagcctcccgagtagctcagattacaggcacacgccaccacgcccggctaacttttgtattttagtagagacagggtttcatcatattggtcagactggtcttgaactcctgacctcagctgatttgcccaccttggcctcccaaagtgctggaattacacaggtgtgagccaccacgcccggctgttttgatgaaattttttgaaagaatgtattcatattcctgtagatttcccatttcccacattccctcaaatttagtttccgtgttaatatcttctattaattttgaacagtgtctttattgtagtttatgcaaagtgaggagtgagtgccatacttattttgcttcctgttgagaataaactgaagttaaattactgacattttgcatattatctcaatcattttttaaggacctgtaaaacagaataaggtgaatcctaatttgctagatgcagatttcttgtagctatttttgattcctgcaggctgctctgatttgctacttgaggaggaaagctgatttgggggttttctttttgtcttggttctagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggtatgtgactacttttttagttttatgatttgttggttatcttttttttcactgattaatcagcatcttggccccagtgaatctacgtgctctgccgtgctggtggaagagaatttcatcctttgtatttaagtgcgtcactgatttctgttctgatttgccctgttgtatgggatgacattgtctggtatgtatgctggctcagtgactttctgggtcttttctctcctgctcccctgattttgagagttcatttgttgctaaaggggtaaaaaattccttgatttttcactcatctctagatctgttcatagagacaacaaacacaacaaaaccagaatcagaatagctaaccattgcttaatttaaaaatattagtaaaagagagtaagcggttatctcagcttatgtgtgcttataaaagtccttggcagcaataatggatatttgccctgtggtttccatggaaactgttgccttgctgtaaaagatacgtgataaaaatcattggctgccatggaggcatagctggagagagtgatgtagagacacagtgttacttatttttagctgacctaggtgactactgataattttttacttttctaaataatgtatcattttaagaaggcgtaaaggaagaaaccatcttatattgaattaaaaaattaatagccataataacttttctatatatagttggacttcaggtaattttcacttttgggcaggggaaaataaatccctaatctgtgttagtatgagtctgaataattcctttttaaataaaatgtgaggaaggaggtttaaaaaatggcgtattcccaaagcagcaaaataataatttttaaaaatacttctaaatttgtaggttgttctataatttttccttttgtaaaaagtctgaaatcttttttaacagtgagggcatttttatttttgaagtagaacatcattgttttttaaaaacatgatgttattacactggaaatccattgtagtaaaattgggaaatagattaacaaaaacttataactcaaagtattgttacctagtagtaattattaacttatgtatatgcttccagtcattttttttttattttaaatttttattgtttttatttttagagatagggtctcactctgtcactcaggctggagtgcagtggcatgatcatggctcactgcagccttgaaatcctgggcttaggtgagccttctgccttagcctccctagtaggtaggtctacaggtgcatgccaccatgcattgttaatttttaaattaaaaaaaaaattttgtagagacagagtctccctatgttgcctaggctggtcttgaactcctggcctcaagcaatcctccctccttggcttctgaaagtgctgacattacaggcaatatgcctatgcctggcccattattattattgttgttgttgttgttgaaagtgctgagattacaggcaatatgcctatgcctggcccattattattattattgttgttgttgttgaaagtgctgagattacaggcaatatgcctatgcctggcccattattattattattgttgttgttgttgaaagtgctgagattacaggcaatatgcctatgcctggcccattattattattattgttgttgttgaaagtgctgcgattacaggcaatatgcctatgcctggcccgttattattattattgttgttgttgttgaaagtgctgagattacaggcaatatgcctatgcctggcccattattattattattgttgttgttgttgaaagtgctgagattacaggcaatatgcctatgcctggcccattattattattattgttgttgttgaaagtgctgagattacaggcaatatgcctatgcctggcccattattattattattattgttgttgttgttgaaagtgctgagattacaggcaatatgcctatgcctggcccgttattattattattgttgttgttgttgaaagtgctgagattacaggcaatatgcctatgcctggcccattattattattattgttgttgttgttgaaagtgctgagattacaggcaatatgcctatgcctggcccattattattattgttgtttgttgttgttgaaagtgctgagattacaggcaatatgcctatgcctggcccattattattattattgttgttgttgttgaaagtgctgagattacaggcaatatgcctatgcctggcccattattattattattgttgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccgttattattattattgttgttgttgaaagtgctgagattacaggcaatatgcctatgcctggcccgttattattattattgttgttgttgaaagtgctgagattacaggcaatatgcctatgcctggcccgttattattattattgttgttgttgaaagtgctgagattacaggcaatatgcctatgcctggcccattattattattattgttgttgttgaaagtgctgagattacaggcaatatgcctatgcctggcccgttattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccgttattattattattgttgttgttgaaagtgctgagattacaggcaatatgcctatgcctggcccgttattattattattgttgttgttgaaagtgctgagattacaggcaatatgcctatgcctggcccattattattattgttgttgttgttgaaagtgctgagattacaggcaatatgcctatgcctggcccgttattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgttgaaagtgctgagattacaggcaatatgcctatgcctggcccgttattattattattgttgttgttgaaagtgctgagattacaggcaatatgcctatgcctggcccgttattattattattgttgttgttgaaagtgctgagattacaggcaatatgcctatgcctggcccattattattattgttgttgttgttgaaagtgctgagattacaggcaatatgcctatgcctggcccgttattattattgttgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccgttattattattattgttgttgttgaaagtgctgagattacaggcaatatgcctatgcctggcccgttattattattattgttgttgttgaaagtgctgagattacaggcaatatgcctatgcctggcccgttattattattattgttgttgttgaaagtgctgagattacaggcaatatgcctatgcctggcccgttattattattattgttgttgttgaaagtgctgagattacaggcaatatgcctatgcctggcccgttattattattattgttgttgttgaaagtgctgagattacaggcaatatgcctatgcctggcccgttattattattattgttgttgttgaaagtgctgagattacaggcaatatgcctatgcctggcccgttattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccgttattattattattgttgttgttgaaagtgctgagattacaggcaatatgcctatgcctggcccgttattattattattgttgttgttgaaagtgctgagattacaggcaatatgcctatgcctggcccgttattattattattgttgttgttgaaagtgctgagattacaggcaatatgcctatgcctggcccattattattattattgttgttgttgaaagtgctgagattacaggcaatatgcctatgcctggcccattattattattgttgttgttgttgaaagtgctgagattacaggcaatatgcctatgcctggcccgttattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccgttattattattattgttgttgttgaaagtgctgagattacaggcaatatgcctatgcctggcccgttattattattattgttgttgttgaaagtgctgagattacaggcaatatgcctatgcctggcccattattattattgttgttgttgttgaaagtgctgagattacaggcaatatgcctatgcctggcccgttattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctatgcctggcccattattattattattgttgttgttgaaagtgctgagattacaggcaatatgcctgtgcctggcccattattattattattgttgttgttgaaagtgctgagattacaggcaatatgcctatgcctggcccattattattattattgttgttgttgttgttgttgttattattattattattattattattattattattattattattatcatttgtgacagagctttgctctgtcccaggctggagtgcagtggcgcaatcttggctcattgtaacctccacctcccgggttcaagctattctcctgcctcagcttcctgagtagctgggacaacaggcgtgcacaagctaatttttgtatttttagtagagatggggtttcgccatgttggccaggctggtctcaaactcctgacctcaggtgatctgcctgactcggcctcccagagtgctgggattacaggcgtaagctactgcacccagccccatttttattatttatagattccttcattatttgtttctttttttatcttacaaggatggaatgctgtgcatcagcactgttcagaaagactttctgggtggagtgctaattaagttgggaaggggattttataacagggtaagtgtcctttagtaggtaccctttcagtggagatctgaagagaagaagccagctttgccaagtaaaataatttcatgaagaagcattaacagttttaaagacctcataggaaggagttttgaggaaacaggagggaggctggagggcaagaatatactgtataaggggaagacttaatgagatgcgaaattggagaggtggccagagtcagattcacttatcacgtatttactggacaccaaccatgcgcacagcactaaggatatagcagcaaacaaatccatgctgtctttgagaaaaagtacctgcctttatgatccttgcagataatgcaaccattttattcaaaatgggagagaaaaccattccaccgttgaatcaagggagtgacacaatctgatttgcttttaaaatttactctggttgtgctgagaataaatggaggaaggagagaagagtgaacaagggagtatagtaaggaatttaactgctgtaatctagattaggggaatggggacttgaaatgattgctggagatgtacagaatatcactagcgtatcaggaagcagcacaaagaattatgggctggcaatgctagggtatccagaaatttcattagttattgaattattgtccatcttttaaaaaaaagtggcatttaatcaattctttttttttttttttgagacggagtctcgctctgttgcccaggctggagtgcaatggtgcgatctcggctcactgcaacctgcgccccctgggttcaagcgattctcctgcttcagcctcccgagtagctgggattacaggcacccatcaccaggcccagctaatttttctgtttttagtagagacgaggtttcaccatgttggtcaggctggtcttgaactcctgacctcgtgatccgcccgcctcggcctcctaatatgctgggattataggcgtgagccaccgcgcccggcccacatttaatcaattctaaaagtcacaactttccctgttttaacaatgaaattgagttaagtgttaacacttggtgtcatgttaacagtctatatcagcaaagcagcagtcctggtatatttgtttgcccgtgtattcacaaatataatcatgtccattcattttgtcatcatttcagctgaggtatgagcattgttggcatttcccatgttaactttgttgttcagtgtttctgcataaatattctgtgaatcagcattgaaacaaaattacccggtatggagaaagttatgaaaacagtttatgatggtatgtgattaaactctgtttaaataagtttaaaaaaactaactcttgcaatcagtattaagtaaaaattctagggcgggtgcaatggctcacgtctgtaatcccagcactttgggaggccaaggcgggcggatcgcctgaggccaggagttcgagaccagcctgggcaatatggcaaaaccctgtctctactaaaaatacaaaaattagctgagtgtggtggtgcacgcctgtaatcccagctctttgtgaggctggcacatggtaattgcttcaacccaggaggcggaggttgcagtgagccaggattgcaccactgcactccagcgtgcagagtgacactctgcctcaaaaacaaacaaacaaaaccctaaatttatgataaagttttgtgtcatgatttatttggaggcatttccactatttcttttcagcatgtacaacagtggtgtgtcttataatcagtggcatcttagatttgatgaaataagatagcattaaaatggcatttgtagctattagtagtaacatttgtaattagttttacgttttctttattaacatgattttgtagctggcaggtaaataattctcccccccaaaagccgagaggtaaaaagtaagatttcaatgaagcattgtattttctgtttgtactcaaatcacattgttgtttgaccgcttattcttagcttttgtattatttcgctgtagctcctttcatttgactgttagaagagtggggacatctcttggacaaatgctgaattacaggcaagacttggttagtgctgagggcttgacaggtgattctgttatacaccaacatttgaggccccaactttggttttcagtccgctagcagaggatacctaagttggctgtggaatttttgggtcttcaatccatatgcataccaaacattgtctataggccaactaaataatatatttcagtatgtgctcctacttacttaaatgctggtatgctattgtgattaataaaatacaactttgttttaaaacattattgcagcctactagttttttgtctgtattttaatcaacaaaccgtattagtacaactgctatcgtgttaggtttgcaaaaatctttgaggttaaaagtgctaatatttgaatatgttctaggctagggaattctgaatctaactagcatatctgaggactgcttgtcagtttgtcagtattactggcagatagaaggtataagcagaggagattaaagaaaaaaagaaacatatatatatgtttatgtgtatttatttatatataaatatatatttttctatatataaatgtatatttttctatataaatatatatatttttctatatatatatatatatatatatatatagaaaaacatagaaaatgaataggaatttaaaaagaaattttttttttttttgagacatagtgtggctctgtcgcccaggctggggtgcagtggtgcaatctcagctcaccgcaacctccgcgtcccgggttcaagcaattcttctgcctcggcctcctgagtagctgggactacaggtgcctgccaccatgcctggctaatttttgtatttttaatagagatgaggtttcaccttgttggccaggctggtctcaaactcttgacctcaagtgatcctcccggctcggcctcccaaagtgctgggacaacaggcatgagccaccacacccggccaaaaaagaaaaagaaattcttagtttgtcttttgtagcaattttggaagatgagaacagttgcataccttatttatttaagttattccttctctctcttttttttttttggcaacagagtctcgctctatcgcccaggctggagtgcagtggtgcgatctcagctcacctcaacctccgccacctgggttcaagtgattctcctgcctcagcctcccaaatagctgggattacagacgtgtgccaccacacctgggctaattttgtatttttagtagaaatggggtttcactgtattggtcaggctggtctcgaactcctgacctcaagtgattcgctggtcttggcttcccaaatgctaggattacggacgtgagccaccgtgcctggcccttcctctcctttttaaattacatcatttgtccttcatttccattttgacaaggtgacattttctgagcacactactattaccagagatggtaatgggttcaggtacaatggtgtgtgacactgggcaagttaagatacgaaaaagtggtaacagttctttccatttaccctcccttcttttttatttctgtctccgctgtgttgtcagtatgataaattcagaaattgaatctgtgaagggacttcccgaacaatgtggagcttctatccttgaaccaagggtgctgagggctaagacttgaaacttgaaaaaaaattttcagacctaagttttactttttagtcacacatacttctttctctcaggtgtgcaagtaaaagttgacttacttttacaaagaaacaactagggaaaaggagaattattaaattttgtttctcaggcgtggtggctcatacctgtaatcccagcactttgggaggcttaggtgggcagatcacttgaggtcaggagttcaagatcagcctggccaacatgctgaaatgccgtctctactaaaaatacaaatattagccaggcatggtggtgcatgcctgcggtcctagctatttgggaggctgaggcaggagaatcgcttgaactcgggaggtggaggttgcagtgagccgagattgtgccactgcaccaaaaaaaaaaaaaaaattgtttctaacttgtttattttctaaatataaattagtcattattctttagttatttaaggagagaaaatgaacatattttttatggtctaccacatttgaaagtatattatagcaacattaaatggactaagacaaaaaaagacaaatagactatataacaagattcagatacttctacctctaattttttcaaatgaaaattttcagccaaaaaggagtgaaataaagtgaccaaatagcatattctacttcttacacttctttgaatagtacttctatttccagtcttctctctctattgacaatgcgggaggcataggcttgatgtgcttggtgggaaaggggagcttatgagctcactgactggaagatgtgttcatagtgaactgtaaggtgcaggcttctgaatgggagtttgttttgagcaatgggttttaaaacgtctttgtagaaaagctttatgcctatggatggtttaaaatacaccccaattctttattgtacgcagggaaggattttttttttttttttttgagatagggtctgactttgtcacctagagtgcagtggcgtgatcttggctcattgcggcctccacctcccaggctcaagcagtcctcctgcctcagcccccgcaagtggctgggactacacatgagcaccaccacacccagctagttttatgtgtttttcatagagatggggattcaccgtgttgcccaggctggtctcgaactactgagctcaagtgatctgcctgccttggtttcccaaagtgtttggattacaggcatgagccactgcacccagtcaggactttttattcaaatggatttttcggttttctttaggaattaggtgatgctcaagaggagaaatcagatgaaataagttgaaaatctaaattgtgtgttattttttaaaaaatgcagttttaatattttcaagtagatacagaaataccaaataaaaatgttgtaaagtataggttataaaattttgttaataaatgaagattgtttacagttagcagagttcattttatttttactcagacaatttaaagttcgacactcatttattgaacaaatactgttaaatatctaccgtgtgcccagtcaatcaccttgtagtgtgcagaacagattcaacatggacaaactaggctgggaggaggctgacgagtttgtcgttttaaggcaggtgagagattattatggcctaaactaattaatgtgttaggtgttgggatggaagaaaacaaataattttaagagattttaaaaactcttttttgatacaatatggaatgcatgtaagaaatagaataaaacaggtgtatagttaagtaaattataaagtaagcaccctcataaccactacctaggtctagaaatagaactttcacagccacccagaagtcctgtacgtgaaccaacccagccagaactctcccttccctctaaaagtaaccagtgttctgggttttatagttatcatgcctttgcttattatacttatcacatctgatccttactatcatagtattgttatcttgtattatatgttaaattaatatcattcctaggtatcatccctaagaattatgtctttgttttgtctgtttttcaaaaatatgctttaaatctcttaattaccgatttgcccttaattcctccttttttttctcgtgcagttggagcatttcttggcttattagctggaatgacaattccatcatctttgtaatatccatgtttatttcagtggaatgacttctctcctggttgtaggtcatattttcctacttcgtgtgtatagaatttgtggtatgatggacattttggacacaaggtgattgagtatctggattttggtaccttccttaatgaagggttgttttgtctggcaagagttaatttacttggggattaacttgatcctttcaagacttgcttttaaactctgttaggcctggtttagaatagccttttctctaggctacatcagctctactcctaagcttgaccttttagtgtctctactaaatgcctctgctgttctccccactatttggaacttgaatttttcccagccctatggggttcaggtagttactcaactcatggctctctgatagttgctctttctccagtagctcttgatcttattttgtggcagcttgccctatacatgcacagcttagtatttggccaaagactcaaggggacccttgtcaggttagacagtgctgcttttctggtaagctcccttctctgtgttttgtttttaatttttaatttttttttttttttttgagacagagtctcactctgttgcccaagctggagtgcaatgtcgcgatctcggctgactgtaacctctgccccccaggttcaagcgattctccttcctcagcctcccgagtagctgggattgcaggtgccccccaccatgctcagctactttttgtatttttggaagagacggggttttgccatgtttgccaggctggtcttgaactcctggcctcaagtgatctgcccgccttggcctcccaaagtgctgggattacaggcgtgagccatggtgcccggacctctggtattttgctccgcaaagttttgcagattaatgggaaccttactcattaaactgtctttggagctttgcaagactgctgttctttgtttgggctttccctccctacgccccatactagacatatctgggccatcaccttgtttattttctctcaaggatcatagtcctgtattgcttgttatccagggtctgaaaacagttatttcatgcattttgtttaattttatgatagtttatgacaggaaggcccatctcaccttatggtcaaagtgagaagtataatggtaaatttattgaaagatttaaagcagattaatgccatgatttgtggatattttatcaagatcaccctggtgctctcttgaaaatagacaaaggaggtggaagaaagctaactagaggctgttgcaaactagactggaaatggggtgaaatggttagactcaagaaatacttccgcactagaacagttaggacctgctgttgacttggttgtgggaaatgaatatcaggaggagaaaaaggagagctttggtgtttggcttgagccactggaatggcagtgccatttaatgagacagagaagactcatctctcatcagagtcaccagatgatgggtgagattgaagaagaggaaatcaagaattttttttgataaaataagtgtgagttgcctgttagacatctaaatagagatgccaaatgggcagttggatgtatgagtcctgaaatcagagcagagggcaggcctagaaattcatcagcatttccgttgtattttaaaccatgtagtagattaaagagtttagatggaaaagagaaaaaggttagaactgatcacctggtcactggtctaatttagacctggaggtctgatttagaaggaagaacctgtgaaggaaacagagaaagtgcaactggagagtgagaactaaaaacaggagagtgtgatgtcctaatagtcaagagaaaacaagtgtctaggagggattgggccgttgctttgaatgcttctgagagttccagggagatgaggacagaaatgtgtttgttagagttggtaacttagaattcgttggtggtcttgatgagttgtttcaatggaggggtagagaaacaagccagattaggctgcttttatgaggtaaagggaatcttgtatgtctgaaatattttaaaattaattaaaataaaaagagtgaatgggagagggagaggaagaaggagagatagcaggtgtggaccagctgtcttcagggcaggcatttgaacaccttggagttcacagagactctgcagtggtgtgtgggcagtttcagattctcaactcccatgtgtcattctctggattttagttggccgaaaacatacctgtgagatcatctttcccctccctttttatggttgcactttgcccactctaactcctgttcatccttcagctctcaggtgttccttaggaaactttacaagatcccaagactacgtcaggatctcctaattactctcttacagtattgtggatattttctttataacactttttacatatgaattatacagttacttaaaaagtattttcattcatttgacaaatatttgagtactatcattgtactgtgtattgttctgggtgctgatatacatcagagaataaaaaagaaaaattcctgggataggagagacaaacaataaacaaacagttataaataccaagaaaaaagtagatcttggttagggagattggggatgtatattagagtcaaatcataagtgaaaatggggtaataaggatgagcctgcttgagactttgattttttttttttttttttttttttttttttttgacagagtcttgctctgtcacccaggctggactgcagtggcaccatctcggctcactgcaacctccacctcctgggttcaagccattctcctgcctcagcctccccagtagctgggattgcaggtgcgcaccaccaggcccagctaatttttttgtatttttagtagagataagattttaccatgttggccaggctggtcttgaactcctgacctcgtgatccacccgcctcggcctcccaaagtgctgggattacaggcatgaaccaccgctcccagccgagactttgacttttgaacagacttcaacagttaagggaaggagagagcctgtcaaagggagcagtgagtgaaaggccttaagtcaagagggtgactgacatgttgaggaaaagcaaagaggtgagtctggctggagccgactggatgagagagaggagtataagagatgaggccagagaggtaacagggccggatcatgtagagccttctaggtcagcataaggactgtgacttttactgtgagtaaaacgagaagcttttgataattgcaagcatattttgacttctgctttaaaaagatcactctagatgctctattgtgaatggtgagatagatttgggagactgttggtgtaatccaggcaaaagataatggtggcttagagcagtgtgatggtggaggtggtaagtttcaggatatattttgaaaatgggaagagcaggatttcctgatgagttggatataggtgtaagaaaaaaagagactcctatgtttttggcttgaacaactggctggatgcataccatgaatcaaggcaggatgagtgaagcaagtttagaggggaaggccaggaggtcacttgcagatgtgttaacagtggggcagatatttgatactccaggaaagtaaaggtacatacgagtatggatttcagtaggaggtaaacatttgggagttatcagtatgtgcatgatactgaacggtaaataccaagggaatgagtataggtggaaaagagaagcctacaaaggactgatgcttgggacactcctgaggagttgggaagaaaagcttagggtaagataggaggaaaagcttagggtgccataccttgaaagccaaggaaagagagtagaataaggaagagggattgagcagttgggtaaaatgctgctggtcaggtacagtgactaaggatgcatcatgggtgctagcaatgtggaggtcgtcagtgaccctgatgaattgcatagatgattatttgattaaactctatttttcctattaaagcttccatgataaaagggaccaaatatgttatttctcattattatatctccaaaacttagttcctggagtgcataaatgggataaatacataggtcccagagcctctgggaggactagagaactgggctccgaagttatatagacaagaataatgcctcgaatcaatcacacttctatattgctttagtgatgacagtgctgcgtggcacaggcatgtgagtgtgttacgccgacatcactgacactgctcaccaccactggagcctctgctgttggtgtgtctggaagcctgaggtagctgctgcctctgccacccactgctggaattgtctgtaaatattcatgtcccggcttcttcatgtcacaagattctgtttcaaagtacatgacgaatgtgtctgattgaggtgattaggtcatgtacctgggctttaatcacaagaaaggctgggcaacaagtatgtggcattttcaatttctgttgtgggaggtagactctgcctttaaatgtggagttcccacacatgctaaggaattcagatatcacacggcgaggaagagtgatgaatgcctgccacggtgcgagataaatagattttgtggggtatacgtgtaaaggtaatagttgaaaccataggattagggaagggctattttggatggttatttgtacgggttgttcaccaaacaagagcttcctgctgatggagcccgtaggccctaaaattcagcctgtgcttcatggtgatgttgcatctacccaagaagggttgctttttttctaattcgcataaagttactctgtggattagtgaaggctttggattcaggctatagaatccagatgttccaaggacaggaatttagaaaatgtctgcaggtaggaaaggaaaagggtggagtttagagctaggataattctttaatggaagccggttgaaaattttaaagacgttccttctttaacttaaatttttttttttctggtaccagctagagtttgcaaaggaggtgaactgacaataactattaggtttagaaacaaggaggttttttatttgctattttagatcgtatggttcagtggagaggtgaggatagaaactggctgatcattcattcatcattcattccttcatctaacaaaagaggaacagatagagaggagaagtaatttttaacgactgcttacatatcagacagtgcctgaggaatacagaagacagtttctaaaagagttcacagtatggtatgttagagaagaaaaactattgctaatacaatggggtaagtgctcatggagctatgtaagctgtgtagcatgctgtatgagaaataggaggtgtacaaaattcagcacaggagtaggaagggactaaaatatttcctttctagctaattcttgaacgtttggtagccatttcattcattcagtattcattccttaaatgtctattaagcgcttaccagtgtggcagctactgttgtaggtgctttggatccatcagtgaatgaatgaaacaaagatcttagcttttgtggagcgtacattctcgtagagaataataagtaaacataataaatcataaaatatgttagagggtaagtgctatacacaggaaaaagtagagcgaagtaaaggggaaggacacatgcgttcttttttggctgtgttaaattttaaaataaggtgtagattatactgaaaacgttgaacattcattttgttatgaaaaatttcaagcctacacaaaagcagtaagaactgcatgatgaatctccacatgctcatcactcagatacaccagtttcgaaaattttgccacacttcctccatgtattcttttttctttttcctcttttctttaccaaagattttaaagccaatccctggcatgacgtcattttcctctgcagactttaatatgcgtctctaaaatatatggacattttcttgcatagcgacaatggcattatcacaacaactaaacctaatactaacacaaaagaggcatttgagccaagactggaaagaagtgaagtcttcccctagcagcttgtgcaaagggcttaaggatcaggagcatgcttagcatatttgaggagcagcaaggagtccatagtggctaaagcatggagacccagggaagagcgatgagatgaggcctttgcaggctgccgagaggacttgggctctagttggagtcgaatggggagccatgacagggttttcagcagaggactgacaaggacaactttatgtttacaagggtcacttgaagtgctccattaagaaaacactgtagtggagcaagataaagcagagctcagttagaaggttgttatggattaaaaggtatatttttgtttagtggttcattccaggtggtggccgtggagatggcaagaagtgcttggattttgggtatgttttgaagctagagctaactggatttcctgactgcggcttgagagcgaaaggaaggcattaagaagactcataggtttgtggcctgagtaacaggaaggatggagcaggtttgggggcaccatcaggagtagagatgacatcttgccatgttgcccaggctggtctcgaacccctgggccaaagtgaccctcctgccttggcctcccaaagtgctgggattacaggtatgagtcatcacgcttggtcaggagttgagttttgagcatgtagagtttgaaatgtttgttggacatgaaagtgagatgactaggtggatagttaaagctggaagtagggagagaggcagcagaaagcattcatctctgtattccctggattcccaagagcctgtccccagggtacttggaagtactgactgatttatttagagacattcacagagtctgacaagaaaatcactgaagtggtttggtaacctggaaggctctgatatcccttccttccttttctatcctgaactcagtaaaatttgggtaaaaaaaaaaaaaaaagctatgtttttctgacattttctgaacctgaactacttaggaaacttgttcaacagtgtcatgtttttcttcctaactgtagcaccactagagagcgagcttcatcgtaggtaaccaggtggtggttattctgggggtggatgccgtggaaaggatgttgtcaacacagattgctttccacagctgcagtcagcaatgcagactgattgtgatggtatttatttctccttttaaaagggagcatttctaatccccattttggatcatttggaattctgattatatttcccggagttatgtggaagattgacacacaacctgaggatgtgaaatcgtagtttcagctgttatggtagctcgtgtctgtgtgactgattttaaataactaggtgttcagagatagggatcctcctatgcctgcatggttgagtgagcctgaatgcagtctgtggattccctgattcacagggaaaggttggtaacacagaaggggtcattgtctcataaggctgtagtgatcttttgcatacatcggctctcactcctctttgaaaaaaatgagggtgaacaggagagcactgaatctctttctgcctcttttctacaggagatgcatcgaaggtttgagaatgctcctgattctgccaaaacaaaagctctgcaaactgttattgagatgaaggtaagtgagaatctagtaaagaatcttatgaattaccttatacttttaagtgatcaaaaacttccatgtgtgagtgttaggaaatggcatgtaatagtatttcacttatttggagattaagagtgagaatcaatgaaaatgacatcttaaaagaatttcagttttatttccttttacttgtagaccataattcaaattggaccaaaaagagttgaacagaatttctttaaatcagctattcgcagatgtcttggtctcaggacccctttattctcttaaaatgacagactcacttccttcattttaagaaaatgtctgccagataccaagtctgggtaaccatagcttgtcagttttctttcaagtaaaaatagtgttccgtgaagaaaatactgaattcagtttacaactcaaagcaacacgagtcctgtgcttagggacagccatcgtatttcagtacgcagcttcattccatttgtcacacacaatattaaaagtatgtgtactccagagttgagatttttttttattattttttatttttattttttgagatggagtctcgctctgtcgcctaggctggagtgcagtggcgtgatcttggctcactgcaagctccgtctcccgggttcacgccattctcctgcctcagcctcccaagtagctgggaccacaggcgcctgccaccacgcccagctaattttttgtatttttagtagagatggggtttcaccgtgttagccaggatggtctccatctcctgacctcgttatccgcccgcctcggcctcccaaagtgctgggattacaggtgtgagccaccgcacctggccaagatttattaaaagtaatactttttactgcttcttcaagggcggtattaaatgaagtagtcttttaaaaattttatttcttatttttcatttttttcctacaagtacttgacgtgacaaatattaatataatgactacaagtatggtttgatgccattgccttgatttgtgctaaggcactagcagttttgcccatcattgctgtatatctttagtgcagacagtggaaaagtcaagtgacatcatggtattattgtgaaaatagttttgatcatgcatactttgtgaaagggttgagggtaccctgagagttccatagaccatcctttgaaaacctctgccttaagttaatgaatatttagaaatctttaggctgttcagtatagtgattaagagcttgctttctaagttaaactccctggattcaaaatctcgcttcacttaaccaactgtaagatatggagcaaattacctatgcctcagtttctttatcaacaaatggtgatagtaatagtactcatccagtgggtcgttttgaggtttaaattagttaaaacatgtaaaaacactttgaacaggacctagcgcatagtaaacattcaatccatactagctgttgcagctgttatttttgttcacaatctgttctttctcataaaagttcatgtagttagggacctccccccacaactacttcttcatatcctctagaaagctcaatactgtgttttgcattgtgggccttcatttaatatttgttgatatgacaagaatatttagtcaatggtatataaataattttatgtaaatagatacttctgaagtagttatgggaactgttgtcttaatttggatgatttcctcttaaaactttatatcgtatacatctttattctcggtggggaaaggatttaccaaacaaattccgaattagtggattctgggttctttgtagttaattggtagtcttgagtataatcttgtaaagggcctttagaatcgttcagttgcatggttttaccctttccacattcaccacaagtttgttgtgttatttcctgatcccttgttaacacctaagaataaaacacatgaatgtacctatgtccacaaaatgatttgtttaactgccttttgacagaatgaggacgagtaatagtattacttggtggcaatggatgcattttaagttgtgtgaaccttcagccattctgctaagaaggagaaagattctggtggcccagtggggtcaagaggatgtgatgctgaaatcacaacagaaatagctgtgttgctgagaatgtggaatgagcttcagagaattatgaaaatctagtgtagtctttagggaaaatagggaagaaaggtgattgaagtaaaagagcccagtaatcttgaaggtgatgcaattttctttgccctctcctctttcgcctcttcttcctctctttcctcttcttatcccttctcccaccattttccctcattccagcctttccttctttgttcctcttcttctctttctcttcctcccctttctctactatttttttgtttgtttgtttgtttgtttttcctttaccagtggaggaacagggaagaatgactgtactgctctagggttagagttttgctgggatagataaagcagagcgagtgattgggatgcaaatgaattgagggtgatgatgacagagtagtttggacgttggtcctggactgtaccctggatctggaaagagtaaaattcaggtggactgacaggttgggagaaaatgtaaaagttaggaaagtggaattctctgtgaggttgaacaggaaataatcagagtgagggtatgacaggccaggggaagagagttctggatgatgataggatccatcagtcctataaactggatcacccaaatggactggaggatgagatcattgcaattaagggcgtcaaagaattctgacattgcaatcctcggattatggcaagagtggtgattgaaggggatattgtaagccaggtgccaaagacttccaaaaatgggcaggagtgatggagaagtccctggatggcagcaatggggagggtagggtgaaaaggagtatgagctttccataaagggaaacagccttgaagaactgggagaatgtcaaccctttcccctgctcctttgtggtgttggggtgttattgaccttcactggagagagttcatgggaaaaaggttgagaatttggggaatttgacaaagagcagaggatttcagtaagtccagtgggattggttggttaatgatggaagggctggggctggggaagtacagagtagtaaagtgaaaaggaatttttttatttaaatattacacattctaggaataagaaacctggttggaatgactttccttaaacccagcattggtacccgttgggttggtgctagaactagttgagagtatcaggccttaattttctggcctgatttccttggtaggttcttcttctggtcagtcagtacctgcctcctggttttcagagctggagtcatgatccctttttgggaagaaggttttatggctcatgatttggtagtgagggtgctaatttgtcaaaagctgcctttgtctgtgtttagggtaggggagaagttagattatatttttaagggccttgtagagactttctagaggctctgtacaggttccggctgccatgtgatgtacagagttggagttcttacctgggactaaattgtcttgagtggagccccagtgctgctggagatacacttccctctttcagctggtccagtttcattaccactcaggctgatgacagaggagaacttacctttaactttcactttctttcatttgtaggctagtcatatgcttatgcctagtattttagtcttttttaaggtgctgtgttctgatatttccagagaaattttatagcaatcttaaaagtgaattttcaggtagtgcaattgaagtagtactttttatgggtcagtcattccacatgagtaaataaaaatcctggtttaggtatagaatgactctgattgtattaattcagtacaatggattttgaacaggtacattttaagtttaatttgaatgaatttataaaagacagttttcattgtgatatttttaaaggtcacgtgatgagcaagacagaggaatacatcctctcctcccctcccttgaacctgaaaatagctaggtgtagttttctcgatataaagccttaatctctctcatctttatgctctgagaataaaggagacttaatcaagaaattattgaggtaaagtagaaaaggagttaatttcaaaatagcttccaaaggaatggtttatctaaaactccaagtgaaataaagctaagctatacttaatttatgctctttaaggtctctatttctttggtgagtaagcacctgcagctacagatacataaaactattcattccatgtaggagtctttctgtaattcatgacatgtaaagtagcctggggagaaactaggtactgcgacaaacaaaatcaagagatcgaatatgaaataatgttctgttggaaggtgatatttgtggtagagatgatggtttataaggacagtgatttttaaaaattaagaattattttaaatgtatgaagtacagacaataaggattgctaacatgataaataacttaattattcccccatttttctgcagtgggatgttatgtaatttttattattgcacatatagctgtacacgttactgtataaatctttgaaaccctcttacttttttcccctcctttggggcataatatgttttttaggggtcaccaagtaaaatgataaaatactagaactagaaaaggctttactattaatattggaaatttttttcaccagaaatttgtaatttctgatgcaaagaaattttaaccagtttttcattgcatttacttcttcagtaatttagtaattattttcaactttaatttaaagggtgcagagctggaggcagccatagaagaaaaatcatactgtggatatgagtgcttctcctcccactcaaatggctgtaaaggacgtattttagaaggaaggcactggctgggcatggtggctcacgcccataagcccaccacttttggaggccaagacaggtgtatcacgtgaggtcaggagttcgagaccagcctggccaacatggcaaaaccctgtctctactaaaaatacaaaaattagctgggcatggtagcgtacacttgtaatcccagctacttgggaggctgaggcaggagaactgcttgaacccagaggcagaggttgcagtgagctaagattgcgtcactgcactagagcctgggcgacagactctgtctcaaaaaaaggaagcaaggcaccaattgccagacagcattttttctgtatatttgtctatctttattaaatgtaacttctttaaatatcatgttattcagcttttctgggtttttgtgaatacttcaatcactaaatcttccattgtcttcaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataaggtaatggcatgtgagacttttgattcttaaaaggagtttgaaaaattgatgcatattttttacttctctagtgatgataaagccgtattttacactcttttatcaggtttcagggaagaatacttttagcatagttctttcaaatgaaacttctccagaattaaagtcagaattactgacatagatagttactacaagtttttacttataaagacaattctctgtatgaggctacatatgtattgtcatggtttaagttttcatatctattagtacttccgaaaaacttccagatgagtttttctcactatatgaaacatcaggttctttacctcttgtgaattatttaaaaagtcaaaaccctaagaggcttgagatggagtttcgctcttgtcacccaggctggagtgcagtggtgtgatctcagctcactgcagcctctgcctccatgttcaagtgattttcctgcctcagcctcccaagtagctgggattacaggtgcgtaccaccacacctggctaattttttgtattttttgtagagatggggtttcaccttgttggcctggctggtcttgaactcctgacctcaggtgatccacccacttcaatctcccaaagtgctgggattacagacgtgagccaccgtgcccagccctaagaggctttttaatgaaatgggtgaaatgaagttacgtttcccctccaaatacagttctgtaacggaaagccctttctttgccctatcctgtggggaagatccacttgctgtcaggtttattgcttcccatgtgcacttcaggcgtaatatgacaaagattgataccaccaagacctatcagtctgtgtttatcatcagtcacaatgttccttccttgtatccaaagtcatttagtttgattctgtaaactatttaggcaagttggaggatttagtttatcacaattatcaatttaccagttttgttgtggtttcattaaacattatgattgtaattataaagtttaagccagaaaataagtgttttccccctttatttcccagttgtattctccaggttcttagaaatgaaacccgcaacatcccagtagtgtgaaggaatgataacatcacttcccctccagtttctggcttcttgccatggtgcccatacctggcatataagtctacagaatattcctctgctacctccagactctattattaattatttctactactttcatttcagttttagaaattaaaaactcacatacccaactttttttttttttctttttctttttttttgagtcggaggtatgctttgtcgaccaggctggagtgcagtggcgtgatctcggttcactgcagcctccgtctccagggttcaagcttcagtctgctgagtagctgggattacaggcgcccaccaccatgcccagttaatttttgtagttttagtagagacgggtttcactatgatggccaggcaggtctcgaactcctgacctcaagtgatcctcctgccttggcctcccacggtgctgggatataatcataggtgtgagctgctgcgcctggcctcacataaccaactttctattagtttggatttttcaccctgatttgagaacaagacatagtgccgtatgatctctgtgtttatgtttttcatttgttgattagcacattccagtccactgtggggggaaaaaacctgtgaacttagaaactacctatggctctttgaagagggaatgaggggaacagatttgattgtattatataagttattgttatttctagttaccattctgcctcaaaagtagacaagaagaagacctaagttgacacataagtgaaaaagaataataatgtcgtgacaggtagaacaactgaaggaggaactaagttcgaaagaggctcaatgggaggagctgaaaaagaaagcggctggtcttcaggctgaggtctttgccgtaagatttacctctttgtgtgcagtggtcccacagtgggaccctgctagctctatggcttctgggtggcttaccctttcattctctatggttggcagctttgcccattactagcactaaccagcctgctctgctctttaactgactcctgttcactagtttgacccacatgtcactttgtgtgcagtgagccttcacgtgttctggaagccttgtacctggtactttattgttgcttttgtcactctgtggatggtatttcaaagcctgtttctttctcaaccctttattgttggtttatatgaatggcggccttcttttcttcctaggtacaagaatatatgcagttgttctaggcctatcacctagagtttatttgaatttgaaactcttgagcaaagtgctttaccttatgtagacattatctttaagtctccagtgagtgattttgccacaaatgttactttctttaggacagatgtatagaaagtatttatctagtaaattgaaattactaagagacttatttcaggtatctaaatctagttcaatattctaatgaacttaaaatttcaattcagaacataataataaaataaatacagttggccctccatatctgtggatttgcatctgtgtgtttaaccaactgttttttattttcagggtaaaaaaatggatgttgtgtctgtgctgaacatgtacaggcttttttcccatgtcattattccctaagcaatacagtatgacaactatttacattgtaaatatttacattgtattacgtattacaagtaatctagagatgatttaaactatactggaggatgtgcataggttatatgcaaattctacatcattttatatcagggacttcagccttcattaattttggtatccaaggtgtgtcttggaaccagtcccccatggacccatggataccgagggatggctgaataataaagtagctaacacttgcacacttactgtaaacattttataacgtgctgagttagacatattatcaactccaaattatagacgaggaaactgaggtaacagaatggtgcctaggaaaacacagctagtaagaggcaggatttggttttatacaggcagtcttcttccacatactgcttacaagttctttactgacctatactaggctgtgcacacatttgtcaaagtgtcagcaaaaactgcttctgaaaataattgtggctaagactggaataaaaaaatacagcatttaaaaaaccaaacttgggctacttttgtagatttgctatttatggtccactttatagtatatattaaaaagggaaatattttggtggaaagggtctaatttggtttatggaaaccatatattggctagagggaaggttgatcaataacttcctttttaaaatagctactattagtaatttctgcattgagtcagacaacaggctaagcacatttcacgctttattttactgaatccataaacagtacagtggcattcgtataatttctccttattactaattaggaaactgattaggaaagtaattattcagggacacatagctagcttagttctgataggtgaatgtctgcaaagccttgtgctcctaagctttgtattatatttgcttcccctttataatgtcttcccttctcagtctttaaggaaaatttgtgcttctaaactctgcttttcttttctttttttctttttctttatttttttgagacagagtctttctctgtcgccaggctggagtgcagtggcgagatctcggctcactgcaacctctgactccctggttcaagcgattctcctgcctcagcctcctgagtagctgggattacaggcatgcgccaccatgcccagctgatttttgtatttttagtagagatgggtttcactatgttggccaggatggtcttgatctcctgaccttgtgatccacccgcctcggccttccaaagtgcaatgattacaggcgtgagccactgcacccggcctaaaccctgcttttcatttaaaatattttcttttctttcttagtctttaaggtcaatatagcattatttgaagcttacttaataatgcagatgatgacgaaacagatttttatatttatttttgaccacgtgattggaggtagctggaaatttgaataatcttagtcatagttctttagctgagaaaatggtaacactttgaacatcccccaaaatattcattcatacaacaaatgtgtttttgttacaatcagtgtgttagggaatggaatagtgttaatgggttgtttttattggtgaagggatatcataaaagactccacgttgttacagtgtgtgctaactcttgggtacatactattttgcaggatgaatatagccaccgtttaaaattatcttccactgatgtttttagtatcctcaggtactttgtatacaataagcatacagaaatatttgttgaatgaatgaataactatatctctaaaaagagattttatgcatatgagaaaaatacttaatcttttttgaaacagaaggctaaattggaaatttatttttggtgttcctcaaaggtctaattttaattaatgtgaaatttatttcttcatgggaaattgttctcaaaagctttatcccttatacctaagattattacaattacaatactttagatacattcaagtttttgaaaatgaaaagataactttttgtttcatcagtgacaccgaaattactgacttgtcaaatgtatacttccaataattagtatcttttttagttccttgttaggtggtagacataatttaaaaggagatgtaatttctgtttacatggcttccatttagggtaaaaaactatttttaaaattcttagaaaacaggaatgtaaagaaggtgttagaaagaaaatactttcaatgttaagagagaaattaatcaatacacataacatcaaattataggattttacaaaaccatgttatgtataacattaaaagtggctttttaagataagaattttatgcaaacttttgagaatgaaaaagataacagtgaaaaattagcacaacagcagcagattttgaattttaaatagtactaggaggtttctaaaaccttttttgttatatctgcactcatcctgcatttgatccatcatgttctgaagaggtctcacctagaaaaatgaaaaccatttcatcagtacagtggtgttcagttgcttactgctgtctcatagtcatctaattgaattggaatttcctttccctccattccctttctaagaggtttcaaagaatatttagaagacacaataaatgaaaactggacatttccctattggttgaataagtttagtggttttttttggctcagggttggggagatccaaggttatgtcatgcaaaaagatgaatatgacctatcacacagttcgtgctgcatttagtttcatattttgtgactcagatctgtgaaagatacagataagaggtgtttgttttatttcttttttccttaaagtgttttacttcttttctagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtagaaacaattctgggatttgtggggagttggtttcttggcaccttttcataagcgttacctgtgctgtttttgttatgtttagaattgggaaatatgagtaatgttatgattaattcttcagcagcgtgatcagtcactgtgctaaaatgtaaccatcttatttcagttgttcttagatctaacaagttaaaacaggtgcagtttatgtttttaattctttaaacttttgccaagtctgtacttcaaagtatactctgacagtattaaaaataaaaggataattgtaaaagagaaatcattgatttagaagcttcagttcaacccctggtgaattttctagtcatgaatgacaatgagcttggttacactgtgtttggagtacatttaagtgtctttaagttgtgatattatgaataactgtatataggaaactggaatctgttaaagttctagatagtctaattttaaaccacagattattagacaatgtgtcttcatatcctgtttgaaaataaagttagtgtttttagaattttttttttttttttgagatggcctctcgctctgttgcccaggctggagtgcagtggtgtgatcttggcttggcgtgatcttggctcaccactacctccgcctcctggattcaggtgattctcctgcctcagcctcctgagtagctgggattataggcgcatgccaccaagcctggctaatttttgtatttttagtggagatggggtttcaccatattggccaggctggtctcgaactcctgacctcttgatccgcccgcctctgcctcccaaagtgctgggattacaggcatgagccaccatgcccgggcagtgtttttcaaaatcttggaagatgatctagactattggctatgacttcagttaggtatccaccatcttcagataggtatatgacttcagatagatatttagtgtatttgctaaataatcccagatcgattcttatctatcttactttcaatgatcgaagagaaagagttgatgataccatgtggatttactgtcttaatataaatattttttaaaggttgcagtgaaatagataatttaagaatagataagtagttttgctttatagaagaaacataaagcatatgatgtagattagctttttttctttaaagaaaaataagaacataatttggtggaaaaaaggaatgaggaggaaaagaaagaataaaaacctcatagtcttagaagacaagaatcttccaataaggaagaatgaagaaggaacctaaactgtttcatgtaatatttttatctgtacaatttggggctttgttaaaaatgggagattttagctgacatgtttgtcatttttcttataacttacactttttctattttagttatgtttcattttgttatgatgtcagctccattctacctcacagagatatttgggtataaaatcatgagatgcagtagtggctaaggctttggctctagagtcatgtttactgagtttggacttccatctttaccacttactatgagtcgcgtgatcctgggaacgtattcaacttccttacacttcacttttcacgtctgtaaggtgaagagaatagtagtgcttaactcataagtttgttgttagaattaaactcgtttatttactgccagtgtctggcacatagtaaagtctttgtacattcgtcattgttatcattttataattcttctaataaaatcaactaatgcatatactgttgagatgttaagagaacatagtatttagatgatctgcattttcttacttttattaagctaaacttaggtttattcagggaattataaatatgaaatcatctagataatgttacctgcaaagttattcatttatagctttattttaaaaattttttgtgggtgcatagtaggtatatatatttatggggtatgtgagatatttaatacaggcatacaatgtgaaaataaattatggagaatggcggtatccatcccctcaatcgtgtatcctttgagttacaaacaatccaattacactctttaagttattttaaaatgtaatagctttattaatcgtttttcacttcagtagcttgagtgcatgcaatacagcaaaagggtcagaagagggtgccagtgttctagaggtcagccgcacttccaagtttgctactgtaatagctttggatggaggtggcaggtgtacaaaccagagaaccaagcagttggttaatgataatgcaaacatttaaaagcttgtcacagtctaataaatgacttttcccccttggcaatccatgcttctctttgtacccccctcaaataatattcttattagccaggtctcacccagatgggcttgtgattggtttcttgtaccatagagaatagattgtatttattgtcattcatgaatggtttttagtttttagccattgcaggagtagctgagtctcagtgattatttctgtaagttactagggccactgcgcaaatagaaccatctcatcataaaagataaaagaatgaaagctaactttctttggaatttgggatgattttaagaatgtaatatgtctatttattagcattgcttaaaaaattactctggtggcacttgacaagagtcaccttttccaatgtaacttgccagtgttagagcccagtaaaaggcagtttataccagctctttgaaagttttcatgtgtttctataatttgctcttagttgatttcatcttttctgcagctatcccagacttcgatctaacactcggattactaaattaagtatatatgaaaaaagaacatggagcatggagtttttctttcatttttatttttagagatagaatcttactctgtcacccaagctggagtgcagtggcatgattatattaatagctcattgcagcctggaactcctgggatcaaacgcttctcctgcctcagcctcctgagtagccaagacttataggcatgtgccaccacacctggctaatttttaaaactttttgcagagacagagtctcactgtgttgcctaggctggtctgggactcctgagctcaagcaatcctcctgcctctgcctcccaaagtgctcggattacaggcgtgagccactgtgcctagcctggagtttaaaaaattttaaaaatcctttaaggaaaacagttacatgtgaaaagatctgtttgttttttgttttgttttgttttttttgttttttttttccctattcagggtacatggactaaggccctctggtgttatacaaggtacagtatatatggaatcgctcccgttttgtaaccatctcttttaatctgatgactttcacagaggtggtctggatttagtaatatagtggttaaaagcatggtctttggtgtcagacataggcttgaaaaccagccctctacctttactagttgtgtgaccttagaggagttactttacttcttctttgtgtgtgtgtgtgtgtgtgtgtgtgtgtgtgtgtgtgtgtgtgtgtgtgtgtgtgtgagatggagttttgctcttgttgcccaggctggagtgcaatagcacaatcttggctcaccacaacctcgcctcctgggttcaagcgattctcctgccacagcctcccgagtagctgggattataggcatgtgccaccacacctggctaattctgtatttttagtagagatggggtttctccctgttggtcaggctggtctcgaactcccgacctcaggtgatctgtcctcctcagccacccaaagtgctgggattacaggtgtgagccaccgcatccattcaggagttactttacttctttaagcctccatttcctcatctataaaatgaggataatgataataacaacttcctaaggtttttatgactaggtgtttaattctgttctcatctgaatatggagggacatttttttattaatttattattttttttttgcgacaaggtttcactttgtcattcaggctgtagtgcagtgccttgatcatagctcactgtaaccttgaacttctgggctcaggtgatcctcccacttcagcatcttgagtagctaggactacagatgcaggccacctctcctggctgattttttaatttgtattttttgtagagacagggtctcactatgttgcccaggatgttcttgaactcctggcttcaagcagtcctcctgcctcagcccccaaagcacaagaattataggcaggagccactgtgtccagccatggagggaaatttaaattcagtgggttaaaaaatttcgaaacaccttacagtttatagcactttgatttgatttgatctttattgttttatttgctcttcatagtaatggcatgggttagacaagataattattgttgttttgcttttataattgagaattttgtgaactgcttattagcataccacttttgactggcacttgaggctactctcactagtaacactgggacttttgatatatcatttacagtattctcaagaattaaagttcttttcttgttccaaaattgtgatgctatactagggacctaccattaaatgtattttcaggatgaattctcaatgtgcagagcagagctgattgtatcaataagccaaaataatgtacaccttactgcttcaaagtagtacaggtttttccccttctccaggaaattgtgttttggaattctgtttattataggtaaggaatataatctatatcttagtaatagtaagaggaagtggttctttttttcggaggtgctcaggagatcagcatctagcacaaggtgaggacctgcccttgctctaggatgttttggcactaggcactagagctaggatgctgttgtttgacgtgcaccctctgcttgcagtcccagcccagttctgacttcttcagcatactaagagttagtaatacattcttagaactagagggcatttttagagatcatccagtctttccgtaatttaaagaatatgtatgataatatctaacctgagtcttgtaccatggagggtttgtatactttcattttcccagttaattcttagagtaaccttctaagaaataagaattgttgtaacattttacagatggggagttaaaacttagagagactgaggttacatgacctagtgcccgatcgattcaaacccgcaaacttgcgttcttgatcataacgctgcaattcctccctgtgcagagagaatatagtgacatgctgaaggcctatacaactacttggtattagttttgggactggaattcatcatttctgacttcgctaattatgatgtgcatagacgaccatgactcttgtttgattggtaggttgaggactagccacaaagaaagatggggagaagaagaaacaattcatgttggtagagaggagaaaaggatttaggttgatggaattacatagcctcagaaagagataggcatcttttgtgacgagattgtgaaagaagagaaagatgtattgattgatctcttcattcaacacggttttgggagtacctgctgagaacccttctgagcactggggatacagtggcaaatgaaacaaaggctgatgatctctatctctatctctatctctatctctatctctatctatctctatctctatctctatctctatctgtgtctctatctctatctctatctctatctctatctatctctatctctatctctatctatctctatctctatctatctctatctctatctctatctctatctctatctctatctgtgtctctatctctatctatctctatctctatctctatctctatctctatctctatctgtgtctctatctctatctctatctctatctctatctctatctctatctgtgtctctatctatctctatctctatctctatctctatctctatctgtgtctctatctctatctctatctctatctctatctatctctatctctatctctatctatctctatctctatctatctatctctatctctatctctatatctctatctctatctgtgtctctatctctatctctatctctatctctatctgtgtctctatctctatctctatctctatctctatctctatctgtgtctctatctctatctctatctctatctctatctgtgtctctatctctatctctatctctatctctatctgtgtctctatctctatctctatctctatctctatctgtgtctctatctctatctctatctctatctgtgtctctatctctatctctatctctatctctatctgtgtctctatctctatctctatctctatctgtgtctctatctctatctctatctctatctctatctgtgtctctatctctatctctatctctatctgtgtctctatctctatctctatctctatctctatctgtgtctctatctctatctctatctctatctctatctctatctgtgtctctatctctatctctatctctatctgtgtctctatctctatctctatctgtgtctctatctctatctctatctctatctgtgtctctatctctatctctatctgtgtctctatctctatctctatctctatctctatctctatctctgcctattgatatatctgtatatatctatctaaatctctgaaacagctgctcagagtaaaagaggactgggtgctatgaaaagagatagggcttagaatctttttcagatgagtgtgtttctctcactgttgtatgtgggttgttgagttatggggtaggggttgggggtgggtgctgcagggtgacactggtatgatattcaagtctgcttgtgaaggtagactggctttggagtgctccttcccctttcagcatcctctctatacctggggcagagcatttgttctagcagcggtacagatgatcatgccagaggcgttctgatctgggaggcttgcttcctgccacaaccactcccccagctccagctggtgagatggcactgcttacggtggtgatggggtaatgtcttgtttgtgggaagatgtagatactgataagcttaagaagttacattaagttacttaagaagataatgataagcttaagaaaatacagttacttaagaagataatgataagcttaagaaaatacaagcataagtatggctcttaatacgctagaaaaatcaaaatggaatgtataagtttcaaaccgtcagagtaaaacccagtttacccagtggagaatagagaagaatggggaggggagagaaagaaatgtgatagcatgtggacaccatgaaaaagaaggctgagataagtacaaatcatgggaaagtcaataaatacaaataagtacttagatcaaaatgaaaatataaatctcagttgggctaaaaagatacagaaagatactgtcaacaagagttaaacagacaaaaagtaacagcaaagttaaaaatacagagatagaaaaaaatttaaaaataaaagttatatcaggaaaataggccttcccaaatatgatttattttaatattgattaaattatcttttaaggcacacagagcaatgttatatgctgataaaagaaacagtagatcaagaaaatataaccgtgccgatcgatgcacctaacagcatggcatttaaatacataaagcgggccgggcgcggcagcccacgcctgtaatcccagcactttgggaggctgaggcgggtggatcacctgagttcaggagttcgagaccagcctggccaacatagtgaaaccctgtctctactgaaaatacaaaaatgagctgggcgtggtggcacgcacctgtagttttcagctacttgagagcctgaggcaggagaattgcttgaacccaggaggtagaggttgcagtgagctaagatcatacccctgggtgacagcgcaagattctgtctataagtaaacaaataaatgtatatatagcagcaatgaggtgaaacagataaatcaacaattgtagttggtcatttggatgtgctcctgtcagaatttgatcaaataaagaagcatcaacataaagttttaataacattaacaagctcaagttcatagatgtgtatatagaattttgtcctaacatagagaataaacaatattttcaagaacttactgaacagtcgtaaaaactaaccatgtactgggtcataaaggaaactttaaaattcccaagagtcaaagtcacatgactttgcactcctaatgcagcaaaattagaaatcaggagtaaagatagtaaagtagtaataaaggtagtaaagaacagcagcagaaaaccaaaataagtatataatcttgaaacatactaccaaaatgacctgtgggttaaaggaaaaatataaacatttaaaaatgagtggcagtgaaagctctctatataaaaatttgtggaacataattagaaaaaaatctgtggggtgtaactaaagcagtatttagagggaaatagctagtttttaacatatttatcagaaaataagaaagaaaagcaagtaatctaggtgttcaaatcaggaaacttagaaaaaacagttaatccaaaaacaataaagaataataaatataaggtgagaaattaatagagaataaaacaacaccaagaggtagttatttgaaaaaggttaataggacaggaacagctcttacagatgataaaggagaagtaactactagtactacagagtttaaaaataatataagacaactctaaacaattatattcgaataagcttgaaaaacaagaagaaataagtttctggaaaaatataaaatgacagaagaagttcaagagataagagaaaacatgaacaacagtcgttatagaaattgaaatggtaatcaacctcatccctttttccctcccaaatcctaaggcccagatggctttcgaggagaaaatatttgatattttctttctttttttttttggagacagattcttgctctttcgcctaggccggagtgcagtggcacaatcttggctcactgcaacctccacctctcaagttcatgtgattctcctgtcccagcctcccaactagctgggactacaggtgcatgccaccacgcccagctaattttttgtatttttagtagaaatggggtttcactgtgttagccaggctggtctcaatctcctgaccttatgatctgcccaccttggcctcccagagtgctgggattacaggcatgagccaccgcgcccagcccaatatttgatattttctatcaaatatttaaaaatagtcattttcatcctcaagttgttccccactccccaagaaaaaacaagaaagcctaatactctacccaaggatatgaggaaaaataaataaattaaaagatactccatgtcaatagatggtataatttaatcctgcagggatatcagttttcctgaagttaatgtatatattcttctgcatttccaattaaaacaccaagcagtcggccgggcacggtggctcacgcctataatcccagcactttgggaggctgaggcaggtggattatctgaggtcaggagttcaagaccagcctggccaacatagtgaaaacccgtctctactaaaaatacaaaattagctgggcacggtggtgcgcacctgtaatctcagctactcggaaggctgaggcaggagaatcacttgaacccaggaggcggaggttacagtgagctgagatcgcaccactgcactccagtctgggtgacaagagcgagactccgtctcaaaacaaaacaaacaaaaaaaacaaacagtattttttaggaattcattttattttaaattttgtaaggaggagttacaaaaagacaaatactacatatgattccacttgtcatacctagagtcaaattcatggagacagaaagtagaaaggtggttaccagcggctgggaaggagagaatgtggagtttaatgggtatagaattttagttttgtaaggtgaaatgagttctggagattggttgcacaacagtgtgaatatactcaacactactgaactgtagacttaaaatgattgagatagcaaattttatgtctgtatatcttacctctattaaatttttaaaaatgtatatggatgaataaagctattctaacattaaacaaaaagagaagagaagatgggagaaccctgccctgtgagacatgaaaatacagagtcataaaccaaacgaaaccaaacagtgcacctcagaacagtgcggtaactagcacaggaaggagcagatatgaaaagaacagggagtgtgaaatcagaaacatttatgtggagagatagtcagtcataaactagtgcaaaattaagcaagtatgagaaaactgacataccatatggagaataaagttggccacctacttcatgctagatgaaacagtgaactctagatggattaaagacctcagtgttaaagagaaactataaagctaatcaataaaaatgtttagtaggaatatattgggtaagataacttaaatgtctccatcaaatttaagcatttctgttcaagaaagaaaaccattggcaaagctaacagatgagattgggagaagagtttttttagagcctcttaaaatagtaaggattcagataaagaataaaaaagagatgcttgaggctaggtgtggtggctcacgcctgtaatcccagccctttgggaggctgaagcgggcggatcatgaggtcaagagatcgacaccattctggccaacatggtgaaaccccgtctctactaaaaataaaaaaattagctgggcgtggtggcacgtgcctgtagtcccagctactcaggaggctgaggcaggagaattgcttgaacccaggaggcggaggttgcagtgagctgagatcatgccactgcactccagcctggcgacagagtgagattctgtctcaaaaaaaaaaaaaaaaaaaaaaaaaaacctcaaaaatcaatagagactatagggagagggaaggatttgaatagacaattaacagataaagaaacctaagtggttaacaactatgccatgatatcatcaatcttactagtaaataaagaaatgcaaatttcaaagatgatgaaatactatattttgttcatcaaattgataaaaattagaatgtgagataacattcagtgcttgtgaggatttgggcaaacagtaacacaaatgacgtaggtggtttcagtaatcccattccttggtatatttcccagaaaaactttcctgctggtccacaaaaggacatgtataaggatgttcaccacagtattatttgtgggaagaaggaattaaaagcagcataagtgtttattactagggggttggataaataaagtattgtggatatgtaccatggaatactgtacaaaagtcaaaagcagtgatgcagaagcagggatagatataagtactatctatgtttacttttttttttttttgagacggagttttactcttgttgcccaggcttgagtgcgatggcgcagtctcggctcactttacagtacttgttacaagtagtgtgttgtttaaaaaacagcatccatcccgttttttaaaagtaaaaaacaggttgaggtatgtaacattaatataaattgaaaacatgtatgaatataaaaatcaccctctgtgtttctaagatacatattcaggaacatattaaaacatattagaatagctgcatattgaaggagggatgggtattggacataaatggaaaaagaggaaaacaaaacaagagtagaacttcacatgaatcaacgataacacttggacagcggatagaccttggtcctaagtgagatagggatctgaagccaagacctccgcataaatctagtactatcctgagaaaggtcggacgagaaaaaaattcctcctaccagtattaatggcaatatgagagactgacttattctccttggctttgattttgtggagaaaggtctctcatcatgcaggtttgagtttgaatagacataactgctctgaagggacattctctcaacctagtacgtgtagattcccacaggtaaaagcattgcttagaatgaatttacaattccacattagttaatcacttgtggattgtaatctcccctgaaccaataatgggagtaagaacaaatggagtgatcagacccttaggaacgctggataatagaacgagagtataaactaaatgattaaaggacggactgagaggcatgggcacactctccagaatggatgatcagatatgacttgttaggatgttgtttcatgactattgagagcaaaagctgaagtagcactaggtttttaatttttattttcttaatttttaatttttatagagacagaacctccttatgttgcccatgctggtcttcagctcctggactcaagtgatcctcccaactcagcctctcgtagtgttaggattacaggcgtgaggcaccgtgcccagctagcactagctgtttagtacagtgtgtttgaatcttgggtctgccacttgctgtatgagtgtatacttttttgcctcagttttctcatctgtgagaagaataatagccttaccccataatgttgtgagaattaaatgttaattatctatgtagtaacactcagtaaatattagctattataattaataaatgcataaagaaatgatttaaaacgcgaggaaaaaaacaaaggtactgtaaataaaaccaaccgggttataaaagatcaaaacaggattttagacatgaaatatatagtaactaaaatggaaaactcagtatattagtgtagttgcagattatagagagctgcaggaacagttagtgaattggaacatagatctgatgagctattacccagcaagcaataggaaagataggaagatagaaattattaaaaagaactctatgtaaattgagcccaacttatatgtaggagtttcaggagtggataaagagaatgggaggcaatcttaagagagaattgctgagaatttttctgattttgatgataggaatggattcttcaattcaggaacaaattattcttgagcaggaaaatatctacacctacatacagcatagtggaaccatagataaactaatcttaaatactgccaggtagactgggcatgatggctcacgcctgtaatcctagtggaggtcaaggtaggaggatcacttgagaccaggagtttgagaccagccggggcaacagtgagactgcgtctccacaaacaacaacaacaacaaaactaacaacaacaacaaaaaactaaccaggcaacaacaagaaaaaaaacttaccaggtgtggtgtgtacatgtagtcctggctactcagaagtcgaaggcgagagtatcccttgaccttagctaagggcttcagggcagtagtgagctatgattgtgccactgcactccagcttgggcaatagagcgagaccctgtctctaaaaaagaaaacaacctgctggggagaaaaaatacattacgtgtaaaggattaacaattaggccaacatcagacttttcagttgccacaacagtagtgagaatatggtagcgtaaaatcttcaaagtttagtgaaaaacattggcaactcagaattctgtaccaagctgaactctcatcattcttcagtaaagatagaagaaagacttttactttcagattaatacaaatgagagtttactacccaggatccctatggaaacaactgttaaaagatgtatgttagaaagaagaaaagaatgagatgcaagaaaaaaaaacaggagatgaaaaggcattaatgtaacaggagaaactaatctaatatcaatataatagtatggcatagaccttacagtaatagtgccgttacagccaaaactcgcaaatcaattgaggtttattcagtaaaggtgaggaatttcagagaaagatcacaaaaggaagagcttgtctgttgcttctccttgttggtataatgttgctaaataatacagcaggtggaattctgcatctagattgtttctatcttccctgtcaagagcataggaatgaaataaatggaatatatatttctacagtggcaaaatgaaaatgaagctcaaggtgtgtgaagacagaaattgtaagaaagcgtaaagacctctgcaatggccaggcagagtgactcatgcctataattccagcactttggaaggccgagacaggaggatcacttgagcccaggagggttttcacatagagaaagctataaggaattctccctttctgtgagggttttcacatagagttataaggctttgttgatcttagttctgataccagaacgaggaagtgttatgttatgtgttggcttaaggggtcaaagtaggttggctgactgccatgctttatcaggtttgcagaggccaagagttccttggggctgcatacctgaatagcacttattgcagtatactttgtgtagccaatactgtgtcttctttgtctgctatgagttttcaagggaaaatgagtgaaggtatcaacattaatttttcagaatataaatttgcgaaacgtatagtctttttttttttttaaactatgtactgtggaatgactcatttctaccttgactattttgatatctgagcttttcatctttttgtcaagtatggggtatcaaacagagcacaattgcagtttgttgaaacagtactctaaaacagtttacttccgtgtggtctgtaatgctgtcagtcccatggctcagtgcccttcacgtagcattcagcctcccatctaggtgggaacaatgggaaatgcagtcataggatatatcatttagagtggacttgagcaagttacttaattagtttgggccttgatttttctcagctttaaagttgggagtttaaattcagttatttaactgttaaaaaaatttatgaagtactgtggaatacaggaaaattgtagaaaatataatagataccagtcagatttaacatacattaaaataaagaattcttaaaaatgtctcattctaaactaatcaatggaagatgtggtttaaataaaagttattagaattttaggtttttagaactagttggggccaggaataaagatttggaagctgtggaggtggtggtgaaagccttagaattggattagtttctccagaggaggttccatgcagtgagatgtgaggaggaggaaatgacagaggatggagaacactgaaaaggtgtgatcacagagttagaaaggaaaagtgtcatgttggcaaagccaagaggggaatgataggaaacaagccacatatccatgcaactaattattactactaatttgcctttagatagatctgtttattgatttaaaacaaaggaaagttaaggtacgttgagagaattggttttttttaattgaggcagagtctctctctgtcacccaggctggagtgcagtggcacaatcttggcacactgcaagctccacctcccgggttcgcaccattctcctgccttagcctcccgagtagctgggattacaggtgcccaccaccacacccagctaatttttttgtattttttttagtagagatggggtttcaccctgttagccaggatggtctcgatctcctgaccttgtgatccgcccccttggcctcccaaagtgctgggattacaggtgtgagccaccgcgcccagccagaattaattgttttttgatcagaagtgagaggccaaaacagtagggtagccattttctgttcacttccattggtagagaaaaccttgtagacaaaagccttctgtttttattgaagttggcatgacctgtttgctacagacaaacttggcaagttgggcgaatgctgttcctgcagctctgctggtgtgaataaacaaggttttattcctcctgccaggactggtgtcagggcaatgactgtgtgtgtcctgctggtctttgaggggttttcctgaatatgttttttgtggtttgtaaaatatggacctcacgcaaaattatactacaaatttagttcactccaaaccaaaagatcagtgtagaattcagagcaattaatctggtagtagcaaagtggtttttgtggtggtttttatctcaaatctccagactagcatatttgaattctgtactgcacaaaaaagcagactaagacaaagtgtacacaggtgatgtgaattgaatacttagtcaataaaagatcatttaataattaggggtatggacgggcagtttctgttcctaatatttattatatgaaatattttttgtatcaaagcctgtgtttccagccacacttatactaaaggtttgtatgtttataacaagagttcttattctttcccttttcagtcacctttttcggtcaccaattcatacttgacactctctcagtgccgtgcgggtatttatgtccggtcagcattgacatgtttccaggtcacttaactgaatcatggatccaatataaagtgcagcttgggcatctgggtgcctttcataaagaggcagcaatgtggggtctcacaaatgttgtcctgtgtgatggtggtgccatcagaatgaaaaacacttagaagtgatgagggatgtgttcctacatacagatccatgtcccgcagatggaaaggcttttttctgaaattaatgcttagaagaactgagagacaagaaaattaggcagttgagacttcaggtttgaatgcctaagctttttgcctttgtagtaagaatttgtgtatttaggacatacaggataaaataatgtgggtttttttttttttaattgagacggagtttcgctcttgtcacccaggctggagtgcagtggcacaatcttggctcactgcaacctccgcctcctaggttcaagtgattctcctgcttcagcctcccgagtagctgggattacaggcatgcaccaccacgcctgactaatttttctgtatttttagtagagacgggatttcacattgttggccaggctggtcttgaactcctcacctcaagtgatccacccacctcggcctcccaaagtgctgggattacaggtgtgagccaccacacctggccggtttttttttgtttgtttgtttttaatgaggtgctttgttttttgcttttggttagaggtagtggtagattaatatatagtatacaaaatacagattagcatgtagtaattagatgcaaatgattatgtgatttatttatttttcaaatttctgacatgtatacttttctaaggctttgacctccttaactgtgtagaagggtcaccagattcagtaagcaccttcgccatgactgatgccttgtaatgggttcagctaataggaaccaaacctgacactgtcaaataggattagtagcaacactggctggcttgagctgtgcctgaatgccagtggataagggtcagtgggttctttggcatcttgagcagcctggttgttgaatttcatattccactaaggtctttactctgtggttgcaatccttttcttttaactgaatcaatattcagtctgttctgacacttcccttttggacctttttttgtttgcatggcggagtgttgtgatttttactctcttggcaaatttcaggtatataatacagcattattaattacacgctgctgtatattagatccccagaacttactcgttttataactgagggtttgtaccctttgatcagcatctccccatgcctctccctgttcctatccccagcccctggtaaccaccattctcttctctgtttctttgagttcaactttattcagattccatatgtaagtgagatcataccgtaatctgtgttatttctgatctcagttttcactgaatgctttttgtccttgtattatgagttgtgtttttctgcttctttgcttgtctggtgagtttgggttggatgccaagcattgtgagttttaccttgttgggtgctaggcattttgtattcctgtaaatattactgaactttgttttgtgatgctggtaaaatacttggaaatagtttcattcttttgggtctttcatttaagctttgttagatggtaccaaaattgcatttattctaaagctagtctcctcgtgcaccccctcccccttgattatattaaagagatttgcaaaaatttaaaacaattatattcttcttactattttagggggaaaatacaggtttttgaaattaaaatgttactttgattaacataatgggtttattgttatttaaaagctgttctaattttttttttttttttaaagatacagtgtcttgctttgctaccaaggctggagtacagtggtgtgatcatagctcactgcagccttgaactcctgggctcaagcgatcttcctgcttcagccccctgagtagctagaactataggtgtgtgccaccacacttggctaattaaaaaaaatttttttttgtagagatagtgtcttgctatgttgcccagggaggtcttgaacttttggcctcaagtgatccttctgcctcagcctcccaaagtgttgggattacaggtgtgagccaccgcacctggccctaattttgagtgtagcaaatattgatagatataactcacataaataaaaactcaataattgggggtcctcagtaactttttttttttttttttgagacatagttttgctcttgttgcccaggctggagtgcaatggcgtgatctcagctcactgcaacctccgcctcccgggttcaagtgattctcctgcctcagcctcctgagtagctgggattacaggcatgcgctaccatgcctgactaattttgtatttttagtagagacaaggtttctccctgttggtcaggctggtcttgaactcccgacctctggtgatctggccaccttggtcttccaaagtgctgggattacaggcctaagccactgtgccctgccggtcctcagtaatctttaagagtgctgaggagtcctgagaccaaagggtctgagaatggtaatggaagggaacattcagaacatttgggtgcctgaggcttctctagagcagggtacttgcccaaagggggcttgggattttgcttcctgttccaacctaacctttgtgttgccctgatatcttattttctgttactggaggcatcttccaaactcagttctccaggtcacggaaacaagtcaatgaaaaagcaggacaggtgtcacttctgttataagcttaccacttcgggcttctagtctctgttttcaacattttagtgatgttgtctctttctctatgtgtacacttctgtatatgcttatatgcatgctgatctatgaatttgaaaagaagtttgttgtgctttacctagcatttctgggtgttttgtagcagtaggtgtggtgggctgaatagtatcctccataaatctgtgtctacctggtactcagaatgtgaccatatttggaaatagggtctttgaagctattattagttaaggtttgagataagatcatgatggagtgggctctaaatgcaatgactggagtccttatagaagagagaggacatataaagatacaaagaagagggtgaagtgaaggtggaaacagagattggagtgatgcatcgtctacaagacgaggagccaggagacagcaagaggcaaggaaggctctttctcagagccctcatagagagcaaggtcctgctacacctttatgtcagacttctaaactccagaacttggagagaggaaaataaatctattgtttaaagccacctggtttgtggtcctttgttagggcagtcctaagagagtaaaacagttaggtttttctggatttctagctcatattcaggtcattatcaggtattttcaggtttttatcaaagcatttcaggtattatcagggagactgttaagatataatgtcatgtcagaaataacacaccaaaaataaggttcttattctctctcgaagctaaaacccatttagtcttcttcatcagaaacctgggaacccatgtttgacttatctctcttttatcccttatatacaaccaataaaagtcaagctcctagacatgacactgatgctttccgtggctaaggccttgtcttctgctgcacctcacataacttaccacctattctatgctttagcaattctctattcatagctctctgagaagttaacatcctttctaatcttcattatttgtggtatctctgctcaaaggttcttccattatcttcctcaccagccatcttctgctcatctttacatgctttgaggtatctccaagcaatctgagtgcttcttttctgtacttttagaaaatattctctacacttctgttgcagcactttctataatatatttatgtgatctattttggcaacattcttctccattaggttgtaacttcagcagaagacaggaaatatcttagttatctttgtgtctccagtaaccagcccagtgtaacttttccgatatacaaataccatgactttctcctgcttaaaaatcttcactgacttccatttgcaagtaggataaaatttaagcctcttattttagcaggcaaggatttatgatctactatcttttcaggcttgtctcttgtccttcttctgttactttatgccaagcaataccaaatgaatttacaagtatatcatgctgtttcatgtttctagattttaaagtattctatttcctcttcctagatatccatgcatttctctctgccttcccttttgtatctagtgatgttctcttcattattcaaaaaccaattcagacatttattcttttagaaaacttttctgactcttctgacatactgttcataggagagatttccctgcctgcctgtgttcacctgtgttcctttatgctggtattctttggtatgtgataacagattataatctttgatgtcatatctagtctttgagttccagtccttctactcaccagttcttttttctttttctttttctttctttttttcttttctttttttttttttttttgagacagagtctcactctgttggcaggctggagtgcagtggcaccatctcggctcgctgcaacctccgaatccctggttcaagcaattctcctgcctcagcctcccgagtagctgggattataggcaagcgccaccacgccaagctaatttttgtatttttagtagagatggggtttcaccatgttggccaggatggtctctatctcctgaccttgtgatctgcccatcctggcctcccaaagtgctgggattacaggtgtgagccaccacgcccggccatagtccttctacttaccagttctttaatataatatgaggtaaactatttaactacgctgagtcacagttttatcatcttttaaaatagggagataatgttagctactttacagtgctaaatgttttaagtgagataggattactgaggataaaagggtgggcaaaataggggccaggagcggtggctcacgcctgtaaccccagcactttgggaggccgaggcaggcagatcacctgaggtcaggagttcgagaccagcctggccaacatggcgaaaccccgtctctactaaaaatacaaaaaaaattagctgggcatggtggcatgcacctgtaatcccagctaccagggaggctgaggcaggagaatctcttgaacccaggaggcagaggttacagtgagccgagattgcgccactgcactccagcctgggcgacagagcaagactgtctcaaaaaaacaaaaaatatatataatttataatatgttacatattatgtatattatttatatgtattatataatacatattatataatatataatatatttatataaattagatataatattatcatatatagtatatataatatatattaatatataaatgtgtaaatgtatatattatataattatatataaaatacaattatatataattatatattgttttatattatatataatatataatccatattataatataattatatttaatacatattatatataatataattatatttatttacataatatatataattgtatataatatatatcatatataattatatatgatatatattatataatatatatcatgtataatataattacaatatatgatatatattatataatataattacaatatatgatatatattatataatatatgttgtatataatacatatgttgtatataatatatgttatataatatataatatatgttatatgtaagttgtatataatatgtaatacataatatatgttatatataatatatatagaaatattggtaagttctgtataatgatgttattaagttctataagtagaaaaaaaagtgttaaattctattacaaaataccctgagaaaggatgagggagatagtatttgtctgttgggggtttggaaaatatttattaaaatggtggcataggaaaaggaccttgaaagatgtgttcagtaggcagattttttttaagtggtagagggttaaggatattacaggcataggacaaaatgtgaacaatgacaagaaagaaggaaagtatagtatttattcagagaatggcagtactgctgcaatggagagccactggaagtggggcaaggaggcatatggcaaaggttaggcagtgctggtacattgggaccgtctgaccatggaggaccttgaattccctgctgtgatcctgtgggttagggtggtgttagagaattagtggttaagagtgtggggtctggaggcaagaccacgtaatcttagatctctgcttatttgtagctgtgagatcttgggcctgctatctcctctgaggcccagtttcccacattgccgtgagagagtgtgaagtttcctgcagggagaatgcaagggaagaaaatacgatacctgagaacagaagtgtgaggattttaatgtatatacagtagtcctcccttaactgcttttttgctttccttggtttctgttacctgtggtcacctgtggtctgaaaatattaaatggaaaattccagaaaagaacagctcccagattttaagttaagcttttttttaggtagtgtgatgaaatcttatgccattctgctgtattccaccctggaggtgaatcttccttctgtccagtgtatccacgtacccacactacctgccccttagtcactagtagctgtctcgttattagatcgactgttgcagtgtcagtgcttgtgttcacataacccttattttatttaataatggccccaaagcataagagtaatgatgctggcatattgttacaattgttctattttgttactagttattgttgttaatctcttactgtgactaatttgtaaattaaatgttattatgtaataggtatgtatatagaggaaaagcatagtgtgtatagggtttgatactgtctgtggtttcaggcatccactgggggtcttggattatattcttcgacgacaaggggggattactgtatatggtgacaaaaatatacatgaacacatgcaggaaggcccagaaaactgtttaattcagaaataaagtagtaaagtaaaacaggtatgatttttttttttttgaggagttgatatgagactgaaatcattgcttaagctgggaggaaaacaaaacaaaacaaaaaccagaatagagacgaatgataaaaaaagaaggacgatagatcagaggtcatgctatggacaaagggtagatttagtaggtgtaggaggaagaaaagaacagtatttgtgattcagaaaaaaaaatttagagtttgaaagttctcaggtagatctttccagattataattaggttaactatgtatattaaagtagaatagaggtaaattacagatgaaagactcttgaaggagcatggtagaacttgtggtgaataatgacaaatgggagctcaaatgattattccctactttctggcttggtgagactggtcgcgtagaagtagttggtagaaatgtagtttagcagagtgaactatggtttatctacatgtttttcctttccagtatggtccaacataatttgtaagtacttacagtagtagcaagtacttattatagcagtctccaatgagactagtcttgttaagaaattttccatactacttaactgagcaggaagtaccaccgcacacacagtattgcttctcagataccttgtagtttagatacactacacattggatatcccttacctaaaatgcacgggactagaagtgtttcagagtttgagtttgggaatatttgcattatacttatgcttactggttgagcattcctaatccgaaaatccaaaatgttccattgagcatttcctttaagtgtcgtgtcagtgctcaaaaagttctggagtttggagcattttggattttggattttcagatttggggatggtcaacctgtattagatcttcctgagtgctttgatgtaccctaaatgtgaaacattattcatattttctttgtggtttaatccacgttcagataggaaaaataagacaagttaaagatgagagaccatagaaccatacttgatttcttagatttgcactgttcagtctggtagccaccagccatttgtggctattaagtacttgcaatgtggctagcccaaattgagatgtgatataaaggtgaaatatacattagatatcaaagagttagtatgaaaaaatataaaatagctcattaatagttttttatatgggttatatgtttgaaatgacaatgaaaaaagaatgtaaaaaagcttattaacaattttcggcttgaaaatatgacttattattttcctgttgaacagcactgaatctatgtgtggggtgctaaaagcttaataaaattttctctgaatggattttaaaataagtatcattagatttcttgttattttaaagttatatctaatgaaaggcattaaacttcagggataaaggtaactagttaccaaactttttagctggttagtcttgctgtctaaaaagtagacctttgcttttgctttgtatggatatctaagtgcattatggggttgtttttcataaaagcctcatagcctatgactagactgtattatctgatatagccagtgttatgcttggtgatgctttttttcccttttcctcattttagattttctaaagcaatgtagcttcacttggaaacttgttagaaatactgattttgaaccccaaccctgttgaatcagagactaagggcttgatttagccctccagatgattctgatgtgcatgaagtttgagaaacatagttgtagagattccattgtgtaacggtgagcacactggactctgaatccagagaaacatagatgtagataatactacttttatagaataacaaaactcaacctctttataacctttataacatatctatttgaaaggaattacattcttttctttttaattcatcacttgtaaaactcctacattcttaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaaggtaaggtacaggtgtttcgagttcagtggcccattcctcatacatcttcactcctaccactaagttatttctaaatgctgtcagagtttcttgctcatttttcagtttatatttttgtgattagtaatttggaactcttgttgcggtaggtagattgttaagactgctctatatattcagtttttaaaaatttaaacactgttagtatcttccagtagtgcttttcatgctgtttctcaaaagtgccttgtaaattgccaaagtgtttgaactgacattcttttgccccttctgtcttttattgaaactgtaccaaattggtttagtacatggacttgggatggtacaacttcatttatgtgtttaataagatgacaattttaagccgagaccagtagcatccagaccaacacataattcatatatgagcaaaaaaaatgtgtgtgtgtctatttcaatacaaatcttactgttccttagtgcttgttatttccccttttttcagttaatatattttggtattctttccaagggtttcttcattgttgttactaacagcattgtatggatatactatagcaaaatttctactgatggacattaattttgctaaaaatttcttcctttacataaaatgattaatagtaaaaaatgttgtacatgtttagtttatacatatgtcaagtcaagtatatttctaggataaagtccttaaagttgaactgctgagtgaaaggatgtgcatttataattttgatggattttgccaagtaaccttaaagagactgtaccaagtttcatttctactatccgtgatgaaagtgttatattcccacatacttgtctgcagagtgtgttaataggctttttcactttttggcaatctgataggtgagcaaacaatgtcagtgtagttggagttctttcattgtaagtaaagtcgaacagacttttatatttaacatcctttgtattttctattatttgtttatatgctttacccatttttgttttgagttctttcctgcttttttaaaagttgatttgtagaaatctcttcccaatttaaaaattagttcttttgtccgatgtgagttctaaacatttcttcttgtttggcttatttattgagatggagtctcactttgtcgcccagactggagtgcagaggcacgatctcggctcagtgcaacctctgcctcctgggttcgagtgattcccctgtctcagcctcccaagtagctgggactacaggtgcctgcccccacatctggttaattttttgtatttttagtagaaacggggttttaccaccatgttggccaggccggttttgaagtccatggcctcaagcgagccacccacctgggcctcccgaagtactgggattacaggcgtgagccactgcaccagcccaccttttttaaaaaataaaaataaaaaagatgttgtccaggctggtctcaaactcctggccctaagccatcttcccatctcagcctcccaaggccactgctcctagctctgtttggcttttgactcgtgtgtgtgtgtgtgtgtgtgtgtgtgtgtgtgtgtgtgtgtgtgtgtgtgttcagacttcttaaataaagtgaatgttttaaggcttctggattttgtgacatattacaaaagttgtattttagaatatttcttattttctagtgatattgatctgtctgtatccagtaacattgtttaaatttttgtgtttttgtgatatatgttaatagctaattccttctaaggtacgtttctttttcagaagtgccctagcttttttttttttcttggctatttttccatttgaaatttagaatcagcttttatcatctcctgcctttaattctttctgttgcattttttattgggagtacataaaatttgtagttattaatttatagagaattgacaagaatggggtatatctttccatgaattcattttttgtttctcagaaatgttttaatgtttccttcataatagattttatacatttattaagcttcttcctaggttttctttttgttataaagtgttatatttttcattacatcttctaactgcttgttttttttgtgcacatgaaggcttgtgatttctctatatcagttttgtacttagtcatcatactgaattctcttaaaggtttggatttttttttagtttattcttttggcttttccaaatatgtagtgttatcatttctaaataataattatcttcctgtgttcagttttaatgtatgtgccccatttccttctccttctacttctgtgtaccacactacatgatactggacatctccacattatacctgatctgaatgagaatgcttttagctctctcccactaaagtacagtgcttgcttttgtgttagaattgatagctacattaagaaagtatccatctaaataaagtgaattaaaacttaaacttttttttattattttttgtttcagtagtttttggagaacaggtggtgtttggtgacatggataagttcttgagaggtggtttttgagatgttggtgcacccatcacctgaacagtggacactgtacccaatgtgtagtctttttatccctcacccattcccacttccccttgactccccaaagttcactgtatctttcttatgcctttgcatcctcatagcttagctcccacttgtaagtgagaacatgcaatgtttggttttccattcctgagttacttcacttagaataatggtctccaactccatccagcttgttgcgaatgccattatttcgttcctttttatggctgagtagaattttgtggtatatatatatatatatatacgtgtatatatatacgtatatatatatatacacaccacattttctttatccacttgttgattggtgggcatttgggctggttccatattttttggaattgcgaatgtgctattataaacatgcctgtgcaagtgtctttttcgtataatgccttcctttcctctgggtagataccagtagtgggattgctggatcaaatggtaggtccacttttagttaaggaatctctatactgttttccacagtggttgtgctagtttgcattcccaccagcagtgtaaaaatgttcccttttcaccacatccatgcaaatatctatttttttatttttaaattatatcgcattgtggttttgatttgcatttcactgataattagtgatgcagagctttttttttttgagatggaatcttgttctgccgcccaggctggagtgaagtggtgcaatctcggctcactgcaacctccgtctcccgggttcaagcaattctcctacctcagcctcctgagtagctgggattacgggtgctcgccaccacgccccactaatttttgcatttttagtcgagacggggtttcaccatgttggccaggctggtcttgaactcctgatctcaggtgatccacccgcctcggcctcccaaagtgctgggattacaggtgtgagccaccgcacccagcccttgttgagctttagtatgtttgttggccatttgtatatcttcttttgagaactgtctattcttttgagaattgtctattcatgtccttagcccactttttgatgggattatttgttttttacttgatgatttgaattctttgtagattctggatattagtcctttgtcagttgcatagtttgtgaatattttctccaattctgtaggttgtctgtttactcttctgactatttcttttgctgtgcagaaactttttagtttaattaagtctcatctatttatctttttgttgcatttgcttttgggttcttgttcatgaagtctttgcctaagctgacatctagaagagtttttccagtgttatcttctagaatttttatggtttcaagtcttagatttaagtctttgagccatcttgagttgatttttgtataaggtgagagatgaagatccggtttcatttttcacatgtggcttgccagttatcccagcaccatttgttgaatagggtgtcatttccctgctttatgtttttgtttactttgtcaaagatcagttggcagtaagtgtctggcttcatttctgggttctctattctgttccattggtctgtgtgcctgtttttataccagtaccatgattggttttggcgactatagccttgtatagtttgaagttgagtaatgtgatgcctccacatttgttcttattgcttagtcttgccttggctatgcaggctcttttttggttccatatgaattttaggattgttttttctagttctgtgaagaatgatgatggtattttgatggcaatttcattgagtgtgtagattgcttttggcagtgtggtaattttcacaatattgattctacccatccatgagcatgggatgtgtttccatttgtttgtgtcatctgtgatttctttcagcagttttgtagttttccttgtagaggtctttcatttccttgtttaggtattttactggtttttttttttttttttttttttttgcagttattgtaaaaggggttgagttcttgatttgattctcagcttggtaactattgatgtgtagtagtgctgctgatttgtgtacattaattttgtatcctgaaactttactgaattcatttatcagatctaggagcttttggatgagtctttagggctttgtagttatatgaccttatcatcagcaaacaatgatagtttgacttcctctttactgatttggatgtccgtgatttctttctcctgtttgattgctctgacaaggacttccagtactgttttttttttttttaaattttattattatactgtaagttctagggtacatgtgcacaatgtgcaggtttgttacatacgtatgcatgtgccatgttggtgtgctgcacccattaactcgtcatttagcattaggtatatctcctaatgctatccctcccccaacccccaccccacaacagtccccggagtgtgatgttccccttcctgtgtccatatgttctcattgttgaattcccacctatgagtgagaacatgcagtgtttggttttttgtccttgtgatagtttgctgacaatgatggtttccagtttcatccatgtccttacaaaggacacaaactcatcattttttatggctgcatagtattccatggtgtatatgtgccacattttcttaatccagtctatcgttgttggacatttgggttgattccaagtctttgctattgtgaatagtgccgcaataaacatacgtgtgcatgtgtctttacagcagcatgatttataatgctttgggtatatacccagtaatgggatggctgggtctgttgaatagaagtggtgaaagtgggcatccttatcttgttccagttctcaggggaaatgctttcaactttcccccgttcagcataatgttggctgtggctttgtcatagatggcttaaggtatgtcccttgtatgccaattttgctgagggttttaatcataaagggatgctggattttgttaactgcttttttggggtctattgagatgatcatctgatttttattttattttattggtattagttttgatctttcaatagtaatattttcaagtaatagacttaatagtttcaaaacatttttcacttctcatgcacttgatcattgtatatttttctcccattgtgcttctcatacatttacttcttattaggcacaataacatgttggtaagaaatatgaccagacaacttttagtggattagaagttacttgtaatttttactatgattaataatgcgtaagccttttgattccatttcctattaaacttttctttaagtgtaggatattattagtaaaatacgaatttttaaaatttcgctggttattgcagttgtggagtttgtgaggaggggagtgatttaattatttgatttcatacagtgcaagtttctgaaggcatctggatgcacaaagactcgattcaccactgtgccagcagcctgtttgttgctctaggctgattatacccaaaatgttggtgacatgatggattatcactttcattaggtcataagtgttaggggcatatattttacttttataacatttgtttttcagctcctattttctttgctctcattctataaggattacttcatttaaaaccaaagtgttgaaagattgcgtgggtcttcagtcattaaactttgcctttcagatcatgagaacatgacagcaagctactaaaaaagccttagatgattaatgttactggaagaaaagatatactggttagaattcaaaggttgtttggaagtaacgcattgcttatttttaactaggtaaaaatttttagaaaagtttttgtattagtccattttcacactgctataaagatactacctgagactaagtaatttatgaagaaaagaggtttaattgactcacatttccatatctgagtcgctagggaggctttgggaatcttataatcatggcagaaggtgaaggggaagcaaggcacgtcttacatggcaacaggagagagacagacacacacacacacatatcatgcaaatcttgtatattttttctttgtccttcctcttcatccttcacagaaggcagcagaggatcagtaattgtgctgtcttagtacaccacactgccccagtaattcatcatgttacaaacttttatgtgtcttaaaacttaccagatagtacaactgttttcaaaattggtttatgttattagtgcttcttttttattttatttaattaattattttttgagactgagtctcactctgttacccaggccggagtgcagtggcgtgatattggctccctgcaacctccgcctcccgggttcaagtgattctcctgcctcagcctcctgagcagctgggattacaggcacctgccacctcgcccagctaatttttgtatttttagtagagacgggatttcgccatgttggtcaggctggtctcaaacttctgacctcagatgatcctcccgcctcggcctcccaaagtgcagggatcacaggcatgagccaccaagtttggcctagtactgctttgtagacaattacctttatgcctgttattttcagtgcttagatccttcccattctgtgtactttttttgttgacgttactgtattaaggtggtcagaatcaacatttgtgatgtatttccagcaccattgttggctgataaaatagagatagctttaaatttagtatccataaaaaataaaatgaataccgtaggtttagagaagtttaaagttctcaagggatctatgtattttttaaaaattatataaaaataactttaaagtaatctttttttcttggtaaaacgtgcagttttatgtatttttaggcaggagtaacaactttttccacatttccatccagagaacaaaggtcaaaacagcatttattattctagctatagttttactgtttaaacttttgaaattttgtgtagcaccattgagagaagattagtgcttacagctgaaacttagttttaatacagtatcatatatacatatatattggttgatttgtttttgagacagggtctcactgtgttgcccaggctggaatgcagtggtgcaattatggctcactgcaacccttgtgtctggagctcaagcagtcctcctacctcacttcttgagtagctgggactacagacacatgccaccatgcccagctaattttttgtattttttgtagagatggggtttcaccatgttggccaggctggtctcgaactcctggactgaagtgatctgcccacctcggcctcccaaagtgctacgattacaggcatgagccaccatgccagacatctttttttcattttttgttatcatttatttctgaaactcagccaatatgatgtatagagacaaatacatagatattgactggcaaaaagtcatggagataaagtgtattacttgaacaagacttcagattgaatattattattctttagttttcattcatttgcccgctttgtgaggtattaggaatgacatgggtggtggtggatacaacatagaaaaatttcacttgcttaatattacttgaactaatctctgggaccatagtcccttggccatcaccaagactgagaagaatcgaatcaagattttgctttaggggaaggttgttttgaatatcttagggggatttacagtgcactctcctgtagcttacattgcaaagcattctggcatgggataagatgttcataactctgtgtgttgtctttaaacagagtctttgaagcagttccctcagacagcacaggacattttcctactgaaggaactcagatgcagtttaggcatacttatatgtggaaactatccatctcatagtttactactgaaccctgaattagctggtagcaacaaccccctaccctctctcccgcagtcagaggcttctcctgatagccatggcagtaaaaatagaacagtagaactaaaatattttccagaagcagaacatattcatagggaaaggatgaattcaaagttatttacaactcttttatcttcaaaccattacatataaattgatcaaataaaaatagctagtctaatgtgttttgagcaggtattaccatttttatttattatttatattgcttatttttgaatcatgatatttcaggctttttatttgatgagtcaacatcttaagattcctaatgagaatggaatatgaaaaataattgggtcattgttaacaatgataagtcattttgacagtatgtgtacttgatatgatcaatgatacttcagctctgtggttctcttccccaaaatgcacaaccccagtccaattatgaacaaaacagtagacaaatcctagttaagaaacattccaccaaacaactgactagtagtattcaaaactgccaagcctccaaaaactaggaaagtccaagaaactgtcacagccaagaagagccaaggagacatgccatccaaacgtaatgacatatcccaggcaatatcttggaacagaaaaatggcagcagacagaaactaaggaaatgcgaataaagcacggactcttgttaagaataatgtatccgtgttgattaattatgacaaatgtgtcatactaatgtaagatgttaacagtgtgaaatctggcctctgggttcccaggaactctctgtatcaccttctctgtaccatcctcacctctctgcaaatccaaaactattctaaacaaaaagtgcatttaaaaaatcaattcaaatttggcagtgtattagggttaagaataataaagtaacagtgattttgagagagctcaaaaataaaaaatttggaatggcattcttttcaaagcttggtggacccaaaacctataaatacttcagtgggggagatcagggattttaccttcggaacattaaggttgtatgaatttattggggaagagggaaggctacaaagtagtcaacctaattctatttgtcttctttgcccctggcttccagatctctctccaagtcaccatagaccatgtgcaccccaatattgaatatctcatgaacaaccaggacagatttgatctaagaaagactcaatgcaagaaatccctgttatattccagtggagagtgttatgtggaatggacccctccatttgaactcttaaattctgtttcaattcaggtcattattctcctctgctttccttggaggtttatacaaatcttaggtacaccaggaaaccatcctttgagccagggttctttctcagtgccaggcacttttctatgtgaattatatcaacaggtaaccctgtgaaccatgtttctacctaacgctgttgacaaatttcagtcctgtttcatttcacacaactgcccaacttggtggatcagaagacaacaggtaaagataaccaagtagccaccaagtaagactaggaggctttccgcaaaaaagacaactttctgaaatgcttggtgaaactgttcattagacagaatgtacatcactggattgatgatggagtttaaaaatagctcagcaaggctgggcgcggtggcccacgcctgtaatcccagcactttgggagaccgaggcaggtggatcacgtgaggtcaggagttcgagaccagcgtggccaacatggtgaaaccctgtctctactgaaaatacaaaaaattagctgggagtagtggcaggtgcctgtaatcccagctactcgggaggctgaggcaggagaattgcttgaacctgggaggcggaggttgcagtgagctgagattgtaccattgcattctagcctgggagacaagagtgagacttggtatcaaaaagaaaaaaaaaaaaaagctcagcaagatgaagatgtcttaatatggtggtatcttggctggcagagaaacaataaagagaggcagccagcagatgataaaagcccctaaaatgatccccagggtttctgtggctttccttgtttgaaagtaaatttcctgttgtactaggacactataagcatgcttgattttcatgtgattaacaagcagaggagagccagttaagcgcctttgcctctcatggaggctggggttgaggaagaagagtgagctgtgatgacctgggcagtggtgctgtgatgatggcttctggatgttcttgttgggcaatgtgtgaagatgatgaacaacacaaccaaaatgtagaaggtcttacatgtggagtaggtggtgcaagaggtctaggagaagagcactgggatagagatacaatttgagatggcccatttactatactacagggcattggtgatggcccagtacctggtcagagcaacagacagaaatatcggttggaggccatgtagcacgtgatgctagaagacagccagatgttgcacaggagttggccaaatttccaggtgtgtgtgatggtctatgtgatgctcatggatatgaacaaggagccagtgagatagttggctggtgtatatagcttcctggtgaggaagatggtggtaagcagaaaggtgttggagagagctgttgtcagtgcgatgatggaaaggaccacagcaagagatctctagcccctggaagttcccagctcctaagcctccggtatttttgtagtatcgagggatccgttggaggcctcctggaggatgtcttccattggatggttttgtgaggacattctagggagctttctcttccacagtcatagcttctcttttcacagttgtctgtaaaaggtcatctttccatttcctacttctgggaaccgtacatcagaagagcaaaccacaacagaaaatctccaaggcttgattacatgaagaacactgaggtgactcctagctacagttaaaggcttttcccaaatcagattaatcccaagatgtctctctgttctagaactctgataggcacatgctgaatatgttagacaattgcaggttatcacagcactgtgggcaaagctccacaatttcttgcctttggtattttgactctttttaaggcttgagacttatacgtgtttaactgtgccttcagaatatttcccatcctattccaaagagattgtggatttcaggttgctgcctgggagcttttaaaattagagacaaaagggaataccagcttattcagagaagcagtccagtcaacagctcacagttttcctaggtgaatcctgacatatgattggtacttaattttggttccttttctactgactgtttttgagcctgaaaagacaaacattccagttaccaaagcttgaagaatgcatgaactcggagaagggaaaacaaacggatcactgtgagtttgccaagcggggcaggtgttcgaagcccctccctggccgtgcgtgtggaatgctgggcttgccctcctgggccctcctttcttcacatggtcggattttggcctacataatcacaggccccagccctgcgccttcccctggccctttcccttcctgcacttttgggatactccatttctttttttgttaattaataactttattcgtttggagtagtttgggaagttcccaagtgtacctgaataatgtacattgtattcaataggtaatttttcatttctcccctgcctgcctccccctgctctgagtctctagtgtccgttataccactctgtatgcctttgggtactcagcactgcctccctcttatgagtgagaacatgcagtatttggttttccattcctgagttacttcacttaggatgatggcctccagttccatccaggttgctgcaaaagacatgatttcattctttttttcatggccgagtagtattccatggtgtgtgtgtgtatgtatatgtatatgtatatgtatatgtatatgtatatgtatatgtgtatatatacacatatacatgtatatatacacacacacgtgcatatatatgtgtgtgtgtatatatatatacacacatacccatgtgtgtttatacacacacacacacacacacacacacactttctgtctcttgccatatacaaaaattaacctaggtggattaaagacttaatctaagacccgaaaccataaaaattctggaagataacacagggaaaactcctctgaacattggctcaggcgaaggatttatgacaaggatctcaaaagcacaacaaaataaaaatgaataaatgggacttaatggacttaattaaactaaaaagcttctgtacagcaaaataaataatcaaaagagtaaatagaccacctacagaatgggagaaaatatttgcatcatattcaacaaaatattaatatccacagtctacaaggaacttaaatcaacaagaaaaaaaaataatcccataaaaaatgggcaaatagcatgaatagacatttctcaaaagaagatatacaaatgcccaaaaatgtatgaaaaaatgctcagcatcactaatcatcagggaaatgcaaattaaaatgacagtgagataccaccctaccccatccagaagggctattattaaaaagttaaaaaataatagctggtatcatggatgtggtgaaaagagaactcttacacactgttggagcaaacgtaaattagtacaacctttatggaaaactgtatggatatttttcaaagaactaaaagtacatttatcatttcaggctgggcgtagtggctcacacctgtagtcccagcacttagggaggccgaggcagatggatcacctgtggtcaggagttcaagacaaacctggcaacatggccaacgtggcgaaaccccatatctactaaaaataaaaaaatctgatgggcatattggtacgtgcctgtagtctcagctacttgggaggctgagacacgagaattgcttggacctgggaggcagaggttgcagtgagcctggatcgtgccactgcactcacagggcgagacttcatctcaaaaaaaaaaaaaaaaaaaaaaaagatttatcatttcatccagcagtcccactactaggagtctacccaaaggaaaagaagtcattctgaaaaaaaagacatctatgatatggaatcaacctaagtgcccatcaaccaatgaatggataaagaaaattaaactttccttttttttttttgagacggagtctcgctctgtcgcccaggctggattgcagtggcgccatctcggctcactgcaagctccacctccctgggttcacaccattctcctgcctcagcttcctgagtagctgggaccacaggcacgtgccaccacgcccggctaattttttgtatttttagtagagacggggtttcaccatgttaggtggtctcgatttcctgacctcgtgatctgcctgcctcagcctcccaaagtgctgggattacaggcgtgagccaccgcgccctgctgataagtatttttttaaaagccctgagaaatgacaatgtaggatttaaaaaatgacttgtattaacagtatgagagtaatatgtgttcaaggtaaaaaaaaaataaataaataaaaataaaaattaccaaaacatatggagtgaaattaaagttccttctcccatcctttgctcctctcagtgcagttctttagggttattaactgttgttaacagttctttgtgtgccgtttcataaagtttctatgcatatcaagcatttatgtgttatataccttttaaaaaacaactggaatcatactttttattaatttaaaaataaacattttaatatcatcttatatacagctttatctcatcttaaaaaatatctacatggttttctgaatcatacttctaccataatttaactaaatttaacctaagatttacaggtagatgaagataggggtttttcttattttattttatttattttatttttttgagacagagtctcactctgtcgcccaggctggagtgcagtggtgcaatcttagctcactacggcctctgcctcccaggttcaaacagttctctcctgcctcagccccctgagtagctgggattacaggcgcgcaccaccacacctggctaatttttgtattattagtagagaggattttaccatgttggccagcctggtctcgaactcctgacctcatgatctgttcacctcagcctcccaaagtgcagggattacatttgtgagccaccacgcctgacctcttgttgattatagtagtataacgcataatgacataaccgtctcattcatgagttgatattgtatgcgtgtaaaatgtcgatagctgtttaattatccaccaagagttttccactgatttacacggagaatgtttttttgcacagtttcattaaacatttgttatcaaacctttttaaatttccactgacttggtaggcaattctgaagtgtctcttttcttgcttagtatttatttaaagttgagttctcattgagcattttttcataggtttttgttttgttttaattgggaggtatatgttaatttcttttccatatttttctgtttgatgatgtattttttcttgttgatttataggaagtttttcctctagtaaatacattggtctatttccttttatgttttacaaatacattttcctgttttttgttttttgtttttaacttcatttatgtatttatttgggggtttatgtcaccaaatttaatagtacttttctttatgtcctctcagttttaggtcacactttgaaagtccttatacatgccaaagtcattttcatttttatatttttttgagaaaggctctcactcactctgtcacccaggctggagtgcagtgtctcagtctcagcccactgcaacctctacctcccaggctccaagccaaccttccacctcagactctcgagtagctgggctacagccgcacacaccaccatgtccagctaattttttagctttctgtagagacagggttttgccatgtggcccaggctggccttgaactgccgggctcaagcagtctgcccttgccaaggttattaaataattcatacatgcttttctctggtacttttaaagtttctttttatacatctaaaaattggtttataaaatttatatattgccgtaatgattcagttttatgtttttacatgtggctggccagttgtcattatagtatttgttaaataatccaccccttctcttctgatttgaaatgccacaaataaattatcagattagtagattgttttgctatattaattttatttttgcaggaatttctcactcttctcactcatttactttttcagatgaactttagtatgattttgtcaaattttcctcttccaaaaaatgaacttgttactttttttattgaatgtggtatctcagaagtcaagtgaagaaagggtttcaaagaggagaggatgatcagatttttcaaatactgctgatgagttacaaaaaatgaaaattgaccattggctttaataaagtgaagatccaaatatctaaaaaaccatcatgcagaagaaagattagacttgttcaatatggccccacattaactcaatcagcagatactctaaggagtcaattctaaagagagtcaaactgtccaaaactgataacacactacctgggaggaaatcaattcattcattataagtggacatatagcaaaattaaagtgtaatccgtcactttatctaattttgctatatgtccagtagagtgggcagagtttatagtttgtgcctagtttctcctgtgattatctgttactttaaacaatattttaaaactttctgtgtcttgatttaacacgtttaaaaatgaagccatgtttattgactactttttattaaaaatagtttatttatattaccaatcccccttcttgattttagttggtaaacttttgttatattttgctgagttcatagtacttttcagttttatattgtgttgttttttgtaaaggagaaacattgcttactgtaattatgattcatatttagcttttatttctgaatttcagtatatttaatgctcataactagtcgttaaaaacagcttaactgttcccagtttttttgttttatttattttttttttgagaaggagttttgctcttgttgcccaggctggagtgcagtggcatgatctcggctcaccgcaacctcgcctcctgggttcaagcgattctcctgcctcagcctcccaggtagctgggattacaggcatgcgccaccatgcccagctaatttttcttttctttttttttttttttttatagttttagtagagatggggtttctccatgttggtcaggctggtctcgaactcccgtcctcaggtgatttgcctgccttggcctcccaatgtcctgggattacaggtgtgagccaccgcgcctggctgttcccaagttttaaactttaatttttggttgcccaggaacttctttgaattgttttgtatgaagggttatgggtgctatcccaattccttgtttgttgaccatgtgtttatgttatctttttatattttaaaaaccatttcagagatacaaaaatgtatagagaataatatactgagtataatcactcaagttaagtaaacatttcaaatattgttgaagttcattggcatatctctccttgatagtactcctttttattctatcccagagattaatacttgattttagtatttatacatgttcaataagaggaagtacatatggcaaataaatatgagaaaaatgttcaactataatgaatgaattgatttcctctcaggtagcatgtatcagttttggacagttttgaccctattttgtttaaccagaattgattccttagagcctttggcaccagggaccaattttgtggaatacaatttttccacaggccatgctgcaggggacagttttgggatgaaactgtcccacgtcagatcatcaggcattaggatctcataagaaacatgccacctagatccctcgaatgcacacttgacagtaggattcacgctcttgtgagaatctaatgctgccactgatctgacaggaggtggagctcaggtggtcacgctcacttgtctcaccgcttacttcctgctgtgcggcccagttcctaacaggccacagaccggcactggtccatggcccaggagttggggacccctgccttagagtatttgctgattgagattaacttggggccatagtgaataagtcagatcttttttctgcatgatatttagatatttggagcttactctttggcagcccccaaatctcaatatcctacgtgaagtatttttattcccctcattgttcttatttgctttggttattttttctgatgacttttatgtgtctaaactgatttttcttccatcttgacttgtttagttaggattttggatctaattgcaagagagatgattaaaatgggattcatgttccgttcacggcccttagctgaaatgtgggctactcagtgaaactcactaacgttcagtttcttcatctgtagagtggatataatagctacttaaggatgttcttgtttaacgatgtaatgtgtatgaaatcatgcaccttggaacctgtaaagtggtatatactcaggatatgaggtatcaacataatttattctcattaaatttcattcagccaattactctgaatttagaatcatggagaatcttttgactcttgatttgattgtttagtctaacagtaatttagtctgacaagtcttgatttgactaacaaatcgtttagactaacaaattgtttagccttgatttgattgaaggattgtcaatccttcaatttcatgccttctacccatttataaacgtgctctgtatactttcgtatagacaataaaatgttgaacaagcccccaaaagatttaggtgatacattgtaagaaactgctgatcagattgatatatccatcacaacaattctaaaagctttttttgttgcctgtagaatttttttttgtaagctcactttgtttgcaggtccagacttttataaatctatattcctatttgtccttcatgtatgttcttcaataagacccttaaaaatctaagatcaaggtgagcatggtggcttacacctgtaatcccagcgttttgggaggctgaggagggtggatcacctgaggtcaggagcttgaccctgtctctactaaaaatacaaaaaattagctgggcgtggtggtgcccacctgtaatcccagctactggggaggctgaggctgtagaatttctggaacccaggaggtggaggttgcagttagctgagatcacaccactgcactccagcctgggcgaaagaacaagactctgccaaaaaaaaaatcaaatctaagatcagcctgtaaaattccttcttctttaaattttctttttctttttgtagagacaaggtctcactgtgttgcccaggctggtatccaaactcctggtcttaagcaatgctcctgccttggcctcccaaagtgctgagattacaggcatgagccactgtgcccagcctgaaattccttctaatgatgataccttgatagtgaaccacctcaggaccaccacctacacatattttcctagcgttctaagcaatgtatgcactggaatagtctttgctgtttcttcttctttttccttaatgagtacatttgtagttgtacagtcaaaattatgttcttgtgggtctcccagtcttcccagtctttctaaaccgtcctcattccgcatagtgttttccactatgtgctaggcaaagacatatagatgtggtctctgctctcaggagtcccagaattatgggaggttagaaggttatgatacgaatggtatacggtggggcaaaaaaacgaggaattttagatttagccctgtatgaaaggagtctgaggaagtcttaggagctgagtcttgaaagtttgcaaggtagatggagaagggggcatctaagcctggagagtggtgtcaataaaaacgaggaggggtgttcctttccaccgtgtcatgccctggcatttcacttctgcttttaaacattcgtaatatacgctcttaaaaatttctggtagagctctgcatatgaatgccgtttctgtctcattacgaactctgaaatcacttgctccctggcaaaattatacccaatttttacctaatgagaaaaattacagtgaatgtagtcatctttattgacctgttaatttaggaagcagttgagttgagtttttttctcctctgtcccagaagattttcaatcaaaaactgtagaaatttatcttcagtgggatattgtggtataacttttaaggtagaactttaggtatccctgtagagatgccttaattctgtacaaaaaagccttaaattctgtactttgcttcttgattcagacacttgttccctaaggaagaagaatatggtaacactacatttatccttttcttgttctttggtgtctacattctctaatcatttctttcatgaatattataactgtatatttaagtaatatttaaatattgtaatatttagggagcagtactgagaaactatgttattttggcatttatctagatatacttaaaagaaattttttcttctgagcacaatggcagttatggtaatcgctgggttataagttagtcacatactgtggactgtctctggttctgtctgggccaccactgtccacccatagtcttccttgctttctaagtagtatacatatttgtatgcactagggtaacccagtgcttagagaatgaaacgagacaatagcagatggccaagcgtgctgtacaatgggattagtattgggctcctccttcccagggttctcccctatggtttaaagtagttctgtgttacagtaaatttcttatctttataataaatcactgacctggaaaatgtaattgagcatttgaatctgagctgcattcaaaatctgtgttaaaattgtacagcttcttgcttgattgattataaatgataatgtagcttggagtttaatttgcttacacagatgctatcaacattcccttccatgcttctgtaacttctgtttatttcgttttgcttgcatctccagtttcctaggtttgttttttttttttgtcctagttggttctttaagtctcttctattttgttttgggtaggaggtcagaaagaataggtcctttgtatgttccgtttgttttctgtgaagtcttggataagacagttgttagtttgttcactttttccatatcataaaatcggacaggagagtaaggttgttgtttttttaattaaagacaatatttactaatatattctgagaaaatattttatttttaaaattgtgcctttttatttttaataaggatcaattcctgtattttctgaatgttattattttaaatcttaacccagctgtgaagcaagctaagtttagagaagactgtgtcaggcctaattgaactttacgtctgaaacataatttagttagatattagaattttttcgttttctttcctttacttataattgtctaatagaactcactttgcagttctttgttgatggagaatatgtatagttaaactcttgaaatatcattttattgcaaaaacaatgcgcagtaaatgaagtttgatttgatgattatatttttactggtagctaaggaaatatactctgtgtaaatttatttgcttcatacaactttttttcccctccctttttaaaagtaaaccttaaggaagtggagagtttaacttgcaaagtattatttaacttctgtatgtcaacaggtttctggttttaaatgatgctgatcctatacaagtgatattttataattattgaagaattattctcttagaaagggaggttattttttttaccttgttatagtgtaaatcttttaattatgatatgttccttagcagtattccttccacttccagaacactcctctccaaaaaatactacaaaataacaaaataccccctcatccctacattgtgataatctagaaataataaacttcagatataagtgattaaaacaacaataaaatggatgtattgtgatagatctagcaaactctattgctgcatgataactgccctaaaacgcagtggcataaacaaccattttattttgcttatttatttgtgaatcaggaattccagaagggctcacataggtagtttgttcttgatttgtgtattttcacctggaagtgtctatgattggatgatctcctaccaagatggcttattcacttgcatatattctctttgctccttagcctctgtctacatggtggtttttatttttattttctttatttttattttttgagatagagtctcactctgtcacccaggctggagtgcagtggcacagtctcagctcactgcaacctctacctcctgggttcaagcaattctcatgcctcagcctccctagtagctgggattacaggcatgcagcaccacacctggctaatttttttatttttagtagagacggggttttgccatgttggccaggctagtctcaaactcctggcttcaagtgatccgcctgtcatggcctcctgaagtgctggattacgggcctcagccaccatgtctgacctacatggtgtcttttgccccagcttctgcaggtgccttgggttcctcgtggcatggggaaagtagtcacacttctaatgtggaagctgcttccagatttatagatgttagaagcagaagctgcttggtcagttaagggttattcttgaaagtggcttggaagtggcaggtcacttctgttgtattctgttggtcatagtagtcacagaacctgccctttttattttattttattttattttattttattttatgttgttattttatgttattttattttgttattttattttatgttattttattttgttattttattttatgttattttatgttattttatttttgagacggagtctcgctctgttgcccagcctggagtgcagtggcgctatctcagctcactgcaagctctgcctcccgggttcacaccattctcctgcctcagcctcccaagtagcttgactacaggcgcccgccaccgcacccagataattttttgtatttttagtagagaagggtttcaccgtgttagccaggatggtctcgatctcctgacctcgtgatccgcccacctcagcctcccaaagtgctgggattacaggcgtgagccactgtgcctggccagaacctgtccttattaaagcagggtggtggtggtgtcaagaatggggctccaccttcttcctgagaaggggtagagttcatggcagaagagtatgtgagatggaagacattgttgtgaccatttttggaaaatatctacttcagtagaataaaacattggataaggggttggaaatcaaagagtgagttttttttgtgcggtatggcaataaaattcttactcccttttctgttgtcttatgatattgcagccttattaaccagaatggaagtggaatgtttctatttccatgttctgctcagtgttttaatctgttatttttagggtttctactgttatctgttgctttcaaacaagctactccaaaccagaaagaattctgaacaacttaagagttgttttacctaattcaggaattaccacagagtataaatgtaattcataggaagaaagtacagaagaataaggtatgtggaaaggaagaggactaacagaaggtgaattaatgctacttactgattttggcaattcaccttgggtgagaagcacgactgtctagatggaaactcttgtgtattagtgatctaacaagaaccagtgtgcttgctacaagactgccttttagaagatagaggtgtgtatagatgatacacagaatgcaggagaatttttttttttttttgagatggagtctcgctctgttgccccggctggagtgcagtggcgcgatcttggctcactgcaagttccgcctcccgggttcacgccattctcctgcctcagcctcccgagtagctgggactacaggcgcctgccaccatgcccggcgaatttttttgtatttttagtagagacggggtttcaccgtgttagccaagatggtcttgatctcctgacctcatgatccacccgcctcggcctcccaaagtgctgggattacctcggcctcccaaagtgctgggattacaggtatgagccaccgcgcctggcgagaatttttaagaacattaagaagaaataaacatggctaaactgttttgtgttatttgagggggataaagcaagatacatctcagaacttagagtgttttcacaattcgttgatggatattgctttgacctagcactgaggggttaatttggatggaattttttttccaatcgagctagaattcacagatcataaaatttaccattttaaactatatgattcagtggttttcagaatatttacaatgttgtgcaaccatcatcactgtccaattttcatcacttcagaaagaaactcacacctgctggcaattacaacccctcatcctctgacaaccagtaacctcctttttgtctctatggatttgcctatactggatgagaccttcgactgtgaacttttgagctaatgctgaaatgagttaaggctttgggggatattggttttgaaatgtgaagacatgagatttgggaggggctgggtcgaaatgatgtggtttggctgtgtccccacccatatctcatcttgaattgtaataaccacagttcccatgtattgtgcgagggacccagtgggaggcaattgcatcatgggatgggtctttctcgtgctgttcttgcaatagtgaataagtctcacgagatctgatggttttataaagagaagctcccctgcacaagctctctctgtctttgccttgtgccttccaagcaagtcacatggtggcttgccttccaacatgattgtgaggcctccctattcatgtgcaactgtaagtccattaaacctctttttcttcccagtctcagatatgtctttatcagcagcatgaaaatggacaaatacagaaggctttcagtcttcaccttgaagtatgatgttgactgtgggtttttcatagatgctgtttatcaggttgagaattcccttccattcctagcttgttgcatgtttttatcataaaaagatgttggattttataaaattctttttctgtatctattgagatgatcatttggtttttctcctgtattctgttaatgtggtacattatattgattgatttttgtattttgaaactaaccttgcattcctgggtaaagatagatttgtttttaaatagctttgtgtttttcagctggatgaatgtagaaacttgttctatcagcattattatggagacaatagaagtggacctgagagaatatagcctttggataaatgcttaattttcaagtgctaaggtgtaatataaatggacatatgcaaaggcttatattgtaatatttttacatcatggaaataattttgactcattaaacattatttctttgggcttttaagtaacttagtgaataatttgaggatctgtgcttatctgtgtcgtttctcatctgttgttaatacgccacattaatgttctcagagtcttgcaagttctagttgagtgttttgaccgagcacacattttaaacttgaaaattgataattatcaagtcaataaggaagggtcagatccctcttctgacaaagattgttcttagttgtttctcaggagatcctgtagcaggaacttgtcagagtagtaaatacacagacacatatctagaaaaagacaaaagatttagggaaaagtgcctggtcgcagttttaaagcagagtcaatattttcttctgcttaaaaactgcttataacttgacataaattctcttacattgcattctcatctgtgggaatggctgtttggttagatgcccaggtatctgtcaactctagttgagaaattgaagtaactaaccacgtgaagaagttattaaatcagactctgatgaagcagccttttatgctcttcctttttcctgctacaccagtatgtatatcctaaccagaaaatagcttcaagaatcagacatctattttgttctttatctgttttatcttcctgtaattgtcagacttcctcaattttttctcctaatgatttttttttcctaaaggagtttttcagattagaaaaatcatgtaattttacagagaaaaatttgcaaaattctataagatctttgggcttcttttttcttttctttttttttttttttccgagatggagtctcgctctgttgcccaggctggagtgcagtggcgtgatctcagctcactgcaacctccgcctcctgggttccagcagttcccctgcctcagcctccttagtactcgggactacaggcgcgcgccaccacaccctgctaattttttatttttactgcagacggggtttcagcatgttggccaggatgctctcgatctcctgaccttgtgatccacccaccttggcctccccaagtgctgggattgcaggcgtgagtcaccgcgccccgtcagcctttgggcttcttatatacagtgcatataggtaagaaactgacatttggatttgtttcattgcatcccattcaggctgaactctgccttatacacagcaaatttggtatttttattttttttgagacagggtctcattctgtcacccaggctgccgtgtagtggtgcgatcgtggctcactgcagcctcaacttcctgggctcaggtgatcctcctacctcagtgctgcaaggaactaagactacagttgtacagcaccatgcctggctgactgttaatagtttttgtagtagagatgggtttcgccatgttgcttaggctagtctcaaactcctgggatcaagtgatctacccgcgtcagccttatgaagtgctgggattacaggtgtgagccactgcactggccaaatttggcacttctataaagcagctaagcaaacaactttaaatgaagtgactggtctttttttttttttttttttttggaggaggagtcttgcttttgtcgcctaggctggagtgcaatggcgcaatcttagctcactgcaaccatcgcctcccaggttcaagcaattctcctgcctcagcctcccgagtagctgggattacaggtgcccaccaccacacccggctaatttttttgtatttttagtagagatggggttttgccatgttggtcaggctggtcttgaactcctaacctcagatgatctgcccgcctcggcctcccaaagtgctgagattataggcgtgagccatcgtgccggctgtgacgggtcattttaaacaacattctggattcttgaaaagaatgccaccgattaataatttgtaacttctcttatgcttttgacagtctgatgaaagctatgggctttctccaggtaaaagtgtgcatagttcatttgtgtgaactgagatataatatacaccttaaagtttatccatgaacttctgattaaaaacacccacctttcaccatgacatggtgaagaaaaaaataatcagaaacactcaccatctatggaacaaccaagttggtgatatacactggtttctaggttttacaaaatcataaaatatgtgtatggttcaaatacaacagaaattcatggcaactacaatttcatgttaattataatttaactagaaagagtgtagctgttgggtatggtggatgctgcgatgatcgatgcaacctaggtctctcctgattgttgaaggacttatttccccagatcgctggaagtgttatcaacagaaagccctccactttccctagagattgtcttagctaaagacaccaccttgcccgagggcaagccccctcccatggacatccagtgattgatccttatgaggtgccatggtttgaattccttccccctacttgggacaacagcttcagagctcctcgtggggttgtcagaatcctttgggacttcgtggcagctgaatcgctccctctgtacaatcctcatttttctcctcctatctactgactccgatcccaaagagcaccgtctaataaacttcttgcataataatgtctgtctcagggtctgctttccgggaaacccagtcttgggtagaatacagggtaggatatgagtgcaagtcagcatctttcaacccataaaagtagacctggcgaaaataaaaattcaatgagatgaacttgaatttaaattaaaaataagtgaaacatctcatcatatttccttcacaccttatattcaagtagtttttcagagtcttggtttctttgaatttatttgtgtctctcagtctttctttgaagaaagactccccaaatctctgaaagcttggtttgtttggttacacattatgaacttgtgaaaggtgtgggttaaataatacagttgcttacatgccccaaagaaacccctagaggttttctatgttggcaggtgaatatgataagagaatctccttttgctaagatttcttggactgtatttagaaaatatttggttttggcattatcattaaaattgtagatgtccattctaaatatatgaaaagtatggaaaagctataaaaagaaaaaaatctgtgtaaaaataaacttctcctcacttgaaattggtataatattacacttactttttggtgacctgtcttattcatgtaatagtgtataataaacaagtttttgtatccttaattctcaagaatatgaattgtaatggtataatattctttccatccagtggatagaccatatttaatttggctagccttttattgttaagtgtttaattattcccaatttttaaattattacaatacaatggatttttttaaaaaattaagcctcttgtgcctgctttagtttttaaaaaaatattggatctctcatcactaaaatgtagtgaactgagactaggctacctagacagccactgtaactgaacaacttcaagggaagccattcacatcgatgatgtgaattgagggcctcagtgaaatctcatcattgctactgccacagaaggattgccgttgtggatttatgtgccctctttgtcttttgagcaattttagcacagggaggtctgtcaattttttatatatgctgactagatagaaaaagaagggtttgagctattttccataattatctaccaggcagatcttgactggcagtgacctttggtcttaccagcttttgtgtcattgtatccagttgttctaatgcgagaggcccctagttccatgatctgtaccatgagcaaatctgtcaaggaactttctttcctaccagcaattaataaaatctacctggagcagtggactctgaaaatatattttcttaagggctataccattcctgtataattaaatttgaacagttttaaagataaaatatagtagtattctggtgaagtttattactttttaaatgttctcatcttccttagaagaatattgttatattttataattgaaagagatgttactagtcttttgttttacagttaaagtgatgagaaagattaagcaatttgctcaatgccacgtaactagtcattcattgcaataattcactccatgatctgtactatgagagaacaacacaactgacagggaaacccaaccaaggaagtgttacttgctacccgacatctttgctgggcttattgaggaccataagcagtaattgagaatactgatatgaaaacttttaaaaacccaaattgaatttaaaacattgcttagagtttcttatggttttgtcagtcttgcagcttctcatcgctggaaacaagtggagaagcaaaatttagatgtcagcaatagtctgggcaaaacattctttttttttttttttttttttttggtaaattatagttttgccttgtttgtacattttgtccgagtgtctgatggtggacaaactgttgaccagaaatcaggggacttagaacctgaaaaggaaaaattcactattaattactatagatccctctttgccaactgattatgaccagttcatccagactgtatttctgccatcaatactgaaaggtattattaaccaagaaagtaaaggtcagagcctttttgaataactgatttcatacaataaatttgatgctgatggctatttaaaagagctgtggaggcaccctcaaaaatgttcctttcccttaaatgatatttaaagtgagccaggggactgcaagaagtgttttgagctgtcttgtcctcagaactgtgtcctagaggaagtctcttctgcgtttgcccagtgatttgggcctcaaaggcagagtaatcagttccacttgactggaaataaatcacccagactgaaacatgatagctcctgacaactgggcagggctgataaaagccaaaacaaaagatgtcaataaatctgtgccaatgtggaattagtatgcagatttgatgaattcactctgtagctttgcagtcagcattagacttcctctgattttatcagtttttctttcttgttgaaataaaaattgtatgaggacaagaaagcctctatataaaataaccattttatttctgtttctttccaccctagtaaacagaactgtaccatgattacagaggtcattttaaggaataacgtcgtctttctccaaacagttaatttaaaaatgtttcttccttgggctgggtacagtgactcacatctgtaatcccaatgctttgagaggccaaggtgggaggatcacttgaggccaggagtttgagaccagcctgggcaatgttgcagtacttcatctctacaaaaattaaaaatcggctgggtgtggtggcatgcatttgtagtctcagctactccggaggctgaggctggaggattactcgtgctcaggagttcaaggatgcagtgagcagtgattacactgtcacacttcagccttggtgacagagcaagaccctgtctcaaaaacagaacaaacaaatatgtatttcttgagtttactactcaataatgataattatatatgatagtaaactgtatatataaacctgttgggtatcaccccccttctattatcattgacggcacagatgtgtagaataaatgccagttcctttgatcactacaaaattttgcttgtacagaaattgaatatatgctaataggtagtgatttctttctatgtcagggagagtttatacaaaaaaaaaacccatgggattataaaatgtatccttttctgtaacaattattttattaattttcaattttaaaactaatttatgtaacagaagaaaaaccttttaaatgttttattgtcaggtcctccttggtccgtctgtctgtaaataaactagcttcctttaaccttgaaagttaggctaaacagattatttgaataacgtcgtggtcctgaaatccttaacgtcaagcatctttggctctgcccagcagctttagtgtatggtgattagatgtatgtttcatccatgaaggatgtacttttccatttgcagtggtttggtacctcattctttgggggttcgttttattctttgcttcagtagggggtacattttaagtacatgatcgtagcaatggtatactatattaataaacactataatcataagaaatcatttatggaaagatgctttatgtgattactttttcagtttttcaccatagaacatattatttatagggtggtaattaagagtagattctggagctacactacctagtgattttcccataggcctgtagtgatgcttaaatcattgttccatataaagtccttgcatcagtacctggcatgtttttaagtgttggctgcttctgtaatctacctccccaccaccactgttagaatcgtcgttcttgttattttattttaggggttctgtggtttatagtcctaaacaatggagagtttttaaaaactggatattccgagcatatttaaaagggtatttttctgctaaacgtgattctgaacaatcatttttatctttatgttctagtatgtgcataatggatccagtttttctcttggctgttcaaagcttcttataaatcttatatttcagatcctatgggtacttgaattagtatagaatagactctctgctgaatattttataaaaatggcataatacatactgaaataatatgatatgggactatcagagtaaacagcatttataacctcaacattagcttggtgaaaaagaagagaataatgacaagaataatgtggtaacattcattcttcagctggtcagtgacacatataaactgaggtccttgatcacaacgaaagtgaggatatgtcatgggagccttcagtggggctcagctgttacccatcatgatgctgaattcagtgagtgagggctcagctgttatccatcgtgatgctgcagtcagtggggctcagctgttacccatcatgatgctggattcagtgggactcacctgttatccattgtgatgctgcattcagtggggctcagctgttacccatcatgatgctggattcagtgggggctcagctgttatccattgtgatgctgcattcagtggggctcagctgttagccatcatgatgctggataaacggaaagagaagtatttttatgggcacacatttcacccgacacacccacctcccaccccctgcgtgtttcgggtttgttcagtgcttacacagctggtttgcacctatctgtgtctatttcaggtcttcctcactgatggcagcttgcccagaggaggtaatcttagtgtccactgttctttttttattttgtgagatcctttcactatgaaatgtttgtttctcctcttttagaagtaaataagagtctgagaatagccatcccttttcactccgactcaacagtcagtctctctagagtgggtaattgaaaaagaaagtaacttgccaagaacttgctgacggcattttacctgtttcagcagcttctgcacctgagtatatcagcagaagtgtttactagcaaagaataatggattcctttaatagtttaactacatatcaggtataaaagtgaaattgttaacattttaattcctgaatttctccctagatgcagatgatggagtagaaagaagggtattatccttattatgcatgtaaggggtgtttgtatattaggtaggctcataaaacaaatctgtcttcttgtatgtaaaacttggttggttctgtgaaatttcattttaaataatgtttcttgtattgccctttcttgacaggaaagtctaatcaacagcatgaccatagcttttctttgtataagacctatatgttagcaactggaatgacctgcacagctggttaaacatgtaaacaccaaggcattgtgttctgtatatacaggtatacctcggagatattgcagattcagttccagaccaccacagtaaaacgagtcacacaaattttttggcttcccagagcatataaaaagttatgtttatactatattgtagtttattaagtatgcaatagcattatatctaaaaatgtacataatttaatttaaaaatactttattgcaaaatatgctaatgattttctgagccttcagcaactcgtaatattcttgctagtggagtgtcttgcctctgtgttggtggctgctgactgatcagggtggtagttgctgaaggttggggtggctgtggcagtttcttaaagtaagacatcagtgaagtttgctgcatcaattgactcgtcgtttcaaaaaagatttctctgaatcctgcagtgctatttgatagcattttacccacagtagaatttctttcaaaattagagtcaatcctctcaacccgtggcactgcttcatcaactaagtttattaatattctacatattttgttgtcatttcagcaatgttcacatcatcttcaccaagagtagattctgtctcaaaaaaaaaaagcaacaacaaaaaacactcttattactcattcagaagaagcagctccacatctgttcaatttttttttttttttgagacggagttttgctattgttgcccgggctggagtgcaatggcgtgatcttggttcactgcaacctctgcctcctgggttcaagtgattcttctgcctgagcctcccgagtagctggggttacaggtgcccaccaccacgcctggctaactttttgtattttcagtagagacagcgtttctccatgttggccaggctggtcttgaactcctgacctcaagtgatctgcctgcctcggcctcccaaagtgctgcgattacaggtgtgagccactgcgcctggcccatctgttcagattttatcatgaagttgcagcagttcagtcacagcgtcaggctccacttctaattctgtttctcttgctatttccacatctttagtgactacttctgctgaagtcttgagcctgtcaaagttatccgtgaggattggaatcaacttctcccaatctcctgttaatgttgatattttgacctcctattgtgaatcacaaatgtttttaatgacatcaggaatggtgaatcctttccaaaaagttttcaatttactttgcccagatccatcagaggaatcaccaactatggccttacaagatgtatttcttaactagtaagactagaaatcaaaatgactccttgatccatgaggtgcagaatggatgttatattagcaggcataagaaaaacatgaatctccttgtacctctctatcagagctctagggtgaccagatgcattgtcagtgagcagtaatattttgaaaggaatctttttttctgagcagtaggtctccacagtgggtttaatacaccaagtacaccatgttgtaaacagatgggctgtgatagaggcttcattgttccatttataaagcataggcagagtagatttaccataattccacaggccctaggattttcagaatgataaatgaacactggcctcaactttcagtcaccagctgcattatcccctaacaagagagtcatcctcttctttgaagctttgttttctttgttttttttttcttttctttttttttcctttttgagacagagtctcgcttcgttgcccaggctggagtgcagtgacatgaacttggctcactgcaacctctgccttttgggttcaagcagttctcccatctcagcctcgtgaataactgggattacaggcatggaccaccacacctggctaatgtttgaagctttgaagccagacattgacttatcctctctagctatgaaagtactagatggcatcttttgccaataaaaggctgtttcatctattaggttggtgtagaagtaacttcaatggcaaaactgccattacttttgcaccaaccaaatacattgaaaattcattgtttgttgtagccatcttcattgattgtcttagctagacctggataacatgctgcagcttctccgtcagcacttgctgctttactttacacttttatattatggagacggcttctttccttaaacctcatgaccaacctctgctagcttgaaacttttctcctttagcttcttcacctctctcaatcttcattgaaatgaagagagttagggccttgttctggattaggctttggcttgaggcatgctgtggctggtttgatcctgtatccaaaccagcaaactttttccatatcagcaataaggttgatttcttttttgtgtgttcatcggagtggcacttttgatttccttcagtaacttgactgtttggttccagaggcctagctttcagcctgtcttggcttttgacatgccttcctcactaagcttaatcttttttacttttcaaactctgcatgtagcatttgacttaatcatttctaaattttgactaaaagtgagagatgtgcaacttttccttctccctgactatttagaggccattgttgggttatgaattggcctaatttcaatgtagttgtgtttcaaggaataggaaggctgacacagagggagagagaagagggaatgattgatcagtggaacagtcagaacacatgcaacatttcttaagttcaccatctcatacgggcagagttcatggcaccccagataaattacaatagtatcatcagagatcactgatcacggatcactgtaactgatacaataatagtgaaaaagaaatgttgcaggaattaccaaaatgtgacagagacaccaagttagaaagctcttggaaagtagtgccgatagacttgctcgacgcagggttcccacaaaccttcagttagtaaaaaacccgtatctgtgaagagcaataaagcaaagcgtaagaaatccaggtatacccgtatatggagtactgaatttttgagtggcaaaattctctttactggttatgagttgacctaagtgttgatccgtatgagatttcaatagtagtgtctgattaaatcaagggaagactaatgctttccatctcggatgaactcagttcttacaataggctttggtctcttactgggcaattcagtggttcacccatacgattatctctttgttaacaagtgaaaatgtaagcttcagcatattcacataccctattctaaacttaccaaatctctttcttagcttttttgttctgcctgtcgagttcttcttgactctagagaggtaccttaaagagcttgtactaaatttattaatgtaagaaactacctgacaattggatccaggattgttttgtaattccgttattggcaggagtttttgtgaatccctgaatatagtttatggaagtccaaacttatattttattcatttattgattaatgtttactatgatctgagatgtactgtataggaaggtacaaaacagctggaggggcaggatccatgtctacttgagacatgtataaaacaaagattacatatggtttcatacactaatcagtgctataatgattgatagatagaggaatggagatatgtgatcaatatatagatacatggaagaatggaggagtgtgtatttatacataatatatacatgtatatgtatcattactggggtacagacaatgatcaggtttttctcttgggggtgagggcaacagactgttcctagaggagataatgtttatcttgcattttgaaaaccacgtagaaaaatcaggtagttctagtatcagctcaagaggagatggtgattatattctcctgcttcatttctctccatagaacttatctctgccctacactatgttgattcattcatttgttcagtcactcattccctccctccatcattcatttgtctaccttactagaatgtaagctccatgaaggcagggatttggtctgttttcattactctgtttcctcagcaactggaaaagtgcctgatctatggtgggaatttgaactcctgtgtatatagtgaatgaataaactttgtgagtagttggtttatttataattttcctttagcttattaaggatagctccttagaatttcctcatagtttgcttgattttttaattatacttgaataataatttttattgtacttgagtctccttgtacttgagtgataacatgccgcttgctgtacttgagtgataacatgctatttccacagtgttatctcatagtatgttgagtccccatcatcttacctgaactgatacaaactctaatggttttccatgtctatatgcgagtcctcttaagttttcattgaaagatcagatccttgcatgctgacactgccaacactggtactgttatttatttaaagtacagaactggccagaccacttctgtgcttaaaaatctctaagggcttccatctctctataataaaatctgtgctccttaggttggcacacaaactgttttatagcttggcttcagctgtataatgatgcattttcttaccatctcatggtagaataaaaatgagtctattcatttttctttttttttttttttttttttttttgagacggagtctcgctctgtcgcccaggctggagtgcagtggcgggatctcggctcactgcaggctccgcctcccgggttcacgccattctcctgcctcagcctcccaagtagctgggactacaggcgcccgccactacgcccggctaattttttgtatttttagtagagacggggtttcaccgttttagctgggatggtcttgatctcctgacctcgtgatctgcccgcctcggcctcccaaagtgctgggattacaggcgtgagccaccgcgcccggcctcatttttcttcatatccatagtgtctggcatgtaatacagaattcaacaaacgttttttgagtaaatgaatgcatgtaagtgtatatgaatgaatggccacaaaaatgtttgctgcttagataaaagatgatataagtaaatgaatgcatataagtatgtatgaatgaatggctaagaaaatgtttgctgcttagataaaagatggtgtaaaactaacctaacactagcctttaagaacacagtcttttctttatatagctgatttgtctttttcactgtttagctgctctatcctctgtcctccctttattctttgtgaagaaatccctcttggcatttacaatgtcattttagaagtaatcctagtcctcatggctttcctctctacatggccatctctatactggatcttttctgctagctacttttcttattttgttagggatgtgtgtgtgtgtgtgtgtgtgtgtgtgtgcgcgcacgcgtgtgcgcgcgcgcatacacatgtgtacttttttttgttttgcctacaagttcctacaaatttaatttgcctacaaatttaaggttttgcatgtaattctgaaactcttaggattaaatgatttctacagaatgcacacacacagacaaccctgagctatctgttttcaaattgaaatgattttgattgtgctattgtttttttatacatgtcctctcttttcccttaaatatttatgtacatttagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagtgagtggctggccccaactctccacacacgttttctgctttctcattaatctaagactggatatagaatacaaaagaaatccctgtgggcacaagggaaaagagctgctgtgtgctattgctgacatacgtagtgtgaagggaaacattttttttagatggagtctcactctgtgcccaggctggagtgcagtggcgtgatcttgtctcactaaattccacctcccaggttcaagcgattctcctgcctcagcctcccgagtagctgagattacaagcatgagccaccatgcccaagtaattttttgtattttttgtagagacggggttttgccatgttggccagactggttttgaactcctgacctcaagtgatccacccacctcggcctcccaaagtgttgggattacaggcatgagcccctgcacctggccaaattgctctgattttcaaacttcttgagtatctgttgacagaaagttttgatgatttctcttttctttaccttcctttatattttaagctcaatatatcaaaatctttcccattccccccttttttggtgtgtgagttgtgagttgtttccattgccttgtgggcaacatgtgaataatatatagagaagaaatatttgttagttattgtccttagggtgtatatataagcttttagttacctggaaattgaataaatggaaatattgcaaaagaatactttagtgatatcaaatactagttgagattataagaaaagaaaccttgggattcaaatgaataaacctacatccttgttatggcaagatgaataagaaggatgaattatttaaaaaatgtattctggccaggcacaatgactcacacctgtagtcttagcactttgggaggccgaggcgggtggatcatctgaggtcaggagttcaagaccagcctgaccaacgtggagaaaccctgtctctactaaaaatacaaaattagccaggcgtggtggcatgctacttgggaggctgaggcaggagaatcgcttgaacccgagaggcagaggttatggtgagccgagatcacgccattacactcgagcctaggcaacaagagcgaaactctgtctcaaaaaaaaaaaaaaagtggattctttaaaaacttaccattgtcttttgaatatagaagtttgaaattctgctaaaagcagaattacagtcatataagtgcaaaagggaatttcttcacatgttgatatattctctcatcaggagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggttaagctccccaaaatggaattagtttgtttgcttaatcattgcatgtgtctgtatgttggtgtttacataatgcatataaaaaagtattcgatggaaaattttcttaatattcttttagcaggcttttgttgaataccttaaggaatatttcagaaagctttgcagagacatagcggattggttcattcattttctaagtattactcactttgttttatgttggttttttacttactaatatttttatagacctaaagtaactgaagctcagatacatttggagaaatagtgtgctaaagataagaaagttgacagataaaaggaatatgcaaaaggaggaaattttatgtatagcaactatcaaagaacacaacagctattaaattaggtgacttaatatactttggtcttgtttttggagaatcctgttaatatgacctaaatagcaaagatgcctcatgctatgtaatcagatgatgataatgcatgagctttagcatctttctgtggattttctttctaatatctttaggcaatgttatggaagtttaaattcctaatagaatttttcttttaatagggaaaaatgtgattttttttttttcttttaagagactgtgtctcactctgttgcccaggctggagtgcagtggcattatcatagctcactgcagtcttgaactcctgggcccaagggatcttcctatttcagtcttccatgtagctaggactatacgtgtgcactaccatgcccagctaagttaaaaaaatttttttttgtgaagacagggtcttgctatgttgcccaggctggtcttgaactcctggcctcaagtgatccccctgtctcagcctcccaaaatgctgggtttacaggtatctggccgaaaaatgttttctgtttaagttaacgtagctactgaggtttgactacttacattcacaaagcttgatctactttggtttattttgtattgacagaactctttacatcactgttcaatgggtatttcttgagaatccatcttatttgttaagagttgaaagctagagctaatattgttttatatttcatgaatgagtttccttgtaatgggagtatgtcagcatttggtaatagaaaggaaattacagctaccatgataaatttaaaaatttaaacctctattttttttaaaattatttattctagatgtgtgttccttcttttaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggttaaagaaaaaatttcacatttttttgctttgccttaaataagaacatagtagataaccttagcatgtttatatggaataatttaccaatggaataataatccgccaaactttaaaataccatgtatatctgaattaattatcttagcattcttatcctactttattttattcaagataatccccaaatctttaaaaattgacagttcagagaaagattaaaatatgcaactctcttgtgggtaaaatatgagaccagagtgtaaaaatctctgttacctgatatttttctcccattagaatcagacttctgccaggtgtggtaactcatgcctgtaattccagctccttgggaggttgaggtgggaggattacttgatcaggagttggacaccagcctgtgccacagagtgagaccccatctcttaaaaaaagaaaaaacggtggctcatgcctgtaatcccagcactttgggaggccgaggcgggcagatgacgaggtcaggagttcgagaccagcttgaccaacatggcgaaaccccatctctactaaaaacacaaaaaaattagccaggcttggtggcgcaggcctgtaatcctagctactcaggaggctgaggcaggagaatcacttgaacccaggaggcagaggttgcattgagccaagatcgtgccactgcactccagcctgggcgacagagcaagactccatctcacaaaaaaaaaaaaaaagaaaaaaaaaagaataagtgggagcatattttctaatttaacatatgtagtaaggtctgagactcagaataattgttaaatatcctgtttcagattttatctcattttggagaatgttaatttcctagctttttttttaaagacagggcacatattgtcagaaagttttttttatttgttatatttttaatttctcttagcaacttattgggcctagaattttattatcttcaccttctacattagggtctattttttggtttatagcttatgtgtagatttacatgaaggactatttggcgtattttcttcttggaaactattactgtattattagtgttctaatttacattttttcaaaagcctgtgcttatcattgaaattttaaaagtagatttcttctctgttttgtttggagtaggaaatgactggtcttgaggtaatgataattggagtcatttttgacctatttatagcttaagaatgtatatcctgtatctgaatattggcattccatgtcttcagcatgagataatatcctcagaatttattgaggaaaggattgaaactcaacttttgagatatcagatttttttgtctttttttctttgttttttagagacagggtcttgctctgtcgtccaggctggagtgcagtggcgtaatcatagtttactgtgacttcaaacttctaggtataagtgatcttcctgcctcatcctcttgaagagctgggactacagacccatgccacaacacctggctaagttaattttgagacagagtctcactctgtcgcccaggttggagtgcagtggcacaacctcggctcactgcaacctccgcctcccggtctcaggtgattctcctgcctcagcctccagagtagctgggtttataggcgcatgccgctgtgcccggctaatttttgtatttttagtagagatggggtttcactattttgaccaggctggtctcaaactcctgacctcatgatccacccgcctcagcctcccaaagtgctgggattacaggcatgagccaccacacctggccttttgtttttttttaaatagaggggtcttgccatgttgcctaggctggtctcaaacccctgcctcaagagatccttctgccatggcctcccaaactgctgggagcaaggccactatgctcagccttgagttatcagaattttaaaaatgcttaatgcttttttttttcccttgtagagtgaaatatttatttctatactctgatttttttattgaaggtttttttttcaccatttttttaaaccgttaattttgtttcccttgattatcttactcttaaaaccattttctgtacttttctttctttcttttctccctgatgcttcttactgtctttggcatcctggaatagtgtggagccactcatccaagccagtgagtgacctagccaagtgttgccagaaagtcccagttgatagtttcttttctgacttttgtgtgaatgacatttttatcaccctatagataaatgaatatacttaaccttctcacctctcccttcccgaaataggaactctaggttgtttttttttttttttaatttatattgaggtgactacaaaatagaaaggcttctctaagaccaaaatttttcctgagactttggaaactgtttgcatttctgctgcttttaccttgttttgttcctagtgagttaattcattcaggactgcttctctttgcttttatttccaccatgttgtggcttttagccacaccagtttagggtacagtttcgctaacacattaaaatatgtttctgccaatagagtcttttgtaaaggccatgcttagtaactgaattttgacaactgatgaaacctgaaacaaaagaaattggtagaggacttaatctcgaaagtacctctattgcttccacaaagcatttaacaaaatttacataaatgtttctcttttgctcaaagtactttgaatcagagctttcctaagtatgtgtgttttcccctttaatattttttgaaaccattttaagggactaaatatgttttgttgcttattgaataaggaaaaaaacgtgtgttagtctttactctctcattaaataggttatgtggtgaaaatgttgatttctatgggaatatgattatctgcatggttttgtaatcttacgtgttttactatgacatgtatgaaatacaaaggaacaaaatctttgcctccagtgtatgagtactgaggttttaataatgttaaaggtaggtgtttttcagtagaacaaggcctgtggatggagagcttaacctttaactcagtattttaaggaggattattcactgttacgtcagcctctcttgtccaaaggtgatattttatacaaatactgttatttcactaaagtttgcagcttttgcttctgaatgttcttgaccttttcacattctaaaagcaaggtgtatggagtatctgcatttttaaagcataggttaacgtatagttagaacttaatgggtaagaaaggggagaagaaaatgaaggcatgaaattaaacaccttcatccagaaaatacctttcatattgataccatgataagtgactatggacagaagaaatgcttacatcttgaattaaatgtcatattccacaatttagaaatccattttatcttcatttatttttttgtgacagagtctcactctgttgcccaggctggagtgcagtggcacaatctcgactcactgcagcctctacctcccaggttcaagcaattcttgtgccacagcctcccaagtagctgggattacaggtgtgcaccaccacccctggctaatttttgtactcttagtggagatggggttttgccatgttggccaggctggtcttaaactccttgcctcaggtgatccacccacctcggcctcccaaagtgatggggtgacaggcgtgagccagtcactgcacctggcttagaaatcccttttaaagggatgtttataacactgatttgaaaaatatgcctttttttgagtttgtattataatttataaagttgtaaaggtctttaaggggtttaaaattcttggaattttattttaaagtacaaattaactcagcaagaatttagatgtaaactactctgatacagaatttgttgtcataagggaagggaaggtttatagtatctttgattttttttttcctagcttgatttattttgtctttaaagattgtcatttagtattcttttattatctttatcattattattttatttttttttgtagaggcgaggtcccattgtgtttccctggcaggtcttgaactcctgggctcaaggaattctcccagcttagcctcccaaagtgctgggattagagacgtgaaccactgcacctggcctcatttgatattcttaataatattccagctacatttaatcttgcacttatatttaattactgattaatttctcttcttcccaatcatttttcttttcctaccgtttaggcctatgggctgttttaaatcaaatggaaactagcacactgcttttgcatattcattttttctacaaataattgagtttttactctgtcagttaccacactgtgcactgaggatatatagtggtggacaagacagacctgtcccttgacttatataatttatagcctctattaagaagatagacacttaaaaaggtaattgtagtaaatcacatggtgtgagggaagcttatatcaaggagaactaacttaggtcaaggtcatggagaacctcctaacaaaagcgacactttctaagctgagacctcaaagtaaggactcaccagcgtgtatgaaggcccagaatgctgatatgcagtagttatatttatatttgtggagttataataaataatttataataaattattagaaatcagaattatctcagtgacgttaaatgccagctggccttcacttttgtttacacaatcatcttttgtgcccctacatcaagctgcctcctattgcctatttcgtcaccttctttcttcgtagatactaagaattttctcagttacttctgcttttgtttgcatcttcaatctcttcgcctttgttgtcccctctctttatgtgtaatatgatcagctttctattgaaatatctcctgatcttggtactccttatggtcttcttccctctctccttttctattagatatatttatagccttctcctgcccatgaaggattgactgctacaggaatttccctcctacaattaacaactcaaaaactgggaaaccacgtgaaacaactgattttagacattggacaacattcagtgcagaacagtgctctcatcttaccttccaaacttatatgatttttgtttcttaaaatatacttcatatgtgtatcaaggttaagggttagggaagcctatatttaagacataaaagatttttttctacacatgtgaagccttaaacaaatgaacttgggaaaggacttatcttaaaagtatagctgttactttcaccaagcgtttaatacaattatataaacatttctcatttactcaaggtactttgcttcagagctttctgaaatatttcctaagaatatatattttctcctttaatattttttcaaaccattttaagggactaaatatattctgttgtctattgaataagaaaaaataaaacgtctaagcttttgtcttctcattaaacacattatacatacatggctttagagattccagaagacagctagggacttgaaaattagtttttaattattgaaactgttttgtattccaaaatgcattaacaatattagttgacttttgtaggatcctgaataaaaatttttttctcagatcttagtgtggttctttcaaaaaaatttttcttaaacaatttttttttccaatagagatggggccttgctgtgttgcccaggctggtcttcaacttatggctgcaagcagtccccctgcttgggcctcctatagtgctgggattacaggctcaagccactgagcccatccttaagtgtggttctcgatttctgaattcatttgtttgtcccatattattttgtaaattctctaatccttgcatgagggaggtacctgtgtgatggtagcagctgttttcttaacctgactcacatttttatggcatcacactcccagtatctgtttgattctagatgcccaaggccatgtgagtcacacgtgttaggtaaagcagcatataggaaatggaaatggaagttagggtctagtgggagttaggtctctgcactggtccggctatacgatcagcagtgagtccctggtgttgccttttgatattctcttggagagatcaataacaacagttcaatgactgttagtttgtctcactaaactctgaagcatcttttgccttatgatggtgtttgatttaataatattcagagatgtgttatttaaaacaactaatctacttggaacctaagataattctccatttattactaatatttgtctatataatacttaagcagataaaaaccttataaattacaaactaactggtagatatttgataattctgtacttaaattggaatataaatcattgtttgggacatggtttgcccattgccacctgtgtgtatctgataggattgaaatgcttttctttgtaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaaggtaagaaagtgaagctgattggggcttatgaggttaaagtatggttttaaaagtatgcttttggggacatactttttcagtgtatctaactctgaatttaggttctcgaattcttgctattactgtattagctgccttttttctaggtcagttgtacgttctttgttgaggtgtctgaaaggcaacatagaatgggaataaattgggaagctatgggctgtaacataattgattggcaaaaaagagagtattcattaatttaaaattaaagttttttttactggcaaatcaagagaggacaaatgtctactttttaatttctctatataatgatcaaatgatcctcaagcaaaggagttaatcttttatcactagtttagacctttgttgttgagctaatgctctgttgggctataaatttttagacttttcacagtttttattgttgaaaagcacgctgttacttcagtgcattagatcaaaattaggaggagagacactttgaggacaatttaggagccacggatatgtttttttatgaagctgtctctgacttggaattcttcaaaatattctgtgtttgaacagatctaggcagacaggtctcctataatttttttggtgtgttttcttattattttatgctaaaggtcaagcatgtgcctcttgacctcttcttttacaccacatatttaacataaatgtaaaactgtgcagaaacaactctgccggtagaactttgttaattacctgtattctgaacagccagaaagactgacagtgacagaaaggggtcactaatctacttggccttttgaggactgatccttaagaataatttttttttttttatgatcttgaaggctgagaagtattagagtacttccataaattttttactaagttttaaagttttggggttagtggtagacttgatactgtcctctgaaggtattattttttcctattctatagtcatagaattttaattttcaagaaaccaaaactataaagtctaaccttcacagttctccttcactgtactgaaagtgtaaataacacgggctgattacctgctcacttatttcctcttattttggtattaactctactcattttgttcagttctgaataagatatatggataaaattctttaagtcagaattttaaaattaccatagcctcaagattagattatgtacattttttatgtcttcatttttgcactgcacccttccccacaacacacacatgtacacatgtgtatataccccctcacccattacgtgcttacgtgaatacatgcctctctttgcttttggaaaggcttgaaatctgcaacagtactgcatagatacaaaaatgcggtgcttttgattgattagtgacttcccactaaatatatttcagaaaagaaattccttgaataagttttattttatggtttgatttcttattagaaatctacatttgaaattattgcttgctatttcaggcagcttgcttgaaaatgtttttgactcatttttgtcaccaatattgattttgggagatggatgtgaactgaaggagagtaagaaataggactaagtctgtacttgatatccaaagcacaccaaatagcagcttttattagccactgtatttctcacattttgagaaagagttgtaaatgatctactctttccacagaatgtaactcttataaaagttggaaaaagcactgtagagttctgtcctctggccctattgcattataatttcgttttaggattcagcacagtttcttggctactggaaaaaaaaaaaaaaggaacagctttcataactcagcttttgctaccaggtttgtagtttgctacttggtaacatagtttaagatgctgaataaacagtagaatcatggaatttgtgaaagtgatcgagcatggcattttatggaagaggaaactgaggcccagagaagtcattgctgaagtgacgtggtggttgagccagagctagtagaatgtggtttgtaaattccagatcaattttctttctgttctgccaaggctagttatgttccttttggacttcctggcaactgttatttgaagactccttacccttaggtgatttattcttttaccccatttggacccaatgtcttaagtagaagtggttatatttagtattatgacttgcttacaaactaaggtagattttagtttcacttatgcccttgaatgccatttttataaactgagctctgcttattttaggagataatcagtgcattctttgtcaaagacagttgggattatgttatacctcttgttcccagatttagtactcgtttgcatatgtgtggctgctgtgtttcttactaatcatttgcttcctatgttgccattccactatttcctatgcctgtgtctgtctccctatagtttatcatttgagattcttcatttttctttttgtcttaccatggtcctgttccattggggtttttggcgtctgtgtgtttatatgtatatgctccttctgccccttggccatggctgtttctcagaaagccagtctcgtgcaaattgtacccttcatgccaggtttctgtccctgtaccatcagggggttttgtttgggacttcctgggaaagtgagcattaagtaaggttacagtcttatactagagtgaattgctactgctgcttttgctactgctggggcttgtttggaattttgcttgatcagagttaaagaacagctgattatatgtcaagttgaactgtacctctttaggtaccctactttttgatataatcagtctgtgttcgttctggtaaacttctgatattgctagttgtgattgctttagtctttgttttactctttaaatagttcctcaactaatgtaactgtagtgccacactgtagattcagcatgtagaattaatttcttaagggtgttcagcaacccactaagtgcaaaaatgaaaggagactgttacaataattgaactcaagaaaatccttagtattctttgcattttatagtgcttcttataaaaggatctccaatattaaatggttcagattgtattatgaaggattcccaggcctgttctttgtgatctaaagaaataaataaataggtccttcccatgttggctgttacagaaaataagagttcttgtcagaagatgatttagtgttgtcctactctcttgacccactgcaattttaaaaagaagattggataagcccattaatacatctataaatataaaatattttccccaattaaatcttaagaagtagtacttctaaattcatgttccatactgtggtgcatattagttggaattcagtgagaagcagaattagtaggatacacacacacacacacacacacacatagagatagataaatacatatatacacacatatataaacacacacaagcatacatatattatgagatttatacgtatatttatatatattaatatatgcctacatatattaagagatttattacagagaatagtcttgtaaaatcgtggggctggctaagcaagactgaaatccctgtggcaggctatcaggaagagaagatcgtgagcaggatggaacctgttgcaggcacaagccaaagctgtggtccacaggcagaattccttttctctcctgggaaacctcagccctgttttaaaatctttccaaaggattcatttatgtccattgggattatctaggttagtcttttttacttaatttgattagaggctttaattatgtcagcaaactaccttcacaagcaccatctagattaatatttgatggaataactgggcactgtaacatagacaagttaatatttcaaaaaagtcatcatctgatggttctggatagtatacaaataaacaaacaaaccagagcttgaaaagtcgttagataagtaaataaatttagagtagcctcaggaaccctgaatgtaactgcaaatttctctcctaaaatgagcatattagagtttctatttagattaatagtgagtaggcttttctttgctatcatgtttaaaatacttagagtggctgggtgcagtggctcacgcctgtaatcccagcactttgagaggcctgaggcaggcggatcacctgaggtcaggagtttgagaccagcctggccaacatggtgaaaccccgtctctactaaaaacacaaaaattagccaggcatgatggcacatgcctgtagtcccagctactcaggaggctgaggcaggagaatcgcttgaactcaggaggtggaggttgcagtgagccaagatcatgccatcgccctccagcctgggtgacagagcgagactctgtctcaaaaaatgaataaaataaaataaaataaattaaataaagtacttagaagcgtactggaggctgatacaggattgcttgctgtctgctttttcactcacgctgtccatcttagctgaatgttcccatgttatagcaccaccctgggaacattgtcccctgtgccgtatattgtattgtgccttataattttgctttttaatgtgctttgttaccttttttctaataccatgactaatggattcacagagtttagtgtttgcagcagaaatactcaattttactctagtatgagattgttagattcaatatgccattcaaaacttgtattcagagaatgacaaccatctgattttcatataatttagataacagaggttgcctttggtttatcaaagttagaaattttcagtgatccaaagaataatagagtctattattgtgtgatctaaagattaataggaattgtggatttactatatttcctgatttgagggaatataagaaccgggattttaatggatatagattttttgggggcggggggcagggtgtgttttgaaattcagccaagtgattatttatgggatagtcgagaaagacctgtctgataaagttattgatatatgagcagcgatttgaaggaggggctctataagaagtccgcagaagcccctaaaaaaaccacaacaactttgaggcataatttacatacaataaaatgcacccattttaagctgattgtttgagctttgacaaatctatacacttatgtgactaccaccatgatcaagatatatagaacatttcctcatccccaaaagttcccttttgcccctttacagcaaatctcttcccaaccctagtcccagcctctgcagatctgagacctacttttaaaattaattttatacattaaacttcagtttctcccttttgccttaacatttaattttctactttcccattctaacacaaccacaagtatgtgtaattccctatttcctcagctccagaagtagattcagattttttaaagccaatcaggataatagcattctctttcttagtgactagtttcgcattgagcacatatgcattagtgattggaaggaaaaaccacagggaggcttctgggaatgattttcttataagacagacttgcaagaagaaagatgacccctttctcctgaacattatcttgtcgggatgtgatacccataattgctgcagctacttctgccaacctaagatgaagccagcgtccagagagtgacagttaacaaaacctcagcaaagcagagttggaactgaaatggactattcctgaaactgcctctgtgctgcttgttatgtgagataggacaatttctgattgtttaagccagtttgaatgaggattctccgttacttccaacccagtgcattcaaatggatataattatgtacttatttccgcccccccccccctttttttgtaatggaagcaatcattttgaaaagagttaaagttttttggtaagtcaaataaggatcaatgctgctgaaagctgggacaacacacgggccctgaccaaattggggtttctttgtctacctcataccttccaaatcaaaaaataatttccctagtattttaattactcccccaaatcaggaataacttcctcactgtgctgattttggttcttttaaaataaggtggtaatttgaaggtaatagttaaaccagtcatagattattctatgccattcttttcaaatcagcccactcaggtgtcagtcctacttttcttttgttgtagtcctctttattctcctttgtttctgcctccacctcatcccccacccaaatgcctggaacagatctcaccctttcgtcttttgagaggaatacatatagcagatttttgcctccgactaggcagctactttaaagggggatgtattttgaatctaaggaagatacccaaaaattttaatgcagtttgtttagttatatttgttcattttagctgccctgtctacatcatgactttttgggttgggggggtatgtgttggaaaggtttcttatgtaggttttttttttttttttgacagaatctcactctgttgctcaggctggagtgtagtggcgtgatgacagctcactatagcctagacctcccagcctcaagcgatcctcccacctccgtgtcttgagtaggtgggaccacaggcacacaccaccatgcccagctaactgcttaatttttttgtagggctggtgcctcactatgctgtctaggctggtcttgaactcctgggctcaagtgatccccttggcctcccaaagtgctgggattacaggcatgagccaccacacctggtgcatgtgcgcacgctatttctctctctctctctctctctctctgtctgtctctctgtctgtctctctctcactctctctctctctctctctgtctgtctgtctctctctgtctctctacacacacacacacacacacacacacacacacacacacacacacacacacacacacatatatatatatatattttttttttttttttttttttaagacagattttccctctgtcacccaggctggagtgcaatggtatgatctcagctcactgcaacctccacctcccgggctcaagcgattcttgtgcgtcagccttccgagtagctgggaatacaggcatacaccaccatgcccagctaatttttgtattttcagtagagatggggtttcaccatcttaaccaggatggtctcgaactcctggcctcaagtgatccgcctgccttggcctcccaaagtgctggggttacagggatgaaccattgtgcctggcctagatttttgttatacagatgtttgaggttaaacaactggtcctgcattacataagtaggtagcagagtcatgcctaacaattccagtgtctgtctctccttcctgaaaagaaatccttttcaggtgttcagttttcattaatgacctcacctcctagaagaggaggctgtagacagctagatgattcagagtctgttcacttgaggatcttactgaggccagagtctttcccacatgctggaatgcccacttacaggacaggtactgcataactggcatgtgggttgttttgctgctaggggccagtttttctacacatgtgctttttaatgcttctctcagtctggactcagttaagggatacgtctggctcaaagagactaagactccatcaatacagaagctattgtcatttcatttatagattatgctagcattggcgtttatctatagcttgtctaatagctagaaattccagtgatgaaattttagttccttaaggtctggttgagctctactggaaggtatcacttaacataccacagaggctggtcatcccagttatcatgtgcccagaatgtagtagtatcagaaagaaaggacttgttgaactttggactattttttttgttttgttttgttttgtttttgttgctttttttttttgaggcagggtctctctcatccagggtggagtgcagtggcactatcacggctcactgcagccttaacctcttgggctcaggtgatccgcccacctcaacctcctgggtagctgagactagaggtgcatgccaccatgcccaactaatttttgtattttttttgtagagatgggtttttgccagatagcctaggctggtctcgaactcctgggctcaagtgatccatctgcctctgcatcccaaagtgatacgattacagaggtgagccactgcagccagccctgaaatttggactcttaagtctttggtctttccatgttcgaagccaatattaaatgatagtagcttgggaggttatttggttggaaggctaataagtaattttggatcctaaactattaatactaatttcaggtcctccaactctagtagagagatacagaatacagagggaaaaccaaaatattgcactgctacaattattctgagaaagatagaactggagatcagttttgttgttcgtatatacataaaattcttagggctagccttgtgagtagttatgatggaggtaactttgtttttctattttgtggtggttaattttatcttctttgctaaccatcttttccatacctcattgtattagttcgttctcatgctgctataaagacatacttgagactgggtaatttataaagaaaatagttttaattggctcatgtttctgcgggctgtacaggcttctgcttctggagtagcctcaggaaacttacagtcatagcagaaggtgaaggggaagcaggcacatttacatggccggcaggagagagagagccagcaaagggggaggtgccacacactttcaaacaaccagatcttgtgagaactctgtcacaagacagcactagggggatggtgctaaaccatgacaaaccaccgtcatgatccagtcacttcccaccaggccccacctccaacactggggatcacagttcaacatgagatttgggtggggacaaaccaccgtcatgacccagtcacttcccaccaggccctacctccaacactggggatcacagttcaacatgagatttgggtggggacaaaccaccgtcatgacccagtcacttcccaccaggccccacctccaacactggggatcacaattcaacatgagatttgggtggggacaaaccaccgtcatgatccagtcacttcccaccaggccccacctccaacactggggatcacaattcaacatgagagttgggtggggacaaaccaccgtcatgatccagtcacttcccaccaggccccacctccaacactggggatcacagttcaacatgagatttgggtggggacatagagccaaaccatgtcactcatctggaactattagctcttggcttttacatcatgattaaactttaattttgtggactaccaagacaacctagtgtgtatttatagtattgtttttaagggagttatattttgatttataaacaactgactttgttaaaaaaaaaatgttatggccaggcacggtggttcacgcctgtaatcccagcactttgggaggctgaggcgggtggatcacctgaggtcaggagttcgagaccagcctgaccaacatggtgaaaccctgtctctactaaaaaataggaaaaaaaaaattagccgggcatggtggcaggcacctgtaatcccagctatttggtaggctgaggcacaagaattgcttgaacctgggaggcagaggttgcagtgagctgatactgtgccattgcacttcagcctgggcaacaagagtgaaactcccatctcagaaaagaaaaaaaaaaaaagttatgtgatctgttcataggatttgggctaaattctgagcatactaagaacacccttgattaaaaacaaaaatcaacaagattagcccaaatcctatgaacagattacataactttttttttttttggaacacaaagaatgaatgaggtcattttcctatcatgccagtagtgatttttaatctgggagtgttatttgcacatgtgtatgtgtaagagaaagagaacttttctgatggcatttgggaaaatagctgccaggcttcaacttaatgcctaaagattattgccttttgagtttttaaattttcttttaaagatttcacaactagtttctaaaatttttatacaatgaaaatggaggtttttatttttcataaatcttctaaaatgtgttggcaaacttgaactagtttataggatgatattaccaatttttggcttgatagcagtcaaattttgaagatgaatgctttttttcttatctgtcttttcttattcttttctctttgactgaaagttttgttccctttatttgtttgtgggaatctgacctattttaaatgttactttttttgaaaaagaaaactttactgacctcctttcgctagtaatctctctttcctttacttgtgcttttccagtagtaactatcacattctgtcctgtgactgtacattagagagaccaatgtatatatgttataaaagagaagtagcactcttttctcattctgctatctaatcatctcacatttccttttctttttttttttctgaggcggagtctctctctgtcgcccaggctggagtgcagtggcacgatctcggctcactgcaagctccgcctcccgggttcacaccattctcctgcctcaccctcctgagtagctgggactacaggcgcccgccaccacagccggctagttttttgtatttttagtagagatggggtttcaccgtgttagccaggatggtctcgatctcctgacctcgtgatccgcccgcctcggcctcccaaagtgctgggatttcaggcgtgagccactgcacccggcccacatttccttttcttaccattgcccataatattcagaccctttaggagttaaaaagagagattcagtagtctcccataccttgatattatattgaaaatatttttatatttcttttatatgtacatagtatgtttacacatgtacatgtttatatatgcatacatatatatttgcacgtttttccttctgtaaaaatgtaagtacattcatctgcctatattcttatacaatttaatataattcagttgaattacttttagatttgtagattaaacaaaagtgtagataactttccctttctcctttttgtcacaatgaaatgccatttctgaccttgtttttgtattttaacatctctgaaattgggatacacgtacaagtaaatggcatggtataatctaattggtataactttttttctttctcagtaatataaaatactttttactatgatgtgtcttctatccttggtgaattgatgttaagaatgcattcaaagagtgaataaaattgttttgttgaatgtgggagtaggagaaagtagtatttctaaattaatattattttgtcatatatttcattttaaatgtacgtgtagtaaccaagtgaatgtatttactagtataaattgtaaattagatatttgacgggtttacctatatgctgagtttgtttatttaggttgaccaaaaacggtttcttttggaccatctccttggcaaaatgggctttatgatattactttatgttagtatcccattatattcaggcatctgttgcatagtgtaacccggaaatgtaaacctaggtatttagtctttattctggtaaatatttttccttaaattttgaattgatagtcatttactgtgtcttcaaagatctaccatatagaaattaagccgtatgcaagattgacataaactgctatataattcatgaggaaagtgtctctttagagaaaaatattcttacttttaaatttatggatatgcatcttcaatccatgaagtatagtgtcagagaatatgctcttaatgtggttagagtggaagagagatgactggggctgcggatggtggctcagagtaattatataatatgtgttcttgcttgagggagaatggtctgtgtttaaaaaatgaaaaaactgaaaaggaaaagaaagataccagcatattacaactgaagatgactggttctttatctgatcctgcttgcttcagcttgctttctggggaagctgcttgtttctttcttcttcctccttgatgaatatcatagacttcctttaaaaggagagtaagttacaaagctttttgtagtcagttctgttaggttatcttcccaaagtttcctgtgggcacagcaccttatagtttgttactgtggtcttacaggaatctgtgtttaatggctactgtagtgtttcacctaaaagtataaagattaggattacatataattcgatgtacagattttttctcctgaagttatttcccaagagttacagtttagccggacgtggtggctcatgcttgtaatcctagcactttgggaggtgaaagtgggtggattgcttgagtccaggagttcgagaccagcttaggcaagtggcgaaacctcgtctctacaaaaaatacaaatattagccagttgtggtggtgtttgtctatagtcccagctatttgggaggctgaggtgggaggatcacttgagtctgggaagtagagtttgcagtgagccaagattgcgccactgcactctagcctaggtgacaggtgaaaccctgtctcaaaaaggaaaaaaaaagagttgtaatttgatgctaaagtgaaatatgattcatgaataataaagtaggtaaaaattaaattaataattaaagttgctctctggcaggaatgcattccattttttcccatggatttacccgtgtgttatgtaaaaacttgcatacaaagaagactcagttaatgtccttgttcatctaaaattattttgacttcctgtgtcacaaccaatgagatagaaggatcattgggaacaatcatttagagatcggcttctttctgcctttgaacattgtctgcattttacacagcgttatagatgctaaacgttcatggagttttatagactcctaaggaagcatcataaaacagataaattatgcccaggtgagatgtcagcagacctacattcttactctttttgagacggagtcttgctctgttgcccaggctggagtgcagtggcacaatctcggctcactgcagcctccacctccctggttcaaccgattcttgtgcctcagcctcctgagtacctgggactacaggcgtgtgccaccacgcctggctaatttttgtatttttagtagagatggggtttcaccgtgttggctaggctggtctcaaactcctgacctcaggtgatctgcttgcctcggcctcccaaagtgctgggattacaggcgtgagccactgcgcctgcccggctgctacattcttattctgtatctgccactcaggcaccatgtgattgccagcaagtcgttttgtttctgtttttcatctcttcatgttacaaggtaacaaatcttgtccttcttatctgtttttattctcacaatgactttttaaaacttgtaagtactgaattatacttttgcaagacatcactaagtcttagaaaacattaaagtataaatggaaatggtgcttgcattcaagaaatagatattttgtttcagattcttaaggtacaatttagaccatgaagctaatccagatgatactggtcgttagaagccctaactatttggaggatcatactaattacagtgaaactgattactttttgaaaagagaaaaactgcttgttgttgtaaaagacagtaatgaactgtaagggctacatgctgtgcaggaatattaagcatgactgctttatatctcctactgctaagcagcattggaactgaattgatgtaaacaagcctgtgtattcttgttcattattgcttttagattgcaccatttgaggattgtggtagatttggagtgagaagtactagttgttattaggagaaaattatgttttaacatttgagaaaattatttcaagtacattaaagttctgtattctacagaagctgtgtttttctgcttttgcttttagataacttggattctcttaatggaatggggtggttaaggcgtagttagttataaggtgggtgtctataaaactaagcagactaaaattgtgcagttacttaaagccaactctgactacttaaatgagaatgagatggctaaccttctctatttttcttagtgtttaagaaattgttttttttttcctgccccaggaaatggtaaattttagacaacttttttttttttgagaaactttcattaaaatacaatggtgtaatctaataagaaagtaaatttgttgagagttgaaaatctgaaataattcttttttagtgactgtatagaatttgtgactccttcccttctctaatcctgcattttatgatgtccatgaataatatttctgaatattgtccttattaattctttctaactttctttttcacattttcttcctggatttcctgtttccttcagtctcacctcaaggtcagtatgcttgcactaaaacaaagatgatgtgattgagcgttgtttgcgaatattgtcttgaattcttacagggaactgaacatatttcaggagagggatatctagaaatctagctgtgaggataaaatgtcaagggtattgggtttatcagaagagtgtgttcagatttttgtgctttgaaaaggtagtgtgagtagtcagagagcaagaaccagatggccaggttttgactgagagagaagtggagatgaaaagagcattacgaggaaagaggaggggaaaaagaattgtgttaatgtaattgaacattcagtggagacattctggctattaaacggggtaaagtgccgcaaaaatgatggagggaaagtcacaactgcctatagctttatagaagaaaccttgaattatttactgagacgaactttcagacacacacacacccacatcctttaaattttggtttcattttgtgactctgctgggtggtagaactagtgataacaaaaacagcaacgattactgctatttatatgtgccagaggcactgtagcggaacatattttgtttcagttgatcttagcaactatgaagagagatttattattttgattttttagttgaaaaagcacaagtgcagagaccattaagtaacttgcccatcttcattagtaagtaaatagtgagagaagcggcacaaaacaaaaatctgcatttaaaaagttacttattttgcatatgagccatgacaatataaagtgtgaggatttctgataggattcagaaatgagcctgttaatatcatatgtgttttacctagcagctgcctaataataatagcgattatatatatgtgtgtgtgtgtatatatatatatatatctgtgtgtgtgtgtgtgtatatatatatatatagatatatatttgctgtttataaaagcacctctttgactcaacagctagcatatgggttacactgggataagtgttaaaagagttagcccgccaaaaaagaaaataaattgaaaaaaatttatgccccctgcccattttgagtaagctgtattcattacagaaggaatcttaaagtgtttgtaataaaaatagcaaacacaaatactgcatttaaaaaatagattttcccgtttctaatctaaacattttctccacatattgtagtagaacagtatgggtaccacttaagtaattccaattaggtggcaaaatctgaaagcagttgagttttagtataaaaatttcatgaagtgttttgccttgtgtttagagaactttcatctctaacttaagcttcaagctgactcattttagtgggaagttttatcatttgtcccatagttagtcctttgcacgactggttttgctctcagtctctctaaatgaaaccctgggaaaagcttcagaagaatttgaccgtgaagccattggtatatacataattcactgagttacaggttatattaattgtaatattgttagctggtttattttagttaacttttacccagcagcaaatgccattaaatcatacttatttctaaataagtttattttccaaggaatacaaaataaaatagtcattgttttttcagtggcaaagatcatcttagctgtagtatgcaaaagtttaaagtctctcttcattccagattatgatttagtgcagtattttttttctagatagaaacattttaccattttaattgtggttttgccaagtccagttgaataggtcataaagagagtataatttattactgctttgatactggattgtttgggtgacttcattatatgaccttgggcaagatacttaacctttccatgtttattttaaccacttgttttgtgttaatagtgatgcttagctgtagtatttgtattttagtgtctccactaaacatttctattttgcagaggtttatttttattcctctcttctcccttgtcttcttcccctgccctgctctcctctgtcttcctttgcattcagtacagagtagtgagattttatttagagtgatactgactgaagactcacattttctatcttcagacatacacatctttttatttcctgttcaatgacattagcaccagagagtgaatacaaagaaattattccatgtatagatgaaaatatatgatttggttcagaattcttcttttggctaacggtcattcagagatgagagctataaatgtcatctctattctcattaacacttaggtctaaaattgagctcaatattattaatatctatgttttaattatcagttaccactgtagacttgtttttaaaacaaatgtttagaatatgtgtgatagttcctaacaacttcattaacccatttataccagaggttgcacattttttgtgtgtgaagaatcagagcttcgtgatgaccttgagcagtaggatataaataactaccacaagcttagcattccagtaatagaacactaggcataaaagggttaagaccagagtccctatgttgttaaaagttaaaatacttttatactttgccccccaaaaaatcccattgttatagtctcttttatatagtttgatggaaacatttcacattaatttctaaaatctaattcaaatagttatttctctgattacacactttaaaaagattttttacattattgtctgatttcattaagaaaaggcactatactagttgctaaaacctcatcataagatatatcactcacaaaaatagatgtaattgtatttttgaaagggttagtttcttatttttttagctaaagcttttttttataggccctagaaaatttctgaccccataaaatctatttacaaggagtttgacttatgggcaagagtttataacccaggagaatgatcgttattatttgcatttttagcttccacttttcattcctttcgcttttttaagcaactctattgttcaagagcgtatttcttattatttttctttcaaataatagtgcctagtgtttttgtaatagtctgcacaagcaagtgtaacatcttctctgttaaataacatctgctggtgtagtagtgtactcttttgaataactcattggtgggaaaaaaaatacgtgaatgcagacttgtgctgatcttcctaactcttctactgaaaatgatagttttatgctatcatgcattgataaatggtaaatgtttttttagatagcaattgtagatcaccacggttgtagatcaccacaaattctgtaaatcagctgaagatggcaaattcaacagagaagggaagaaagaataattttaaagttggccaaaatttgagtttttatagagttgccagatttagcaaataaaaatatggatgcccagttaaatttcatataaaccacaaatcatcttttagtatgtcttataataactattgggccatacttactctggcacccacccccccatctcagtaaaacgacagaaacacgtctgatttctgattacagtttgacactgttaaaaatgctatcaccttctttatctcacttcacctcataacaactatatgaattggatgacattttcccgtttcacagatcagaaaattgactttacagagatgagatgatttacttcgggtcatagctactaagtggcagaatctagggtacaaatctagtttgtctcatttcaagtttacttcacactttcctttcctctgtatcaagcttgtccaacccatggcccacagcccatggcctgcatgcagctcaggtcagctttgaatatggcccaacacaaatttgtaaacttacttaaaacattatcagctttttttcatgtttttaagctcatcaactattattagtgttagtgtattttatgtgtaggccgataattcttactcttccagtgtggcccagggaagtaaaaagattagacacccctgctctatatcttgttctgttatgtgtttgtgacatctagagatgacatgcaggttgtaatacctttttaaatttatgctttttagatccttggagcatgggggtgaagggttggattacttgtattatttggtttgcacagtgtccagagaagcagaatgtgtggtcttggagtggaaactgcatgcagctctatctcttatttggcagctgttggcgtgttccagttgtgtcttcttttgattatactaagcctgtcttgtatgggaaattgattaattctgaataaaataatgatattgcaatcagcaattaaattgtttttttgttttgttttgagatgagtctttctcttgttacccaggctggagtgcagtggcgcaatctcagctcactgctttcaagcaacctccgcctctcgggttcaagtgattctcctgccttagcctcccgagtagctgggattacaggcacttgccaccacgcccagctgatttttttttttttttttttttttttttttgaggtggagtcttgccctgtctcccaggctggagtgcagtgatgtgatctcagctcactgcaacctctacctcccaggttcaggcaattcccctgtctcagccttctgagtagctgggattacaggggtgtgccaccatgcccagctaatttttgtatttttagtagagacagggtttcgccacgttgctcaggctggtcttgaactcctgacctcagatgatccacccgcctcggcctcccaaagtgctgggattacaggcgtgataaactgtttttaaagcagtctcatgatggctttatttgcaagggggctattggtatgtattgttccctatgattatcaatacatttggaattcacatagttaaacaaacttatggtttcatgtagcaatgtttgggatttcttcatagcatttttttttttttttgctctaattcttaggtgagattggctagtctgtcaccatttgtagcctgttgtatgagatgttcctatagtatggactagttcattcatttgtgttgtcctatttatcaacattttctgccttgctcaagaaatgctctataacgcaacttgtatttcagatattgggtaatttgattattttataagatcctttagaacagtgcttctcaaacttaagtgtcatacaaattggatgggagcttgttaaaatagagttcttatttgatggatttggttggggcctgaatttttctacctttcgaaaagctcccagttggtactgatactgttggtctgttgagcgtgctttgactcacaagattttagtgagttaacgtttttcaaatagatttttctccttttttaaaaaattcacaaacatttaacaatatctctgttgatttatttatactagctcatatttgaacttgttataaaaatcgacctttccttgggtttaggatatcaaggtgaccgttttgcctttgttaaaggacgtctgaggttttctattggcatgggtacaagagtcaggttaagatttcaggatgttagagcaaaagcactgttttcactggcacctgttgccttgttgctttaaatgtataaaagcatattgaacagtggaacaaagtgacaagaaatttagggtgaggcaactggagaaaagagtcacaaacttcagaactattgagttggcttcttgggtatggcttatgctttcacagaaaccttccttccaacctctagtttctgttgtccatgtatgtggctttgaggtctcagaatttgagattgtgctttgggagaaacagacaaggaaatcagtggccttcactggcagctggcagacctgtaagtgatgtggtttaattgtgtgtacgtcaggattgctctgtctttaagacggtctttttaagctgcagtgtttatccactgttggcattttctttgttggtgaagttgtattcttttgttttaatcttccagctcttgtctgggttgtcaaatgtttgagcatgatagcaaagatctcaaaactagttctttttgcaagcagatctcatctttaaggtgtagtgtaatgggattcagaaacttgactcctgtcataggcaggagggaaatgtgtgtttaatttttctttacttcgctttccttcattaatatgggattgttattattattttctggtgtgtttgggatagttgctgtcaatggctacaaaagacagttttaagattctttagctagggctgggcatggtggctcacgcctgtaatcccagcattttgggaggccgaggcagatggatcacgaggtcaagaggtaaagaccagcctggccaacatggtgaaaccccgtctctactaaaaaatacaaaaattagttgggtgtggtggcatgcgcctgtagtcccagctactcaggaggctgaggcaggagagtctcttgaacccgggaggtagaggttgcagtgagctgagattgtgccatgcctagcaacagagtgagactgtgtctcaaaaaaaaaaaaaaatgtagctagctgtttggcctaggtattacaaatttcaatgtttgttattgtaagtttctatattcaaaaatcacttaagtatgttacacaactattttgaaactgttagtgaaaaataatccccttcaaatgcaatcttttaaattgatatatatatatatattttgagacagagtttcgctcttattgcccagactggagtgcaatggcacaatctcggcttaccgcaacctccgcctcctgttttcaagcgattctcctgcctcagcctctggagtagctaggattacaggcgtgcacccccatgcccggctaattttgtatttttaggagagacagggtttctccattgttggtcaggctggtctcgaattcccatctcaggtgatccacccgcctcggcctcccaaagtgctgggattacaggcgtgagccaccgtgcccggcctaagttgagatgttaaaaggaaagtactttgcagatgactttccaagaaaactagaaggaacaattggcttggggaagtgatcataatgatataacttggatataatcagaactttttgtcttttttctgagatggagtttcgcttttgtcacccaggctggagtgcaatggcgcaatcttggctcactgcaacctctgcctccagggttcaagtgattcttttgcctcagcctctctagtagctgggattacaggcactcaccaccacgcccagctaatttttttttttttttgtattttcagtagagacatggtttcgtcatgttggccaggctggtcttaaactcctgatctgaggtgatccaccatccttggcctcccaaagtgctgggattacaggtgtgagcctctgtgtccggccataatcagttctatacaatgtgttgtgagaggaaaattcaccacaggctctttaccttatttaaggaggtcaattaaatataaaccatagtagcttgcttattgtcattattagtttattgatgcaacagtagagtaagttgattctttcctacattactgcaaaagctatctaatgcttcctcctgtccactctcattatgtttccctttcagcttgttccaaattttgggaaatctgattatatcacttccttatataagtcctatatactttgggtaagctacgcattccttgcttagcatataattgtttggctttgcttacctttagctttctttttctctactctctcctccaactttaagctatagtcattctgaaccatgaggttttccccaagataacacattctccttttcctcaggtttttgttcgtagttcttctctgcctagtactggatcacctgcctagtaacttggacttaatcccttaggaaagttcagatactgtttttccaggaagcctttcctgatcatcaccaccacctccacctccagactagcttagggctctttcctgtccactctaatagcacttgttatatactgtatttccttagatgcctgggaagtatttgagagcacgaacaatttttattcatgaaattgttgcaggaatttttcttagttcagctaaagacggggtccttgtcacacagccacgaaaatttaggcttgtgtacgattcgaacgttgagtaggacagggttttattgggtgaaaaggaaaagggggaaacagggcctctctgcaggccagattccttgctagagtgcttcccgccttgcagattgactcccaggttacacccgtgaaaaggaggggccaggctcctccctgctgcacaaggtgcagatttctgtagctccatcccagtgtgctctcctcccagggcaccgctggctggagtttctctggggaccccttcctacctggctttctcaaaattgtatcctcagtgtttgatatataatggtagtatttaatgaaatatttgtctatttaatgagtagtgaatatgtaaaaaacttagcaggctgtcaaagcttagataaatgtgatcctcttacatcccagagcctattttctcctgggcaatgcctaaagcttattttttagttgtctagtaatcccgattctgccctttgtgaggttagtcttcttcacctttacctgtaacctagcatttagtctagttttctgacctaccggtattttttttctagatgtaaaattatttcctgactctttctgcctaaatcttttggcttccattttgactattcacataaagagggaaaaaccccatagtgtcttacatttatttagtacctagtagcttaaagtgcactttcacattcaccatctaatgtgagtgaagagacagattctgtggaagaactaaactcatctggtcatactcatcatttcaagtgggaagaaagtggtagctttgaaaaggaagagtgcgtagaaatactgttgtagagtcgaaacttgctttcagaggagttgagttttaagaccgggtgcggtggctcatgcctgtaatgccagcactttgggaggtcgaggtgggcggatcactcaagcttaggagtttgagactagcagggccaacatggtgaaaccccatctctactaaaaatacagaaactgcctggttgtggtggtgggcacctgtggtcttagctacttgggaggctgaggcaggagaatctcatgaacccaggaggcagaggttgcagtgagccgagatcactgccactgcactccaccctaggcgacatagcaagactccatctcaaaaaaaaaaaaaaaaaattgccacgcatggtggtgcatgcctataatcccagctactcgggaggcagaggcacaagagtcacttgaacccaggaggcggaggttgcagtgagccgagatcacgccactgcactcagccttggtgacagaatgagactctgtctccaaaaaaaaagaaaaaaaataaggaaaagttgagtttttaaaaaaggaaatgaatccatatgagaatgccagggtacttacatcattggatatgctgcacttttggaaagaaaaaagacactgaaagatgaaatttcctaagaacagaggaatacatgctgttaaccatggtaatagaatcctggtaaggtaacaactctgtagagcagtgggtttctgccttctgatttatgtactatgtacaccatcttcatttcatatttggtatcagagatctcccaggtaaacagtatttgcttataatttctatagtagagaggttaaaagtatcgtagttacagtcagacagacctgagtttgagtactagttctaggatgtttaaaactgattttgggtaatgatttaattttattgaaggtttgctcttttcatttttagtgtggagttaataaaacctcataaaacattttgaataagatgataaatatgctgtgataaacattaaggtccttggtatataataagtacttgtaagggttattatggtattatatttagcatagcgctagagttagatataaacatataacacataacttcaatagtatcctccttccctccactccccgcctcccggcctcccctcaaagagtgaagaagaagcatattccatgtttgtttggatcttaatgaaagggcaaatttagatatttaaatttatatattaacatataaaacataaatatgcgtgtgtgtatacatacacacacacacacacacacacacacacacacacacatatgtttggggtgaggagaaaaaggatatgttagtaacctcttgcagtgtgccaaatcttacgctaagcattttccatgcattattttatttacttctcacagttctataagagatgggcattattcccatgtcataaataaaaaagataagaacactctgaagcttagagaggctaaagatcatatagataatgaatagtgaaccagcatttaacctagagctctttagcccttaaaacttttgcttttaaccactctaccatttgtattcctgttaggagtctcctcacatcccttgggagaccttgaacatattctgagatttacaagttaccatgttaattttatgattttgtattttcatttcaatgacaataaaaaagtttatatacatattctggatcacctgggtgactgtcttacaatgaaataccctatgtagtttcatttatatttatggatatcatctcattgtcttcaggtattactgttataattgtcatgggccaatgagaaaagaacagtggtgggcctaatccatactgttgctttttatccaagcagagttcaaatgatgtcataatgtactataagcagcaaactttttttaaaaagtaatttgacaaaatttctgagacagttggatcatcttacagctcaaaacaaaacaacttggacaatagtaataagtaccatgagtgcactgtgagcagcaatttaacagcatattcaattaatactggtactttgcactatgtcttttggtttgaattgcattcaatttgggaactctagatctaatatttgcattttttacagtattacaatttatcagtggatctagaaaatattttcttttataattatactatattatactatcatctagatacagaccctttagctcatggagatgaaggaatcagttctgtttaggggagtgctggaaagctttgccaagatactgccatttaagcttcttcttgcagaatgagtgcatgtatgctcttatgctcggcaaagacagggtaagggaaagggcagggacatgaagacatctgaaaaggcaaaaaaacaaaagaatcttttcctcatgcttactgcatgagggaatattaaaaatataggttattgttaaagacctttagtgctaattaagggaatatggattttattacgtaattagtgtgaatccaaaaaaagcaaaaagtgtgggaatataaacaacttttataattcaattgtgtgcatatggaatctttgtaaattaagtcatgttttacataaaaccagaatcttattggttaaagactatttggaaatggaatgtaaatgtttttgtatgaaaataaattgtccccaaattttcagatttacaagttaccttttttttggtctccccctctccttccttctttccgttcttttcctctaggcgcatcctttaataatgaaatcagaaactcgtaactttattcttctctcccatctcactgggatattttagcgattaatagtattctacccatttgatttaatgatttttattttattttaactaacatttattgagaaaactacatatgagattttctgatcactaatatttatttgcacagaaaaaggtgttactatcatttacttaatagatctgcttttattaatgattttatgccttgatttcccacagttagcctccagctgttacttctgtattatgcatgttagagtgaaatgtccaaattaaattagtttttaagctgagccctgtgaaatcaccaggtggagaaatacggatggcatattattcctgcatatgcattttcatatgctattggtgcagtgtaattcaactgtagcattcacaactttcatcattgacatagccttggtggggtcggggaggagggatggggggtggggggcggggggagtaaatggaatgatatgtacaaaaacacttttcagctgggaagagtgaaacaagttaataggaaataaaaggccatattgtctattcagactagtacgttacttttccagagtcatggggctagcaaccactatatgtctgacttctaccaagaagggttgaatccctggttgatcctgtgaggcctgaggcatataaacaagaaacatgaaagggagaggaaaattaaatgaagtgggagtgttgcagaataataatacaattaagggagaaaataatagaggtagaggaagaggttatatacacttatttctcttactatgaacattttacttagaagtgtaaggttgtatgtcttgtttgatacagtgataaaaattatgataatgcttaacagaaatgggtgctttgctccataaaagtgctccgtgctttcctctgtcattatgaattaatcagcaagaaatccagaagtgaacaacataaaagtattccctctcctcctttttttaaacagtgaaaaaagttgacaatatatttattctgtcatagatccaaaaagccaagcctgcgttttaaggcagggttttctttggttttctatttctcagccacaccttcagatttcttggcacagtacagtcatagcattgtgtcatatccttggtctgttttatcagactttataaattgattctgactgtaccagcagtactagattcttatctttacacagtttgggaaatggacaatgactcttttggaaaaacagctctataaattgtgctgtggtatgtgagaatgggttctctgctttgcttttcctctagcctgctgccattcctagacagtgtcatttctctgatttagggcattgtgtagctgttctgggtagagtaaacctgcctctaaatgtggaacagattgttacccgtcagaattctccaccttggaatggtgacactgaaagatacaattcagctctggccaacacctcctgtcttcccagttcacttactctcgtctccactccaattattgcatctaattaggaccttgaaacaacaacctactacttttttttgtttgttttgaacctcgtatggcctcacacttccttccttacccgggtcagatttcatggtccagcagtataattactcccttctaaatccccttgacttacttgcttttctcttttgtcacacttgcttgcaaaacctcaatcctgatttaaagcaagtgtcttcctacactgcctctgccctgagcagctttatgttaccgggcaagaagagtcacaaagctttgcagactggtctcacattgaatttatggccacagatctcaaattgctcctaattctgcaggcagtcctaattaagaggactattagatttgatttcccatcctcagaggtgactgtatcattctgttctcttatcaaatctgcaaatccttcgcctccactcaaagtttctggcttcacttgatatttctttgagaaaattaaaataattggatgctacccagtttgtctcctcatcaaatctaccagcctacttgcatctatacctggagcctttgcctgaatagtgccactattcctgaattcacctctgctgccttttctgttaatcctatcccagttgcccaacctaaagatgcttctccctcattatccttctccctcctttcaaatttttgctttctccttgttcacaagtgtactaacctgcctttagagttccacttaatgtcttaaaaaaaatcgttctcttgatgtgatgtcttattctagttgccaccctgtttctctcttcccttctcagcaaatcttatttaaaaaattgactgtagttgctatctgcctttccttacctttcttcaagtttgtttaatcaggctcctatttttagtagtcttacgaaactgctcttgtcaagttatcataaatatccatgttaccaaatacagaaatcacttccatggccccatcttaactttacctttcagcatcattctacacatttccttccttgaaacactgttttcttctggtatctctgataccagtgtctccttattttctccctctttcacctgtcattccttttgtggtgtttctgattctgccactttcctctagacctctaaaaggctccactctcagtcctattctcatatatatatatatacacacacacacacacacacacatatatatatatattctcagacttttcttttttttgagatggagtctcactctgtcgcccaggctggagggtaatggtgccatctcagctcactgcaacctctgcctcccaggttcaagcaattctcctgcctcagcctcctgagtagctgggattacaggcatgcaccaccacgcctggctaatttttatatttttagtggagacaggatttcaccatattggccaggctggtcttgaactactgacctcaggtgatccacccgccttggcctcccaaagtgctggaattacaggcatgagccaccatgcctggcctcagacttcttcaagtctaaggcattcattatcaaaaacacagcaatagctaccaaattaataatatacaaggtgctccagaatactctacttattacctacacaatgtctttagttaaatatcaaatttagttttactcagaacagatctcttgatctggcccacctttttcaaaacctcttcttccccagtttcccaccctcaataaatggtactaccattcactcattgtgcaggcaataaatcaccaagcaatccttgatttttcttactccctacgttaaatctattagtaagcccgatcacacctcaaaaatgtatctttaattcaatgattccattcgattctctctatgaaccattatccgttgctcaaattactgcagctgttttccaatggctatctgcttctatatcacttctgtactagtcccatctctgtagcaatcagactgaactctctttttttttttttcttttttgagacagggtctcactgttacccgggctagagtagcctggcgtaatctcggctcactgcaacctctgcctcccaggctcaagccatcctcccacctcagcctcccaagtagctgggactacaggtgcacaccaaccatgcctggctaatttttgtgttttttgtagagacagggttttgccaaagagcagggagtacaggcatgagccaccgcacctggcctgaactgaactcttagacattgtcaccccttgggttaaaaccttcctgtgttctcccatcatacacagtgaaacccaagctccttccacagcttaggctctgtatcctatggcttcttgccacccctgtaaccccaccacaacctccccttccatatactccacctatcagcttttttgttgttgttaaaacaagctaagcattttctatcctcaaagcctttgtagttatgattctctgtgcctcttctcctagatcattatatgtctcttccctgaccattgtagctgaaatacactgtttgtcacatccagtgtctccattacattgcttgttttaatttttttcttagcacatgtcactgtgctatgacatacttttttgttagtttatgttcccgcctcccccttttaaaaataagttcaatatgtttgttgagggtggggacattgtattcttttttcttccttagctgtatttaactcttggcaggcattcagtaaatatttgctgaatagatgtgcgagggctggctcttttctgaaaaagttgacagttgagaatgcatgctagttttaaattatggacaaatatgtggctttacatcagttgagagaaacttgaatgtttattaggttactgttatttttatttgtgtttttgagcaattcttttgtactttgtgataacaagtaattgcttccaaatgaaaaagacttttccagtgacctgcaaagctcttcagcagggattggcaaactacagctcatctggcacctatttttgtaaaacctgcaagctaagaatgggttttacatttttcaagggtaacaaaaaagaaaaatatatgagacagattttacatgattcacaaaatgtgaaatatttgctctctgatcctttacaagggaagtttgctaacccttgctggaggcggtggccctcattacctgccttcctcattagtggcctgctgcatctgtctgcttcacctgggcctcgtgcccattcgcatttgctgtttccttcgtgaggaacactcaggctcactcccttacttccttcacatctttgcttagctgttgcctttgcagtggagcctttcctgagcacttaatttaaattccaatcccgccacccattcctacacaccttatctcctttcttcttttatttttcccattggacttatcactgtctgacataccatgtatttttcttatgttctctttctttccagtggacagtaaactcagtgagggctgagatttttgtccgttttgttcacggccatattttcgaagatagcacctggcccatagaagcttttattaaatatttgttgaattaatggtcatagattaaagttatcttgagaaccagcattaaaaaaagtcaaaacacttcagtaaacattgattaattgccataaaacagtcctcatctcagatctatggagttgtataaaatcgggtccttgtcttcaaagaaattagtgtagtagtgagaataagcatagaaataaaagacactaaatgtaagatgagactaattatcctgcagtttccttgctgattaaaaaaatgttgaattgatcatttaaagtatttttgcagaagttaaaagtgtttatgtaaaactccaagtaattaacacttttacgttctgtattgatatcttttctccttttcatcatgacttgttttctttagacagttaggaatatggttccgtgaaaataaaacccatatttaaaatggcttttaaatagtcaaaagcattttaattagataaataacaagtgaaactattagcattttatttttagttttttggttactctttgggcaggtattttttaaagcacaattagatatttaagtagtattataaaattttatgtcttaatttttatgttaactgtgagtggagctctttggaagaaggtaaaatgagagagagtgtgtgtatgtgtgtgcacgtgtgcaatatatatagtcatgagtcattgaataattgggatgataggttctgagaaacatcactatgtggtatcattgtacaaatatcatagcgtatactaacacaaacatagatggtctagcctactgcacagccaggctgtaaggtatagactgttgctcctaggctataatcctgtacagcatgttaccgtactgaatactgtaggcagcattacacagtggcatttgtgtacctaaacatgtaaacatcagtaacaatccagtattataatcttatatgcatctgcatacaagatgcagtctattattgaccaaagcattatcatcatgtgctgtaggactattatgagtgtacatattctctttttttttttttcttttttgaggagacagggtctcgctctgtcacccagactggagagcagtggcgcgatcttggctcactgcaacctccgtttcctgggttcaagcaattcttgtgcctcagactcctgagtagctgggattacaggtgccaccatgcccagctaatttttgtatttttggcagatacggggttttgaggctggtctcaaactcctgatctcaagtgatccacccatcttgtccccccaaagtgctgggattacaggcgtgagccaccacacctggcccatattctctatatgtaacattttataaatattatagatgtttatatgtaatatacacagtgctttagcaatgtcattttatttttaattattgtctatttaagccctagcttaagcttctcttcttgagtgaaaacacaaataccttagtgaaatttgattgataatattttttttaatttgacaatagaagcatcctattttttcttaaatttgtgtgggagattttatggtatagtaacgtataacactaactatatgtaacttcctttttggtaaagcaaaacagccagtagaattgtagcctctggcaaatgttgttagtttcttaataggaaggagtaagttaaagacagataataaaaattcctttaccaattaattttgctaggtgtttaagatacaaggaagatatttattttttagtaattccattgttttagagcttcaaacaaactgtattttccctcagagttttgttttgggtggatttgtcagtagggtatgattagtttcctttttacgcatttgttcaacaaatgtttaatgagcacctataaaccacaaggaactgtactaggaattgtggattttgaaaatatatcagaggaggactttaacctctaggaaggcatgttcataaagtacagtaaaacaggtatgtagactccctccctaatgtggagaacaagtcaacatgtcataagatagattcagttaaagtggtatgggagttaggagcatccataatagttgtgatctaatagatttacctaaatttgagtttggattttaagagacagaggcttagagcagcaataacaaagtaaatatgggcaaagcctgcctggcatagtctgcattgactgttgtttcttaacattgtgcatttagtgtgtattcatatcccctgggaacctcgttaaagtgcagattctgatttaataggtctggcgtcaacctgagattgggtgtttctaccaaacactaaggtgatattcatgatataagttcatggatcacactttagatagcaagatggtggaccacattttgtaaaacttctggtggcagagacaagtaaaaattcaactactattttctttcccatcttcgtttttctgtcttcttacacttttgtttgcttacatctgtgtgctggtggagagagttaaatcttttattcatcatttcactgtttattataatagttgggagcttagcaattgtgaatctaattttaaagcattaatttatttatgaattgctctaatttgtcctcttcctgcttgaagaatggtaaaacatctatgttcactatgaattaaattcagattagttcaggcaaaacagcagttgagagagttttaataaatttactaaaccattaaatccatggcacctcacgataggaatttactaacatctgggttttcttgagaatttagattcaaatcaaactagatgttaatctacttataaggaaaaagaaggaaattcctcatttcacaagttctgttatgtctcagaatgttttttcctaaatatacattccagaaataccctccttttactcttttaacttatatttagatgatactccctcttatatctcttcccagagaaacagtattgaaaaggataataatgaggcaagaaaatcattgtgtgttttcatcttttccagttaattcatgaattcagaactatgcatacattcataaaaccatgtgcatgcacacacacacgtacacagacagacacgcatacacaggacgagaaggtgggggtaggcaagagattgatttaattgtctcacaattttctatacttttcttggttgcctatcatagataaaaccattttatcttgatagtcatcctttagcctatagagtgaaggtgaagaaataatagtggtgaaactaaagataggagatttaaaatatgaaaagaaaatggattaagaaaatcaaagaccaaaaacttaaaagaatcaaagaccaaaaaaatgtgccatactgtactactttgtatatctagtctgatataggcaaacaacctattttgagatacaaccatatctctttttagaaacaacttttaaagaaaattttaaaatattttatgtctgaagtagaaaatttagaaactgtaaaaaaatgataaaaaagaaaaaaaaataggctgggcgctgtagctcactcctgtgatcccagcactttgggaggctgaggctggaggattgcttaagcccaggagtttgagaccagcctgggcaacatagtgagacctcatctctacaaaaaataaacagcaataacaaaattagccaggcatggtggcatacgtctatagtcccggctacttgggaggctgacataggacgatcatttgagcctgggaaatgagctatgattgtgccactgcagtttagcctaggtgagtaagtgagaccttgtctaaaaagaaagaaagaaagaaaagaaaagaaaatgaattttcaaaaaacaaaaagaaaaaaacatgcttaatttgtccatcttaatattcttcattatatgtgtgtatatacatacatttgggatcatgctctgtattccttagttagcattttattatgtctttttggagttgatggaggtagtcattagtatgtctgtgagccaggtggaatgctcacacctgtaatctcagcaactcaggagtctgagacgagaggatcacttggggccaggagttcaagaccagcctgggcaacatagcaaggtgctgtctctacaaaaattagctgagcatggtgatgtgtgcctatagtcccagctacttgggaggctgaggcaggaggatcaattgagcccaggagttcaaggctgtagtgagctatgatcacgccactctactacagccaggacaacaaaatgaggctgtctcttacacacacacacacacacacacacacacacacacacacacacacggagtggttgattggataggatgagggtaatgaatttcttgaattgttttttctgaaacacgactaaaaacaccataacctagttttatgatttgtaggtaaagtaggatttttaaaatcacttactcttcgatataattgtgatggaaagtgctgaggaatgaaattggctttgattggattaaatatctaccttctaaccaaaacatagtctagtagttttaattcagttatttattccacatgtcataatgccccaaataaccaggctactgctattggcattaaaggttgccagcaccatctggaataattcacaaatgcaaggtgaaaggaatttctgcaccatttaaatttttttctctctcttaaaacagagcaaaatttttgcatctagtaaatgaatgttaggaggaacttaattttgagaaaaagcaatttgattcataaaaacagaatttttctccatttgtttgtcttctctaatgccaggagccagtctgctttttccattagttaatataattgatatcagattgttaaaatgagaaataaaaaattatagagtaaggagaataaatataaacattatttttctttttatttcctctagtgataactgattttattatattgtctgtggctgaattcttctgtagatattgaagatggccaaaaatggagatctaaaatgtaacttcttagtgtgcattttcaatggagaatgaattatctcatcatctgtgtcattaattcatgattttatcttgaataatttttcccagctttattgagctataaattgataaaatagcatgcatttaagtacggtgtaccacatgatctgatacatgtatacattgtgaaggattagcacaatcaagctaattaacacctttatcacctcacatagttaccacttgttgtgtgtgttgttagaacccttaagatctgctcttagcaaatttcaagtgcgccgaacagtattattaattatagtctaccatgctgtacactggatcttcagaacttactcatcttctgtaactgaaagtttatgccctttgacaaacatcttccacgatctccccctttcccaaccctctagaaaccaccgttctactttctctgagttctgtgaatttgatgtttttaggttcattcatatcacaagtggcagtatttcccttttgttcttgtttcgaaacagtctcactctgtcacccaggctggagtgcagtggcgtagtctcggctcactgcagcctccacctcctgagctcaagcaatttttctgcctcagcctcttgagtagctgggattacaggtgtgtaccaccaggcctggctaatttttctgtttttagtagagatggggttgcgccatgttggccaggctggcctcaaacttctggcctcaagtgatccacctgcctcggcctcccaaagtgttgggattacaggcgtgagccactgtgcctggcctcctttttgttttatggctgataaatattccatttgattatatatgccacattttctttatccattcatctgatgcacacttatgttgtttcacattttggctatcgtgactaatactgcagtgatatgggagtgcagatcctgatttcagttgtttttgatgtgtagcagaagtgacattgctgagtcatatggtagttctgtttctaatgtttagaggaaccttcttaccgttttccataatggctgtgccagtttacactcccaccaacagtgtaccaggattctcttttctccacatccttgccaatacttgttatcttttgtctttttcatagtatccattctaactggtatgaggtgatatctcattgtggttttgatttgcatcttcctgtgatgttgagcgtattttcacatttagctatcctttggcctgttgagcatttttccatatacctggtgaccatttggccatttaaagtcttctttcgagaaatgtctattcagatcctttgcccattttaaaatcaggttgttttcttgctattgagttatctagacattttgaatattaactccttatcagataggtttgcaagcattttttcccattctttaagttgtctctttactctgttgattgcttgcattgctgtgcagaagccttttagtttgacgcagtcccatttgtctattcttgcttttgttgcctgtgcttttggggtcatgtccaaaaaatcattgtgcagacccacatcaggaagttttctttccccagtgttttcttctactagttttaaagttttaggtcttatgtttaagtctaatccattttgagtcaatttctgtgtatggtcagggataagggtccaatttcattctcctgcatgtagatatccagtttccccaacaccatttattgaagagattatactttccccaatgtgtgttcttggcatctttatcaaagaccaattaactgtaaatgcatgcatttatttctgggttttctattctgttccattggtatagatgtctgttttcatgctggtaccatagtgtttagatttgtaacatagtttgaaatccgaaagtgtgatgactccagctttgttcttcttactcacaattggctattcacggtcttttatggttccatacgaagtttaggattcttttttctgtttttgtgaaacaatgccattggtattttgatagaggctgcattgaatccatagattgctttgagtagtatggacattttaacaacattaattgtttcaattcatgaacagattatctttccatttgtatgtatctttttcaattcctttgtcttctagtttttagtgtacaaatctttcagccagttgtatacaaaaatatacaactaatttttgtatattttatattctgcaactttactgaacttactataatagtttttaacaatttttttatgcaggctttagggttttctatgtatgaggtcatgtcatttgcaaatagagacagtttatcttgtattttccagtttgtgtgccatttagttctttttcttgcctaattgactaggacttcgaatattctgttgaagaggtggtgagagtggactcccttttcttgttcctgatgttaggggaaaagctttcaacttttcaccgttagatttatcggctgtgggctaatcatatatggcctttattgttgtgttgaggtacattccttctttacctaatttattgagagtctttatcatgaaaggatatttaattttgtcaaatactttttcagatgattgtgtgatttttatcgttcattctgttagtgtggtgtatgacgtttattaatttgtgtattttgaactatccttgcaaataaccacttgattatagtgaatggtccttttaatgtgctgttgaattcagtttcctagtattttgttgaaagttttgcgtctagtttcatcagtactattgacctgtaattttcttttcttatagtatccttatctggccttggtataagggcaatactggccttttaaaatgagtttggaagtgttcctgcctctttaattctttggatgaatttgagaagaattggtactagcttgtgcttaagtgtttggtggaaatcagctatgaagccatctggtcctcagcttttctttgttgggaggtttttgactactgctttagtcttctttcttgttattggtctgttcagctattaatatgtcttcacttgtccaggtacagtgtgtaatcccagcattttgggaggccaaggtgggaggatcacttgagaccaggagttggagaccaaactgggtaacatagcaagactggtctctacaaaaaaataaaaaattaactagttgcagcggtgcatgcctgtggttgcagcaacttgagaggctgaggcaggaggatcctttgaccccagaattttgatgaactatgatggtgtcactgtgccccagcctggacaacaaagcaagaatgaatctcttttaaaaaaaaagtcttcaattttgttgttgttgttgttttaatgattcagtctttagggtatatgtttctagaaatttattcatttcttctaggttatccaagttgttggtgtattaattttcataatattctccttgtactcctgtggatcagttgtaatgtcttctctttcatgtctgattttctttatttgaattctctttctcagttattctagctcaaagcttgtcaattttgattatcttttgacaaacaactattatgttgattttttagaattttctttctggtctcccatttatttctttattatttccttactttagctaactttgggcttaggttgttcttttttctatttttttgaggtgtaaggttaagttgtttgagatctttattttcttaaagtttattgccataaacttgtctctttgaactgctttgctgtattctgtaggttttagaatgctgtgttttcattttatttgcctgaagatactttttgactcttttttttttttttttttttgagttggagtctcactgtgtcacccaggctagagtgcaatggcacaatcttggctcactgcaaccaccgcctcccgggttcaagcgattctcctgcctcagcctcctgagtagctgggattacaggcatgtgccaccacgcctggctaattcttaatacagatggggtttcaccatgttggccaggctagtctcaaacccctgacctcaagtgatccgcccacctcagtctcccaaagtgctgggattaaaggcgtgagccaccgcgcttggcctgactttttgactctccttttgatttcttctttgacccattggttttgtcaggagtatattgtttactttccatgtatttgtgaatttttaaatttccctcctattattgatttctaattttataccattgtagttgaaaaacatgcttgatatgattttaacatagttggatttaacacttaattttgtggcctaacatatgttatattctggggaatgctctatgtgtacttgagaaggatatgttttctgctgctgttggatggatgtttcatatagtctgttatttgctctatactcttattcaggtctaatgttttcttattgacagactgtttgacctatccattgttaaaagtggggtagtaaagtcctctcttgttattgtattgctgtctgtttctcccttcagttctgttagtatttgctttatatttttaggtgctctaaggttggatgcatatatattaatacatttacaattgtaatattctcttgatgaattgacccatttattgttgtataataaccttgtctcttgtgactgaaagtctattgtgtctgatataagtaagcccatttctattcttttttggttaccatttccatggaatatctttttctatccttttgttttcagcctgtgtgtgtccttacagctaaagtgagtctcttgtagccaacatattgttggatacttaaaaaagtctgttagccactctgtatcttttgattggagaatttaatccatttaaagtaattattgatagttaaggccattttgttgttctctgttttgtaggtcctttgttcctttctctcttgctgccttcctttctgatttgatttttttttttgtaattgtatgcttaattcctttctatcttttatatgttactggaggttagttttctttgtggttactatgagggttacataagatatcttaggctgttttaaggttgtaataactaaactttaattacctacaaaaattctgcaattttatgtctccctccttcacagtttatgctattgatgtcacactttacatctttttatatttgtgtacccattgacaaattattgtagctatagttatttttatacttttgtcttttaacttttatgctagttaaaattgatttatgtaccacgattacagcattgcagtattctgaatttgactgtatatttatttttaccagtgagttttatactttaatgtgttttcatgtttttatttagtgtcctttagtttcaactcagctccctttagcatttcttataaggcaggtctagtgcgatgaactctgtcagcttttgtttgtctggaaatgtctttatctcatctttatttctgaagaacaactttttttttttttccctctgatggcacctctgactccttgatattgtattatttgtttctcagagaagtaaagcaattttttttttgagacggagtctcgctctgttgcccaggcaggagtgcagtggcatgttcttggctcactgcaatctctgcctcccgggttctagcgattctcctgcctccgcctcccaagtagctgggactacaggcgcccgccaccacgcccagctaatttttgtatttttagtagagatggggtttcactgtgttagccaggatagtcttcgatctcctgacctcatgatccacccacctcagcctcctaaagtgctgggattacaggcatgaaccactgtgcccagcaacaactttcttatgtataatattcttggctggcagtttttgtctattagcactttgactatatcatctcattccctcctgatctgcaaggtttctgctgagaaatccactgattgccttggtggtggtggtaatggtggtgtgtatgtgtgttgcgggtttccttgtattataggttgcttttctcctgctgctttcaaaatttcctctttgcctttgatttttcagaattcaattataatgtgtttcagtgtaattttctttgacttgagcttttgagcttcatgaatctagatgtctgtatttctttcaagatttgagagattctcaggcaacagacattcatttacgtgagctaggtatttcttctattctcctgttgggaccttggtaatgcacatgctcattcatttaatgctgcatcggagcttctgtatgcttttgtcgtttttaattcacttttctctttagtttctctaactggataattttaaacgatgtgtgtttgagttccctgatgctttcttctgcataactgagtttcctattgaagctattaattttttttttcagttgtcagtgtattcttcagtttcaagatttctgtttggttctttagagtttctattcctttattaaactgtttgttttgttcatgtattgttttcctaatttttgttgagtttcctgatttttgtttctgggttctcttgagtctcattgagcttctttaggatgattatctttaatgccatcagtcatttcatgtatctccattcctttgtgatcagtcataagggctttattggtttacttcggtgatgtgttatataactgtaaaccgaatacatggaaaaataaaaaaaaaacaatagaaaaataattagaattagcaagagcgtttaacaggttttctagatagaatacccatataggggaatcatgttcctgtttatatgccagcaaatagccactagaaaatgtaattttaaaaagttactaaaataatttattcaggaaaagttcattagtgcatggagccattaggtgaaaggttgataaaaggtgaactctacacacagaagagaccaggctgtcactgccttgatgcactagttaatcttagcctctttaagagtgagaaaaccaaggaccaggcacagtggctcatgcctgtaatcccagcactttgggaggctgaggcgggtgggtcacttgaggccaggagtttgagaccagcttggcccacatggtgaaaccccttctctactaaaaatacaaaaattagccaggtgtggtgttgcatgcctgtaatcctagctacttgggaggctgagacaccagaatggcttgaacccaagaggtggaggttgcagtcagccaacattgcgccactgcactccagcctgggcaacagagtgagaccctgtctcaaaaaaaaaaaaaaaaaaaaaaagagtaagaaaaccagacattatattatatgctgtcagatgtgaggcaatgtcagttatacaacaccattaattattatttttacctaaaaatgaaaattgaatatattcaagtctttaaagctaatattcagtatcaaaacaaacaaaaagcaagagatatagagaaacaagttgaatttcatcatgaagaagcaaacatacaatccagaatgtgagtcgttgtatggaataattgatttcctttttaaaaaaatcactggcattcaaaaagggtacattggaggaggtaagagacttttctctagattagtagggatttgaaggatctgacaataagcacaatgtatgggcgttttttgtattttgattcaaataaagtagccgtaagaaataaactttgattcaaatggggaaatttgaatatggactatatattatactgatattgaggaattgttaattttgttacaatttacgttgttaaacatgctcttttttggagatgcatcaggaagcatgtataagggtataatgacatgatatctggaattttaaatgatggcaaaacgtataatgtacatagaaataaaatatatacacattttttatggaggaaaatataatgctttgttagccttttaaggagacctaaacaaatagataaacacactgaccagttttcaacctaacgatagtgcaaaagtgatacacgttcagtaaaaccacactttgaattttgatcttttcctgtgctattggtatgtaatatgatactctcttgtgatgctggacagtggcagtgagccacagatcccagttagccacacaaccaggagagtaaacaactgctactttccagattaggtgttttaaatgcattttggacttaggatattttcaacttatggtgggtttattgggatatagcccaatggtaagttgaggagcatctgtagtatgttaatgaattgaaagatccaaaagcatgaagtttttcccaaactgacattgcttcaatgtgattggaatcaaaatcccagaggctgctgttgggttttttgttgctgtagttggttggttggtttggtggaacttgacgggctagttctgaaatttctatgagaagcgtaaagcgccaagaacagccaagagagttttgaagaagaaaaaggtagggagccttgccttgctaattactttttgtaaaggtatagtaattaaggtggtatagatctggcacagaaatatacaaacatagccacaaaacaggtacacatgcatatagaaactttgtacacaccagaagtggcaatgcatgtaaatattcctgggaaaattcattataaatacatgtaaaaaatgaaatattattatgttataccaaaccccccaaaatggaagtatgtttttacctcataacatatgcaacctcggtttcagatggattaatgactgcaacgtgaaagacaaagttaacgtcgttttaggggaatatctttatgaactttgatggacaagattttgtggaaatgtcacaaaattgtatattataaaggagaagattgatacatttgaaacaattaaaagttttaggctggacatggtgactcatgcctgtaatcccaacactgggaggcagaggccagtggattgcttgagtccaggagttcaagaccagcataggcaacatagtgaaacctcatctctactacaaattagctgggtgtggtggcatgtgcctgtaattccagctgttcaggaggctgaggtgggagaatcacctgagcctggggggtcaaggctgcagtgagcggagattgtgccactgcacactagccttggcgactgagtgagatcccatctcggaagaaaaataaaattgaattctatcgatgaaaagatgtaaagaaatcatagactagaagaaaatacttacataacatataacggataaagtattattatctataatgtataaagaatacctataagtcattaagaaaaagatatgttaatttaaaaagtggagaaagacacaaatagctatttcacagaagtggaaacaggaatggccaaatactgtatgataagatattcagcctaggtggttagaaacatgcattgtaaaactataatgaggtactattttttttctaccctattggaaacatttagaaagtcagtaccatgtattaatggatgtggagaggtataatggccaacagttgtgcacagctagcaagagtataaattaatatagcttcttggaaaataaaataaaataaggtgtacctactgtatttcctagcaattcagttcctaggcctataccttagagatattcctgcccaggtatatcagagtgcacctagcagcattatttaaaatggcaagaagatggaaacaatgcaattgtcatcttctggggagtagattaaagtaattgccatatattatttcatacctcagtgaaagtggagaagattaaaagatacattacactctgaatggtctaagtctcgaaacctattgaaagggaataatattgaatatcattctgtactaaaaagaaaaatgaataattatttatctttataaagctcaaaaacatgtaaactataaatgaacagttcatatatatatatgtagcaaaacaataataaaagcaaagggattttaaacataaattttgagatataggttgttcttattaatggaggatagaccaatagtagagagagacacaatagggagcttcagaagtaaatatgatgttccatttcttaagctaggtttatggatttttatgtcattattttcatatacatctacattatatacagtgtattgaatgtttgaaatatttaataatggtaaaattagagttgttttacaaagctttctttttctatcagccattctaatatttcagtgcgtcgatgtcaaaaatactgcttccgtatttccaaaatctctgacttggtttctttttagtcatttcaaatgatcccgtgcctttcttttgttttatgatttcattgttcttcgtagaatacatgctgaaatacatgttctttatgggaaaacttatttttgtaaacgaatgtgctaccattgagaggaacgaatttggaattgttgaaaaatttcgcagcatgtatttattcgttggttttcagccattccttattgtcactggtgtaagtctctagataaacatatttgtttctatacatacatatgcaaagcttgatttttctccttctgtcattaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggttagaacacaaggagaatctgaaaggatcgggtgaagacatttgatccgtaatcgcatgttgtttttctcttcatctttatcctcctcttttttctctttctaaccctgcttgctgccttcctctcagaccaactgtttagcaatgaaggaatggctttaagtagaaaatgcaagttttattccacagctttatgaggacacctcagcataggagaaagttcatcttgcttcaagttgatcacacttaattggtaagttcaatgacagtttaatgagtgggttatattaggcttcagggttgtcagtatacctctttgccagttccattcattaaaatggattgctaatcttggtttgtgtctttcttccttttttctattcttcctttctcttttccttctacctctctaacctccctctatctttccttcctttcctctttttaaatattcagtttagtaagaatattttacagtcatacagaatgtgacatataaactgtattttttcacttcagtggagtgataattgatgcctaaacctaattattcacagattaattaaaccaggctcaacaacagcagtagcagctaccatattataagtgccagttaggtcctcagtatttgaaactaggctctggtcattcattttgttctaaccttcacagtaatccaagtggagcaggtggtattgtatacattttgcaccgggggaaatagattcagagacattgtgttacttacgtaaatgcacacagcttctaaatggctcagccatgattttaactgggacttcctgaatctgtagactgtcctctttgtcttgatcataatgcttcagaatgaaggtgtagattatagggaagaataccataaatgtgctggagtctctgaaagccatgctaagactaagccactgccagattgtttttctctagttaacaatttctaattgggtctgatactgtgtatatgccgcaattacaatctttactggagagatttggagggtttactatgtagaagccattctgaggctttacaacaaattcttttaacatatgaagaagactctactttttacttctttttctcattcctcttttatgtaacttttactgattatgtttatagaaaaagtataaatttcctcaaatgcaccaaattttgcaaaaagcagcatgcccgtttttcctcatccttgccaataacagttaatattggcagttttctcatctttctgttcttcctccttttttttttttttaacaaaatacaaatctgatgagtggtaaatatttcattctgtgttaatttatatttctctgattaccaatgacattgttttttcaagtcttgaattttcttttgcttgttaatgtaatttaaatctctcttccattgttaggttttcctcccatggattttttgcttagtttatccacattttgagagtatatatttacacataaatacttttaagttgttctgtgctttcatatttttgcctttactttttaattcattttgtggtatttgtgtggtgaggatattttttctttattgctaacaacttcacaagaatgtttatagggaattatttcattgctcacaaacttgaattgatgtctttatatttcatgaaattaatgatgagtctgtttctaggatttcagtttaacctcccttcttgaactatggccacattgttgtttaattctagaaagtatttattttatgataaggcaagcctctctttatgttagcactttaactgtttcatttgtctttcttaccctgctcatcatttaatgttttctattagcagtctctctctataaaccaaagatactcttctaatcttctctcagttgttataacaccaaaagtgctttcatatgtaatctcttatttcctttttatataaactaaaagataaataagatagattatattatttatattttacctatagggaaaactaatttagagtggatgactggcttccccaaggtgtctaagtaaatgatagataccaaagttatgaaaaagatagctgatggccatgtgcaaattacacagagatgtaattcattcaaataccgtgaaaagagcactggactacaagttaggatacttaggatctgatctcagttcttttactaactactcagttacttaagtatatttctgtttgtttatttatttatttacttatttgacagacagtcttactctgtcacctaggccggagtgcagttgtgtgatcctcctgtctcagcctcccaagtagctgggactgcaggcttgtaattttttaattttttgtagagacaaagtctcactatgttgccttaggctgttctcgaactcctggctccacacgaacctcctgcatcagcctcccaaagtgctaggactataggcgtgagccactgtgcctggccctatggatcatatttagagattgcaatctgggtgttaggggtactccccaccactgcgttgtcatttacaacaacataatgaagaaatacagccggccatcgtggcttatgctaatcctagcgactcgggaggtgagatgaaggatcacttgagaccagagttcaagaccagcctgagcaacatagaccctgcctctaaaaaaatttaagaaattagcctggcaggatggtgtacacgtacggtcccagctactgtagaggctgagactggagaattgctttatcccaggagttcagggttgcagtgagctgtgattgtgccactatactccagcgtatgtgacagggcaaggccctgtctctaaaataaattaaatgaaaataaaagaagttaggaattcttggagaagttactcattccaggattagagcaagaaatgtacaagacaaacctaaattagtggttctcaaacttgtgtgcgttggagttacatggagggctattagaaaagtagattgctgtctcctgtccctaggggttttgattcagtaagtttggggaaagccccatgaatttgcattctaataagttcctgggtgatgataaaattcctggaccaggaaccacattttgaaaaatcactgcgctatagcatcatgcgatatgaaaaattaagaacctatcaaagactactggggtcatataaggatggacagaggagcaagaatgaaggggctatcactggcctaggatagacagtttgagcataagaaagactaatgagcacagttgtttaaaacaaagtatttttaaatccggaaacttcattgtgagactataaaaataatttggagattgctgggacaccagtgccctaacactgggatttactttttaaaattccaatggtagtaggggaaacattggccattttttgatagtttattgaagctgagtggtggtgacatggggtgtatgatattatctttcctatacttttgcatgtttgaaattgtccctaataaaatgctggaaaagaaagatatcacttaaccacttgaaactttcgtatctgtaaaatgagtcttaagacagataagacttcactcttagactttagtgtgtctttcagttctaaactagctttttaaccatatttgcgtagccctggagtggagcctgtgactctgggttcatttcttagccaagctccttatttgtgttttccctttacttgagaaatattttccgtattttccaagtaactcttttttcatatctttgcttgaatttcatggagttggtttcttctgtttttaaactgaaggtcatatagctttggtcgtatacctttgcttttgtctaaaaattataaattttaattaacatactagaaaaattaatccataatatatatttgtttatatccctctacattttcttttaaactttaattttacttatttgtaatactaatatatatacactcttccgtattttgctttttaaaaactttatatcatttaaacatttccatgagttatgtgtttcataatgatgcttgtacttactattttcagttgaatccagagttcagtagctttatacacgttcctctttttctggacatttcttaattttcaattttcacagagcaaatttgtacagataaattgtacccaatttggtgatttcctttggctattcctcagagcaaacttactcaaagtatatgaagtgttgtagcttttcttaaatttttgttaccaaagatgaactaatttatagtacttccagcagtttgcaggcattctgttttccctatagccactttggttctatttaattttttgctcattttacatataatggcgtcttcaagttgttatatttcatttcttcagtgacactgtccgtttttcacatgtaatgatctattatctgaaatttccgtgtcaaattttaattacatttgctacctatcatgaaaatcttttcatatcacctcctttgaattgatatgttatgaattacattgaggaatgatgattgttacatattttttctttttcagtcatttttcttttgaaatttattagattttgttgtttaaacatcttttcaaaaaaatcttttaaattgcttatcttgtcctttcaaggcaattttttcacttaatatccatttgcaacagagtcaagcatactagtttcttttagttctttagctgtgtgtatgtgtttgtttcttgtaaatgttcattgctttaatgcatgtggaatttatttaacttaacttacaaaacatagatttaaagtactctttctttaccctgatacccagttctcctggtagcacttagtaaataggtattctttaaaaaaattttaaatctacctaatcatatgctacataatcacacagaagtttccatttcattctagattcattgttttgtctttaatccaattttttgcatttcttcttcttctttttttttttttttttttttttttttgtgatggagtctcttgccctgtccccaaggctggagtgcagtggtgtgatctcggtttgctgcaaccttcacctcctgggttcaagtgattctcctgcctcagcctcccgagaagctgggattacacacctggctaatttttttgaatttttagtagagtcggggtttcaccattttggccaggctggtctggaactcctgacctcaggtgattcagccacctcggcctcccaaagtgctgggattataggcgtaagcccagcctttttgcatttcttttgccctttgtttacaaagtcagtaggtcatcttcaacgtcattaactttatctcaaaactttttttctaggtaaatttatcagttttttcaacaacctttgaaacatcatttgagtgtctttagtttgttaaattatactaataacttaaagaatattatcacttgtaatttatttagtcatctccagccaggaactaaattcattcctctttattcctatttatgtttattatttatcatgttaaaaaagatttaaggaatataaaatattttctaaagaaagctaatatccagattacaaccaaattattaaagatttgtggtagataatagagaagaaaaaggcaaatgaaacttcaagccataaaaagatgaaaaaagtattagcaaatgctctttattgtattcacctataaaataacctttcttcttatgaaaacggagtcaaattccttacagagctcctgtctctaaaggttgtgagcattaatgagatgatacatgtaaaagcttctataagagcaaatgttaacaggattggactaggtagtagtaacataacaggtacagtgggtcctccatatccataggttctgcatttttggattcagccaacggtggattgacaatattatggaaaaaaacaccaataaaacagaataatacaacaataaaaaataaatagaaaataatatagtgtaacagctatttacatagtgtttacattgtattgggtattagaagaaatcgaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccaggcgcggtggcgggcgcctgtagtcccagctactcgggaggctgaggcaggagaatggcgtgaacccgggaagcggagcttgcagtgagctgagattgcgccactgcagtccgcagtccggcctgggcgacagagcgagactccgtctcaaaaaaaaaaaaagaaaaaaaaaaaagaaatcgagagatgatttaaaatatatgcgaagatgtgcatagattatctgcaaatacgacagcattttatatcagggacttgcgcatctgtggattttcatattccaggggagtgttagaaccaatccccagaagatactgaggtgctatgtagggatgtaatgaaacgtgagagatactgaggtgctatgtagggatgtaatgaaacgtgagagatactgaggtgctatgtagggatgtaatgaaacgtgagagatactgaggtcctactgtagggatgtaatgaaacgtgagagatgctataattttcttgtaaaaggaggcactcacttcattaggagagaacttttaatttttccggtaggattttgtgagaaatttgcctcgtgttacttcatttagagcagtggttctcaagtaaggctcagttttggcgctaaggaatctttggcactgtctggggacatttgcaacttgaggggtgctaccggcatctagtgagtagagtgctgggtgctgctaaacgtcctgtagttctccggatagcccccacggcaaagaatttctcggcccacactgcaaatagtgctgaagtttgaaaccacgtttagaaacactttgaatgccagttctttatccgaagtgttactgtggatgaagttttcatgaatagctttggaaacctaatacgtatggccatatttatatttttttctatgtagagctaagaccaaagctgttaagttaaaactctgtagtggcagtgccacagtacccagtaatatcgcctaggtacatagttttctggtaccgtactctaatttgatgtgaaataatgctaggagagttgtggtgagtgagtaatttacataacatacacaataaccatcattctcgggcacataattccagattgaagttaatataccacgtgattgaagtattctgtattattgttaatgaagacttggtactctagaagtatttaataattgtcacacaatcgtaatcgaatgactggttatatttttggtgtgtcatagaatagtagaatagcaattaattatgtcttcttattttaatcatttttatcacaatgttttgtgttttaaatttctggctatttaggtgatctcttgatgttttcatgaaataggagaagtaaagggaaacactactaccttatttctgttttttgaaggaattattttagtatttctacgttaagtataataattctagtattaaaatattcattaagtgttttgtacttaatggtttgtttgtttgtttgtttgtttgtttgtttgtttgtttttaagacagggtcttgctctatgacccaggcaggagtgcagtggtgtgatctcagctcactgcagcctccttctaccggattcaagtgattctcatgcctcagccacccgagtagctgggattccaggcgtgtgccaccatgcctggctaattttgtgtgtctgtttttattagagacggggtttcaccatgttggccaggctggtcctagcatcatgtgatctgcctgcctcggcctctacaagtgctgggattacaggtgtgaaccagcacacctggccttatacttaatgttttgaatagtttatgtttaatctttatcagatgccgttttgatattcaaaggtcagttttgctagttacgttaaaaagcacgtagtaaatttattttatttgtgaagattaacacttgacctgcagggttcattttcactttttgttattcagcgactgccacttgtgatgttaagttcatcactggcttcactgttccaggtagaagttacagtttgccagagagcagtagtactacttttctattttttctcttttttaactctgaaaaataaaatacatttttaaagtatgcacatgcacatgtagatgtgccgtgtaaagaatacttataacatgatcatctcgagaaattggagtattgttggcatcccagaaatcatatgtgtatttctttgctatcatttttctcttctgttcctctagagattactattctgacttttcttcttctttgcttttctttatgacctgcacatatatcaaaaagtataatttagttttgtatattttgtacttcaataaatggaattactgtatttattcttttgtcacttcttttgttgatcattatttgtgagattcatttgtattagttatatgtagcatccattcctttattgtccttgtactgtgtttatttaattcagaattccacatttatattgaaagtgctctgaaaagatgattcatttcttttcaattttccattctttgaatacttcagatagtaccaaaagtaattccttttggcagaaagtgagtttagaagtaagtggttactttgctttttgtttttggttcaacacattaaaaatgttctgattggattaaacactgtcttacatgtgaaatgaaaatgatacctgaaaaactaagagaatctgaggatcccagagattctaaacacttttttgtcatttatcatggccttagatatgaatactcttccttacgatgtcatggtgccactcagttgtatcctatttctacctttgtgttttggacagttaattactgtgatttatagtaacttatctcatactttttggtctcagaagcctctttgcatttaaacattattaaagttcccaaagtgatttttttttctttttttaaatagagactgagtcttaactatgttgcccaggctggtctcgaactcctggcctcaagtgatgctctcaccttggcctcccagggtgctgggattataggcgtgagccactgcaccaggcctcaaagtgatttttttatatgggttatatatgatatacatgtgcagatcttttgacccagctatcccatgtcgtagatttatatgcatatacatgtccaaaaatataaaaatacatatgtacaaggtgacttataacattattcgtaattgcaaaattttgaaaacctaattgcctataggtgggagagtgcttaaattcaccatggtgaatctacacaaaggagactggcagttttaaaaaagaaatgaaacgtgagcaaaagaaaaaaaaaagatagtattttaatcgtgaatgaaatacatatccatgagtttatgctgatataaataagtaatcaaatacataaataaatggcatatggacagacggctctttctcatagaagaatttcagttaataagtatagatggaaatagaccaaaagaaaatcaccatgagacaaactgatggttgtgaaagttagtgtgtgaaagtttgaggttaaacatggctttcatagtctcaaaatgttttctctaaggtgtttatttattttaacagaagactaacttttcagtgaagaaacctaccaggacaccttaacaaagtgtttagagttaacattaccagtaataaagagacattgacctcatgaaccccttgatacaaggcactgagagggacacaatatcatttctgtgttattctttccaaaaatgtgtagcctcattccagtaatgagaaaatgccagacaaatgcaaattctgggacattttacgacataactgagcagtacactttaaatatgtcaagatgatgaaagacaaggaaagactgagcagttacagatgtattcgaggggaaatgtcagctaaatgaattgtgggatcttggattaaagcagatttcaggaaaaggaacagaaaattagctgggtatagtggtgcatacctatagtcccagctacttgggaggctgaagagggaggatcacttgagcccaggagtttgaggttgcagtgagcccaggagtttgaggttgcagtgagcccaggagtttgaggttgcagtgagcccaggagtttgaggttgcagtgagcccaggagtttgaggttgcagtaagccctgtttgcgccactgcgcttcagcctgcaagacagagtgagaccctgtctcaaaaaaagaaaaaaaaaatccggaaagaaaggacattggtggaaaaacaatgaaaggacattggtggaaaaacaatgaaagtaaggttctcaggttggtaaatagcattgtaccagtgttaatttcccagttttgatcatcttactatggttatgtaaaccataaacattacaggagcctgtataaggagcagatgggcactgttctgtttttgcagcttttctgtatgttcataattaattcagaataaaagttttatttaacaaatgtattgacactatatttctcagcacttttaatcacccagttcactttgccatctctttgaaataagtatgctttggaatttaaaaatgtcttactaccaaaattaacataacaggttagttagctcaggcatttttcctgaatttaggaatgcagatattatgttctcatattgttgacttcgtaaacccgtagtttaattaggaatgtagctgatcaggccgggcacggtggctcatgcctgtaatcccagtactttgggaggctgaggtgggtggatcacctgaggtcaggagttcaagaccagcatgaccaacatggagaaaccccatctccactaaaaatagaaaagtagccgggtgtggtggcacatgcctgtaatcccagctactcaggaggctgaggcaggagaatcgcttgaacctgggaggtggaggttgcggtgagccgagatcatgcaactgcactctagcctgggcaacaacagcaaaactgcatctcaaaaaaataaaaataaaaaggatgtagctaatcaagttgatcgttctaaagattagactcaaatcctcaagccatgatgatgtaatatggctattatcagtagagttatacctagacctagagatgaaccttgacctgtctgtatccttcaagtatagaaggtttaattttactcatttttaaacatacttgagatgtctttcattttttcaatataaatttatcgaatgctttctaagtgtcaggcactgttgctaatctttggttatacagcagtgaaaagacatgttctccgcccttctggaacattgtctcatggaaaaacaataaaactaaacaaataagtaaatatcaatcagggtaagtactacaaagaaataaacaggacactgtgatagatgatgggggagggaaatattttgggcaacaaatttaggtagtgacatcagaggagtcctcccaaaggatattgagatctgaaaaagccttataaaaagtggagaagacaaaaaattgaggttacccatatggcagtgaaaagcttggcattttcaaagtagagaataggtaagggtcaggtcaaaagggaccttataggccatgaaaagaagtttagattttacaagtagtgaaacagtctacgtgaaaagttgacaggatctgattcgcattttcaggatactgttttttgcaatatctggaggatgattggagtgggacaagagtcatacaaaagtgtttgctcactgtttcatacctttgtgtgctgtgcagttttctatgctagaaacagtaatgttgcacgagacaaacaagcttctttctcttaagaagctcacattctggtaagggctctgtgagaattgaggagagaggtttttatttatatttaaaaaaaaatttttggagacagactcgctctgtcactcaggctgcagtgcagtggcatgatcatagttcactgcagcctcaaactcctggacttaagcgattctcctgcctcagcctctggagtatctgggactataggggtgtgccaccacacctggctaattttttttttcttcttattttaagtagagactgagtcttgctgtgttgcccagtctggacttgaactcctggcctcaagcagtccttctgccttagcctccaaaatgcatggattatactttacattacttattataactttttatttctgctggctgtcaaaagatgtgttataatacaagtacaataatttcaattatagtaattgctatacgcagaactgaaattaggtaaattccagcaacagcaagaacctttcaaataaaacatatagaagcatagtcttagctgatttggctgttggtgaattggggattaaaaaaagctttctcttgaaagcctacccatcttttaagggtcagatgctttttcttgcgaagctgcctaaatcctcgcagttggaattaatcataccttctgttgtaatttcattagtttgtttctgcattgatttggggattattttatattactttgtattatatgctaattgtgtgctggttcttctgcatacttgagcttggggaccatgtcttggtattttacatatagttggtacttcataaatgcttattgattttaattgtatctatagatgtcaagaacgttctgtcacatgcatcttagcctggtctcttagtctatttgggctgctatagcgaaatactgtaaactggctagcttataaacaacagaaatttatttctcacagttctgtgcctggaaagtccaagatcaaggaaccagcagatttggtgtctggtacaggtccactttctggttcataggtagcaccttcttgttgtgtcctcacatggtggaaggggcaaggcagctctctgcagcctcttttataagggcatttaatgccattcatgagggctctgctctcatgacctaatgacctcccaaaagctccacctcctaataccatcacattggtgattagatttcaacgtttgaattttgggagcacacaaaattcagattctgattctgatctgatctgattcagatcattgcacctggcatttggagcctcctattaaagcaagctctgttttaacctcatcttgaggtcagatgcttggcttctctgttttacacaagctgacagtgttggtttctttgaatataacacgttgttttcctaatgtatgctcttctacttctgcagaatctttttcctgtggatttccagttttactacataaagattctgccttcaaattaacttttgttgatgaactctgcctggacttgttattgccttatccattgttccttagcctgaatgtttaatcatgctttattgtttacatacttttcaatacattgttttataattgcccctgtgtgatttaacccatttaattttcccttctcagctagtttatatctgccataagtgaagaattactttaaaatttctttttagtttttcttaaacactgttttgcataggttcattaattatagctgtacttattgagttataaataataaaatttaatttagttataatttttttggaactgaatgatattccattcagcatcctaataaatattctctaaaattctgtaggctatcctttaagagccttgtatgttttaacacaggaaatgccatcttcccttagttgagaatattaattctttgagcagtgacactcagatacacctttcagcaaggctgtaagttttagtcacgtcctaataatgcaaagtagagtggactgaaaggaggctcctatcaatagtggtttggggctttgttttcctttataacaaagataagtatctgaatttaaccttgaaagaggttgttgtgagagagattaatggaatgctgtggtgctgtgagacagctctcccgaaaccaatgaatattaagaataaagttcaaagaaagtgaaaacaatggaaatagagccggggaaaatcagctttacatatatttaagcatattctcttcttagatatatagtcaatgaaacatttgtgtttttctctgtaatttgatttaactctgtctacaaaaacagtttcttcattttgataagagattttttttcctttctgagaatgaacactacttatccttcatttttagatttgccagggggataattatttaagaaagccttttataaacattaagattgacatctttttaggaatactatttctagaaatagtatgtgatttgtcacatgctggatacatctaatatattaatgttcctgtttttgcaaaaataaattttgatttcctgtttctagaacttttccttcacctatttaaatgtttaatcctgtatcatttcttcctttttaataaaaattttttcttagtaaaacagggctttttctatatagaatattgtcgtaggtgagtttttatggtgttcttaatgaatattagagtaacggatcacaatggaaaagtgtgcatataaatcagcatctgtttttacatccctgtggatagttgctgaaattacgcatgaaaattctcttttactgcaggtgaagcacctacacaaattgttggttatgtgtgcagcttttaaaaactcctatctcaaactgggccactttttaccatttagaaagaaagcaaaaacacggcttaacattactttttaaaattctgcagtgtttgaaatggactctgtagtacttttccctctggccacatgtcagttcaatttaatagcagtgaaatttattgaaagactttattgataggactaatgtgctctccataaaatgatgaataaaattacattaggcactaaaattattaaaaactggactactaagttctcactttagtgaaatgaatggtttactcctttcctttgtgttgtgtgagctcttcttggtttgcatttggaaggaaaagtctccaatgagattcttttttttcttaaattttatttttaattataatggatacataatagttatacatatttacgaggtacacatgatgttttgatacaagcatgtaatgtgtaatgatcagatctgggtaattagggtactcatcccctcaagcatttatcatttctctgtgttaggaacgttataattctattcttttaggtattttaacatgtacaacaaagtgttgttagttatagttgccttattatgccactgaatgctaatcctgttattttttaagagaacagaagcaggtatgcaaatagtccattttctaagacctcagaagcaaaggtcagcctcttatgggccacatcagttgtctgttattttaaggaaaagatatttttgggattttttggtaaagactttgaaaaggtatgcttgttctttttataagcattacagatcaaagatttatagtgtcctaggattaggtaaactccatgtccttgcccaagtttctcatactcagctaccatgattttcaagatgagacccttcccagtctgtatgggatatttgtactctatgctctgtaaaatttattgatataaagcatcatttttatatgtgtacttttctgtttatttaatgaaatacatctgcttttgttttgactttggtttttaacaattggggttataacagagcaccactcttaactgaggggagacatttgaggtgttttaaggagaaggagggagagaatatttttaaattttaacccacagtattgccttaaagtagttggtgtgtaaccaaattctgtctctgtgttgtgctagctttcacttcatcagtgcatctggcttcaatttttttccccacaaagcatctgagaagttggtaaatgaattctgacatgttgaatgattttaatgaaatcttctggatgtgtatatatgcttaggggatggggaagagggaggcagaataagcagtggggttgaaggtaacaaagaattactgtctctttacgttaaggataatggataacagttaacattaatatctttcagaacaggttaaagtctgtctggtaagtggtgtttacttccaaggaagcagctcttattattaattcaaataaatgacttccattaccgtgtcagaatgagagctgggagagggaggagagaatgtgggagattgttactttggataatctttgtgaaatctgaattggccttctttctgctgcagaaaaaggcaaaagcttagggagatctaccatcatcaagtagctcttttttatgtgactatactgtagggccttgttaacaatttttgagggagatgtttgagggaacaacaaattaaattttaattgcagtttctcctctgcctttgcttttctgattgaatgtttgattggaaagaaaggcagctagctgggtgtggtggctcacacctgtaatcccagcactttgggaagccgaggcgggcagatcacctgaggtcaggagttcgagactagcctgaccaacatgtagaaaccttatctctatgaaaaatacaaaattcgccaggcgtggtggtgcatgcctgtaatcccagctactctggaggccgaggcaggagaattgcttgaacccaggaggtggaggttgtggtgagccgagatcacgccattgcactccagcctgggcaacaagagggaaactgcatctcaaagaaaaaaaaaggcagtggagggtagagtcttacagctcagtgatgtgtagcttggtgttgacagagctgacatcaagaagtaaagttctgagagatgtattgggagtggtatcatgggagttgctatagagtccagtctctccctgttaatctgcctgagtgaagctatagttaggctgtcccaacttctgccctagtctctttgaatataggagtcttcttctttaaggagatgagggattctttgaaaggtcttccttcttctccctctaccagacccctcaaagtagtcacacaaacctcctgccgtgaaccctgtactctgtgagtgaagtattcgtatttgatttcagcaaatatgtgaggctggcaaaagtaggcttcagttacataatccaatggtaggaaaaatggtctgggttcgttttggtgagtgcaaatgtggttaatagcagttgaagtaaaactctaaagatactgctttcattttaggtgatatgaactatttaaaatgataaagcatgttcctttgctatctctagatagctattaagtgagatgtctgtgacacacagtacatttctaaattttgggttgcctgaattgtttaagcagagtaaaatagccaagttagggcaggtgcatggaataaaactctctctctacttagtcttattcccctaggctgccaatttaatgcttttttctaattagtgagtgctataaaatggcttatctccaaacagtacctgtgttaatggcaaaaaccacaattactttggcaccaacctaataattcccctttgtaatttttttaaattttatttttattttattttatatatttttttgagccaaagtcttactccctctcccaggctggagtgtggtggcatagtcttggctcactgcaaccaccgcctccccggttcaggcaattctccctgcctcagcctcccgagtggctgggattaccggtgtgcatcaccacccaggataatttttgtatttttagtagagatgtggtttcaccatgttggccaggctggtcttgaactcctgacctcaggtgatccacccaccttggcttcccaaagtgctgggattacaagcttaatttttaattgacaaataataatcgtacgtatgtatggtgatgtttgaatacatgtatacattgtggaatgatcaaatcaggctaattaacatatccatcacctcacatacttgtcatttctttgtggtgagaacatctcaaatccactttttttttttttttaatactttaagttctgggtttcatgtgcagaatgtgcagttttgttacataggtatacatgtgccatggtgagttgctgcacccatcaacctgtcacctacattagctattttctcctaatgttatccctcccccagccccaaacccccccaacaggccccagtgtgtgatgttctcctccctgtgtccatgtgttctgattgttcaactcccacttatgagtgagaacatgcggtgtttggttttctgttcttgtgttagtttgctgagaattagggtttccagcttcatccatgtccctgcaaaggacatgagcttatccttctttatggctgcatagtattccatggtatatatgtgccacatttgcttaatccagtctatcgctgatggacatttaggttggttccaagtcgttgctattgtgaaccgtgccacaataaacattcgtgtgcatgtatctttattatagaatgatttataatcctttggggtatatacccagtaatgggattgccgggtcaaatggtatttctagttctagatccttgaggaatcaccacactgtcttccacaatggttgaactaatttacactcccaccaacagtataaaagcattcctgtttttccacaacctcttcagcatctgttgcttcctggcctttttttttttttttttttttttttttttgagacggagtctcattctgttgcccaggctggagtgcagtggcgtgatctcggctcactgcaagttctgcctcccgggttcacgccattctcctgcctcagcctcccgagtagctgggactacaggcacccaccaccactcctggctaatttttttttgtatttttttttagtagagacggggtttcaccatgttagccaggatggtctcaatctcctgacctcgtgatccgcccacctcaacctcccaaagtgctgggattacaggcgtgagtttaatgatcgccattctaacaggtgtgagatggtatctcattgtggttttgatttgcatttctctaatgaccagtgatgatgagcatttttcaagtctgttggctacataaatgtctccttttgagaagtgtctgttcatatcctttgcccattttttgatggggtttgcttttttcttgtaaatttgtttaagttctttgtagattctggatattagccctttgtcagatggatagattgcaaaaattttctcccattctgtaggttgcctgttcactctgatgaaatctacttctttaaaaacaattttgaaatacacagttgtaatttaaaattagactctgtttttgcctttttttttttttataactttttcccttgtctactttaagactagaagcagttataatgaaaattcatgaggaaacaggagtttaaagagggtctttattcagtgggggccaatagactctgagtatttcgttctcagactaaaaaaaaaaaaaaaaagttgattccccaaacagtcaaatgtgaggattcactcaaatgtgatgactaagcttattgataaacctccattgtatatctcttaaaacatttgcccaattttttttcagctgaactttgatgattggcctatcactgagtattcttggtgttgaactatttatgaatacgttggattactctaatttataatcatagtcacaagaaaatattttattagagttcaaatcacttgcagagtttattctgaataattcctgacataatgcatatcttgctggtttcacattcagtgaaatgctgagccatatctcaattctgtagtctccataatatctgcctttatattttaggtatgtttgggttccattttaatatagtctcataccaacagctgtgtttttataattgaggtcctgttagcctaaaaggcatttttcttggagaagaaattttgtcttcattgataatccagttttgttatactggagctacatcctcaggttctataatacccatccttcagtttgactccaagtcatccttacctcctggcgttcatgcccttgtgtagtcctctcccgcaccctgtcaggattggtctgtatgaaccgtacaagaaggcagaagtgatggcgccggcttctgaagctacatcacaaaagatactgatgcaactgccttgcactcctgaatcacttgccctggtgagagccagcctccgtgttgtaatgacactcaagcagcccggtggagaggaacagaggcctcttgccactagctgcaccaccttgccagccatgtaagtggaagcaaaggactgaatcctggttgacatcttgactaccacctcataagagaccctggcaccagaactgtttagctaagctgcttttgagttcttgacccacacaaactgtgtgagataatcagtattcactgttttcttaagctgctaagtttcgaagtaactcattaatacaacaatgaacaatgattacagatattttatatttttagtattaaggtgatctaccatagtctgatttttcccctctaaatccacagtttggttttctctgttagagtaataaatgctattttaaattgttttattcatattatcaccatggtaattatcagggttgggtaacattggagcttttgttggtgtttattacctatataactcatatttgtctgctgacagcctgtaagctgggaaaagagttacaaatgtatgtaaaacatgatgtgtcatatagccttttatagatttatttcctatgtaaaaaactgctctaactagtgccacattctccagtagaaatacaatgtgagccacacgtataattttgaattttctaatagtctcattaaaaaaactaaaaggaaacattaattttaataatgttttctttaatcaaatatatccaaaatattatttcaacatataatcaatatgaaaattattaaagaagtgttgtacctcctttttttaagactaagtttttgaaatttaggtgtgtttatagcacatctcagtttggactagccacgtttaatcacccagtagctagttgttgctagtggcttctgcattggacagtacaaatagtatattagctaaagaagaatattttcttctaagctagcggcagattaagaatgcctataaacaacaggtatgattttctcaaattaagtgtggcatgtcctatcttaatctctagctacatttagttccagtaagtcaacttcctaatttccagatgcttcagatccttcaaacctaaggaatatagggataggaggaattagggatagtacatagtatatgtagatttcttcagcattacagactcagaatggctcttactgtctcatagtttatcatgaaggttggtgaatatggactttttgaaggagaaaatgtactttagcatgtaaagcatgtattccaagcctcaggctacacatggtagaatcactcttacacttgggccaccaggaagcactttccaggggttttagcacatccccttacttcatcgatgtggtcctcagagcagaagtatgtgaagtctgttgcatttcatgattctcaagtctaatatgacatcttattggctcactcactttcaaggaagctggtgacaactgtcacttcttcaactcaaagtctggcattgacagattagagatttttaaatcttcagaatcttcaggatttatggaagaacttactgtgataatattgtcccttttaaaaaatgttgttatttagaacatcccatggttatcaaaagacttgaaaggaatttcttatcataattctgacccacttctgtaaaatattgccgtgaagaaattcataggacttttgaataaaaagctgaagagcacaatgatgtataatccatacatgttttgttctctttacctttcttttttctgatcatgagcactgcctgaagatgtgtttgcctggtctgcttttctcttttcacagtaaacagttaacttacatatttagatatcagttatctaaacaatgacacttgtaactatttccagaaggtctttagatccctattgatttcttcatagtgcaagatactcttttaacatatttttcaattttcttttgattttatatcagaactatgtattttatattatttacacaaataatacttacatgtcttagaataatagtcacttctcttattcttttctaactctgattcctcttcctctgagatgaccactttcatctcttttggttgtttctactgttgtttatttttatctttccaaatgacattcttatattattgttgtattatttttcttatttgggcgttgtctgttgacatcttatcatagatgatgaggaattagtgtttttacacaaaccaacacacacacttacttctttctgtccttccaatataattatatctaggtctacatttttaaaactgaggcacgtagtatattatgatttacattttggtctttcctagggtaccttagttttcctttttgtttttcctgtcttgggtatctctttctttctttctttttttttttttttttttttgagacggagtctcactctgttacccaggctggagtgcaatggcatgatcttggctcactgcaacctccacctcctggttcaagtgattctcctgcctcaacctcctgagtagctgggattacaggcgcccgccacaacgcccagctaatttttttgtattttcagtagagacggggtttcaccatgttggtcaggctggtctcaaactcctgacctcgtgatccacccgccttggcctcccaaagtgctgggattgcaggcgtgagccaccacgccctgctttcttgggtatctattcccagattcctttctacacccataaaattcctcctgatatcattgctactataaaaacacatcatcccttactaattgcccttggataatccatacatctgctgtttttcttggaaacattcatttcctttctctgctgtagtgtgtagttagtctctaggttgtgtcatgcttgtggttcccttcaccactcacctatggtagagctcttttttctggatcccacatcttctttccaggtttacctcttcattttcatagagtataccgtagtagcttcctgagagagtcgttgagtgagatacttttttggggggattttgcattcaactcccatatttgattggtagtttagatacagaattctagattggtaatcatttgttttcccttagagttttgaaaccattactcaaattgtcttctactttcctgtgttgcctttaaaaactccagtgtcttctgatttgttgatctgacaagtgatcatttttggcctttctaaaagttttcaagatgttttctttcctctagtgttctaaactttacagaaagagtattcatattatcatctaagcaccaaatgatggatttaatctttttgcaagagcgaggacaagaaagagtgattataaatattacctagcagtgctgttgatactctggtatttgtaggactcaagggctttcctgtttatttcttacagtggctcaacattttattaaattaaataggagattcaagctgtggttcaacacaagagaaacttcttggtttattttagcagagctctcaaaattccaaaactaaaactagtgccagattttacccactcgatagattaagtaattctggactttgtaaatgaaggtgagagagatatttgccgtcttctttctcttgtattttactatcctagtttgatacagttgcgttagagcaaatgcttccatacttagctttacatcgaaatgttatgtgacttataatatcacgtaaatattacttatcagccatttccttttatttgtagtttcacttggcttttgtttttcatccttattatcgagaaagattttgaaccaggctttgtcattaattccagaaatcttttttaaataaggctgtgaacactgagctcatggagtacactctggtttcactgccggcttcaggtaaagtcatgacatgagttttataatgaaacactatgaaacttgattctctgcattgtgacagattactaatcattttctccctaaaagttttttattgatacagccacaaagctatttttgccccacgcagatgtacaagtgaagttgtttgcttgaaatagattcctgggaagttatttggaattaactgtttgagcctcaattttagataatagaagcctctcaggagacttgcaaaaaacagtttaagagtgggataggatagaccgcacaaagacataatactgagttttccgtaagttgctaatgagaaacgttatcaactttatgtattaataatgtttctttatgcttctttatacttacagcaatctgtattttagaatcccacattactccaaaatagtcattctcattcattagagggtttgagaagactgaactaatcattgcatccatctcttagttcgtaatccttcttttatgtttagttttctttgattctgaagaaaccaccttggcctttgttttgacgggcatcgttccttgtctctgcgcgcggcgtccctttaaaaccctccactgtactgtgctgctcatggcaagtcaacagagggaaggaagagctcaacaaacaacgtttgttttcttttgttttgttttgttttgttttgtttgatacagataaactgccctacataaaacagaacctcacttatgggaatagatcacagtattttataactgtggagaaacacagttctctgagaagaatgaaaacttgtaacatgaacatcacgtacagcaccaaaatgtgaatttttttctaaatctcattttttaaaatttagaaaaacgagagaggaaaagatttatcaactgttcattaagaagaatgttaaataatagatgctgttcttccaaagtggggagaaaaatctgacttaactttgacagatttcaagttctagatttttgaaggtacagttgtcaaaaaggacttacaaaagtgggctgtggtataattgagtttcttagataaaataaaaaattcttggatatcttttcctgatatgagtactctgaaaattggagaatggtttagcaaatcttgctcttttgttttatgtatttttaaaaggaagcactttattcttaatcctctagtttcataagaagttaaagaaggaagtgcctataataacctgatgactgcagttctccatcccacttgaactcttcttcatgttgtcttcttaagatctctcctatcttacatgaactcagcgttctgtagggttttgtttgactttctgatagatcaacattcacctctccggaagctgtgttttaaacttgtgtagaacatcagggctgggaattgcttagttggctgataaaattgctcattcttagccagaccggtcacttatatccagttgtcatttttggttttctcctatgagattatgagaaaaccatacattcttgaaatactaggatgcatcacttgcttttcaatgtcttttaagaaatcgtttgctgacaattgtctatgaagaatatcatctgaaagatgatgctgcttactgcactttttcatgtaggcttaactgcagggaaagagtgttttgatattcggtcgaattactatctcatcaaagctggctttatgcttagagagtagttcaaaaacaactttgtgcttttaagtaatcaagcccttgccacctctgctgtctaacacagttttgttctctctgttacagagagcaaatttctcacatttgtcttgcttaactaacttgagcctttgctgttaatgatatacttcttcagcctccttctttcctttccttgctttctttattgtgtcctctgtgacgatatcttgttgacctggatttgcttctgatggaaagaacatttaataagcaaacagccctttcttaataaataggctctccctgggttaagtaattaatccacttcacctagtcttccatcattttctaggacagtctccgtaagaaggatgacaggattgaagagctggaagaagcactaagagaaagtgtacagataactgcagagcgggaaatggtgctagcacaagaggaatcagccaggaccaatgctgaaaaacaggtctgctattttatacagttccaagcaatgctgctggttaaccaaaaggtaacacacaaccagtatagtttaggtaaactatacatattgtatgtttatagggtttcaaaaacacttcatagaggagaagtcccaaggagttccttcatagcggtattagatacaaggatgtggtttcttttgtgtcaagtatagaaagaaagaccaactttattagcaaagctgagagagaattgatgaacattttgcagaatgagtgcctttcagtgccctgttcctagataaatgccttgtctactctttcttaaataagaattgaaataaagttgtatgagaattgactcatgttaacacagaagtccctgcattaataacttaggtctgatcccatatatatttatgtagcatgtgctaatgtattggacgagatgaaatggagcttgtctgtctgctacaagactgggcacaaccctggcttttaaacggaaagaaaaaacatgaacgtttctcttttttttcttttattattattaatttttttgagacaaaatcttgctcttgtcccccaggctggagtgcgatggtgtgatctcagctcactgcaacctctgcctcccgggttcaagtgattctcctgcctcaacctcccgagtagctgggattacaggtgcctgccagcacgcccagctaatttttgtatttttagtaaagttggggtttcaccatgttggccaggctggtctcgaactcctgacctcaggtgatccacctgccccggcttcccaaagtgctgggattacaggcgtgagccactgtgcccggccaaaaaaaaaaagatacaaacatttctgactgaaaaacgttaatttcaaatagctaatattttattcatttcataccctgcctcattgaagagaagagttaaggttgtaacaagttaaggttaacagtgagtatgaaggacatagaaaccatgcacttgagtcccagataagcagcctcggagggacttgctgaagagttctgctgtggcagtttgtgatgcttgttttacatatatcctgcatcttttaagatctccagactcttgcttttgacttttcattaggaagaataactacagatgggaaaagtgaatggaagaaatagttttaacaagtgaaggttataatcccagctcccattatgagaatgtgatttaagatttcaaacctaggccgagcgcggtggttcacgcctgtaatcccagcactttgggaggccgaggcgggcggatcacttgaggtcaggagatcgagaccatcctggctaacacggtgaaaccccgtctctactaaaaatacaaaaaattagctgggcgtggtggcgggcgcctgtagtcccagctactcgggaggctgaggcaggagaatggcgtgaacctgggaggcggagcttgcagtgagccgagatcgcaccactgcactccagcctgggcgacagagcgagactctgtctcaaacaaaaaaaaaaagatttcaaatctatctgacacagaggttcataacacttaattttgcagtagttgtttcctttccatttctttgtgggagaaatataaatgttaaacaggaaaaaaatactcaatgagagggtggcaggaatctttctaggaaccccttggtcagaccaaggtgttattttgagttaaggtagctatagtaaagaagggtatgtttccaaggcagacatagtatgtgccccagggagtcccttcatagctgtgtgagatagaaagatatggtttcttttgtgtcaagtatagaaaaaaagaccaacctcattggcaaagctgagagagaatgaactttttgcagaatgagtgcctttcagtgccctgttcctagataaataccttgtctactctttcttcaaatacattcctaatgcacagtcacatagagcttggttagtggagagcttcagagaagggatggtgacagccattgtgtcacccaagggtggagagtaatttcctttaatcttgattttaccctttttatattctctcctttatttttcaaagaaagatttttcttctgctttggcctcattatttattgacaagtattaaacatcagagatcatgcagagattttggcaattaataatcatgtcattatgggatacagacttctgttatgtattttcctttttgaggctattgtgtgaactgattataatatgctttaggggtatgttttatttatggttaatagacttcgcagtttttaggtttgcagaaaaattgagcagaaagtgcaaagagcttccatttacgcctttctctgcctcagtttcccctattattaacatgttgcgccagtgtagtatttgttaaaattaatgaaccagttttaatacattgttattaactgtgtggtccatagttgagggttcacttttcgtgacgcacagtcccgtgagttttgccaaatgtataatgacatgcatctgccattacagtattatacagagtagttgcactgcccttaaagtatcatgccccaccgatttattccttccccgtctccccagtccgtgatctttttactgcctctgtagttttgccgttttctttattggtagttggagtcatatagtatgtagcatgttcagattggcttctttcactcagcatctgcatttaaggttcttctttttgtggcttgatagctcatttctctttatctctgaatgatattccattgtatggatatgccgcagtttgttcattccttcagctgttgaaggacgtcttggtaccattcagtttttggcacttaggaacaaagctgctgtaaacattcacatgcagactttggtgtggatataagttttcagctcatttgggtaaataactgtgagtgtgattgctggattctgtggtaagatcatatggtaggagttttggaaaaagctgccaaacagtctcccaaagtggctgtatgtattttgcttttaattgtatgcttttttccttttctgttttcttgtccacctttctgctactcactgcctatctgaagctgttgcgtgaaatattgcatgagaccagttatttgaactttaagtggttcaaggtatgaagaaattgcttttatgtttatacttctgaagccttacaaccttcatctactgtcctctcctctcccattttttattattatttttatcgtttcctgtctttttttttttttttttttttttttttttttgagatggagtcttgctctgtcgcccgggctggagtgtaatggcatgatctcagctcactgcaacctctgcctccagggttcaagccattctcctgcctcagcctcccaagtagctggggctacaagcatgtgccaccacgcccagctaatttttgtatttttagtagagacggggtttcaccatgttggccaggctggtctcgaactcctgacctcaagtgatccgcccgcctcggcctctgaaagtgctgggattacaggtgtaagtcaccgtgcctggcccatcttttcctgtcttttagctctactattaattttacttatgtacgttaattatatgtactgagataatctacaaatgttcttttgaaatgccttaaatgaggcttttttgtttaggaacattatctttctcagattcaaaagttacctgtttctcacttaaatttagcttctgggaaagaatgactttttctgataaaggtaggatatctacatctcttaattcctccaagagcaaagtaaaattgtatgggagccatagctcttattaaaataagatgtagaaccttccaaagttcgagcaaggaagaactcccataagaaaacatctcttgatgccttttctttattctcacgggatccccttacagtttatttattcctaatacatgctgccccacgctgagcccatgctagaaatttagagaagttgtgtaatgacctaatgaaggaaggtgccccctaacctgtgtgagcaaattggaagatggaagtgaatgatccccacaggggagaacccaacagctcctttacttttgctttgtccctttccacgtggggattctatttctggaagctttctctgtttaacttttggtgggttttgtgctttattgaatgtgagtgtcacttttcttaaacaaggtctcctaaacaagtctcagaattgccaggggctaaggagcagtatgcttagttcagctatgatgttatgaaatttaaatttttgaattttaacattttaaaagagtgatttaaatatcttcactgggccgggatacagtggctcatgcctgtgatcccagcactttgggaggcagacgctggaggattgcttgaagccaagagttagagaccaacctgtacgacaatgcgaggcctcgtctctacaagaaaataaaaattaattagccgggcatgagggggtatgcctatattcccagctacttgagggactgaggtgagaggatcacctgagcctaggagtttgaggctgcagtgagccatgattgtaccactgcatcccagtctgggcaacagagtgagaccctgtctttaaaaataataataataacaacatatttgcacatatgaatttggttgttcttttaaaagccccatttttaacagtgatattcagtgataaacagtaatattttttcaaattgccattttgacattatttggcttataaagtataaattcttgatgttcaaggttataggattatatctgtggtttgctaggtaatgatacattaatgagcatttttaaggattacatatttttttgttgttgttaatgtataaagttcttcattggctgaaaatctcctctgtcatttatgcaacagttatcaccagaatacccaagttcattttcagaatgaacagttgccactacagaagcaaaactggtagaggggtatgtctgtagaagataatgtacactaatagaactataattgtattccttcgtctttcttattgccttttttacttttagcaatttattctttacttttataaacataattctttactggtctgaatattaagttatatttccctcattgtttattaaatggcagtgttgctctgaaaataaaattatactttcacttgtacctttttccctgctaacatttaaaaaaatcttgtgcttttccaaatgccacattaagcactgaaaatgaaaaggtaatagatacagcctctgtcttcaagaagcttgtagtttattgggaaagactgaaggatgaacttacaattatggttctgtttgacaactaccatggtagaggtcttaatacagagctttaggaacagaggaagaggggcaagcctgaaatccagatttgggaggtctgcagaaggcttcccggaggagattctatgtgtgaattaaaaaattagccaggtgtggtggcgggtacctgtagtcacagctactcgggaggctgaggcaggagaatggcgtgaatctgggaggcagagtttgcagtgagctgagatcgtgccactgcactccagcctgggcgacagagcgagactccatataaaaaagaaagaaagaaagaactaggcaaagaaatggaagatgttcaacatgttccatgtagagggagcagaagtgaaagctagaagcgtctaggaaaccaagttgtggttagtagctacagttgagtgtaaataggaatggcaagaactatgtaaagaagagaaaaagatgagagagtaagggagatcctttgtacaggtgtgcacagtcagatcatgctgaatgaagcatgttcaagcttatgttcaaggaagtagagaacctttgaacaaagaacaatagttattattagtttacttgctcatttattcattcaacagatctttataacttattcagtgggtgctgttgtagtcctggacaatacatactgataaacaaagtagctgtaatttcatgcctgagaccttacagttcagatagggacacagacactaacccaacagataacatttaattgctagttatgacaaaggaacaggttttcagaaatacacaataatttcttgaaagttggagggttagcagctattttagattaagtgctcagagagggtcctctgtgaaagcggctttgtcctgggccttgaaggctaagaagcttaccatgtgacaagtgggacagaagcagcaatcataatggtaataaggtggagaagagctgaacgtgtctaaggaagactaatatgactggcgggcaagaacagtgcaagctatgcagggccttttatataaggccattccataagaggaatggaagccattaaagagttttaaagagggcgtgacatcatctgattgatgtttttaaaagatcattctgggtgttgggtggaggatgaattagaggggggtaagattgaaagcgggaggatcagatggactattaaagtagcctaggctggatgtcttctaactgaggtatgcacacacctgaaagtgcatgaacactttcccaaaaggcacatgggcacaggctctcagcctctaaacatacgtatccctgaaattgatctgctcaaaaggcacctaaggtgtgcagattctcctttttcattttccccttcacggttctgcacccctcacttgacaactctcctgactcttactatcctctattcctcagaggtgaaaaaactttggaatgttaacaaagggacaattcagcatattggtgttaagataatggatgagtccgtcaggttgttttcaacagaattgaaataaaacctaattaagttgccagttggtagattatgataaataattttcgatgacacgttactatctggtttggggtatgtaattctgaaggaatgcaaagagttgagttatattgctacaacaaaactccttccattcctatccatttatatgatgaaggtttcttagtgcttacatctatagaagtgaaacataccgatagaattgatgctgaacccttatcttcctttttttttgagatggagtctcacttcttcacccacactggagtgcagcggtgggatcttggctcactgcaacctccacctcccgggttcaagcgattcttgggcctcagcctcccaagtagctgggactaaaggtgcccaccaccacgcctggctaatttttttgcatttttattagagacgaggtttcgtcatgttggccaggctggtctcaatcctgacctcaggtgacccacccgcctctgcctcccaaagtgctgggattacaggcgtgagccactgtgcccggtctgaacctttatctttctattaatagtaatattaacaaggggtatctaaactaataaaagtataaaagtcccattaatctcattaagataatatgtttaataagatacattttaattaaaatgtattcatgtttaataataattttcttataatatttaatatatctattggttttgattgatactatataactagtgattctaatcataactcagtgcacaagaattcttaagggttatgaccacaggaaaatattaaaatatcaaatttaaatttatataaatatttttattgagaaaagtacaagacaggatctgtgcaagccatctagcacaaagtaaattacattagtataaaattctaaggagaagtagaatggaaacaaggtcaaagagaaaaaggaaaatgtaaataataatttgtccttaacggtttttgaatagatgatgatggatatcaagtatggtatttgtattttattggatacttccttttctttaaaaaagtgatgcttttttaaaaaacagtctttaatacccaagaaattagatctttgcaactctttaaattttcgacgtaaaacatttatatatcaagttaaaatcattctgtctcagtatgtttgtgagcagaaaaaaagaagtataaaaagatacattttaaaaatcatagttgtataaactcttttaggaggtatagaagcaaaaatgtgtagagagacttttggtctatgcaagaggttgggcagatcaggcaatagctgaagagattccacagtgacagtggagataaagagaaatagatagatttaaaacgtcttttggaaatagagctaaaaggatttggtgaattacatgtatggataaaggatagaagagaaaacaaagatggccattggatttctggttggccaactgggagaatagtggtataattttttgagatgagaaagcctgagggaaaaatttgaggataagaagcaagacatggtattaaagaaatgttagctacattatcgtcagttttagaattgttatcagatatttttattattgatttagagatgagttctcgatatgttgttcaggctggactgtagtagctatttacaggcatgattatagcacactatggcctcgaactcctgggctcaagctacctttccacatagctggcactgtatgcgtgcacaatttatatttttagccaagttttctcttctgagatccaaagttatgaaatagacaacaacccatttcatatctttacaccaatatttccttgatatctcaaccagaaactaagttcaatcttttgattctcaccttccaaccagtttttcccccaggcttgctcatctcatctgagaggacttctttgtaatcttacaaagctgaaagtaggcttactgaatgtgagggaagtcgagtctgagagaggcagaagtgataggttaggtacagaaatttttacactgtggctttccagttcaaaaggtcgttccagaaccttagggaagctgtattccataatggcgaagaaggtggactctggagttagaaaccttggttggaattaggctcccatcacttagaaattatgaccttgggcaagttacttgtgggtcagttccccgagctgtaaaagaaatagttactacatctgccacattaaagagatggtatctgtataaagcacctttaacagattctgacacgtggtaaagccatagtaaacatctaccactattggtacttctgttgtcaccaccactgccctctgtggttccaaggggaggcactgctctcactggttggctgaaggccccagagaaatgtcgtatttatagaccctgtctggttgattcagcaccagcagtgacaaacttactgttaaattctaatttacatatgtcaagtgttaatactgtgactcaaggaaattcttgtcctctccccaatctggtctcatattctagaagttgtagatttgcatcaactgagaataacacagtcacctaatatgttgatcagatggacattattcttatcaccagattatttattctctgagagtctgtcttagatcaatacaggttcttaatctgtacattatttcctattttacatccatggtcttctcataaaaagagtttgagtaggccgggcgctgtggcttatacctgtaatcccagcactttgggaggctgaggcaggtggatgacgaggtcaagagttcaagaccagcctggccaagatggtgaagccccatctctactaaaaatacaaaaattagctgggcgcagtgctaggtgcccataatcccagctacttgggaggctgaagcaggagaattgcttgaacccgggcagcagaggttgcagtgagctgagatcatgccactgcactctagcctcagtgatagagtgagactccgtctaaaaaaaaaaaaaaaaaaaaaaaaaaccttgagtagctttagtaaactgctagaaatatatgctataaaatccagttctaatgctgtctttcagttttactaagccagatgttctatagtttccagaaggaagggagggaggggaaaaatactttcttagcattatttgaaactaagcattggttttagaacgttatccttagatgttattcctagaagcaggaagatacggaaattttaaaaccgtaaaaatattttaagggtttagtctttgtaatcttaaattggaatttgaaacatttgtttaaatttatgacttttttctcttaaacagtcacacatgcatttcctatgtactgcaaatacctagaaaacaaatcatcttcttagtagcaatgctcactcgtagtggtcagatacggtttctaaatactattcaatattagaaggacttgaaatctaaacaaaagttacttttttggcataaagtgaatattataagtatacatttttcttcacaagtgcttattggcttctgaaacctctgtagtctttatagcagcactgtcaaatagaacttgctaaaacagtggtaatgttttatgtctgttctaccaagatggtagcctctagccacgtttctgttgaacacttaaaatttggctagagcacctgaaaaactgatattttgcttttatttaattttaagtaaattttaatggccatatctgcctagtggctactatattggacagttcaactctatagtatgttggacagatgggtgggtggatggatggatggatggtcggtcagtcagatggacagacagatagatacatggatatctatctatctacatatacatagttagtagatactagttagtttttcctcctaagcctgacagagttgtgacactaggatattcaaatacaagcattttctgatatagttggtcattttttaaatttttgtttttggaaaaacatttgtgacataaaaccatgtttgtcaaaagtaatttttcctttaagaaataatggtggaagactagatcactttcaagggatattataattgcatgtgagtgttttcttccacattcgtgtggtagcatcatgtagatgcttaaagttatgacgtgagtgatggaattagtggaggaaaaaggagtggaatagttacagaaatgagagtcatctacattagatgtccatagtgagaacatgccaccccagcattgttaaaagtttatgtatcatccattcatttcgctgttcattcattgtttatctagatcctcctatgtgctagaaactgagaatactttactgaaccaaatgagtatggtccttttcctcatggagcttatatgttagtaggggagattgatcacagaaataaacatatactttaaaatttgatccatgcaaataaaaaaagtatagtattttataaaagtgtgtaacaggggaccttatttagagtgaatggtcagggaaagcatctcgtctattttattttattttattttatttatttatttatttatttatttattgagacagagtcttgctctgttgcccaggctggagtgcagtggtgcggtcttggcttgctgcaacctccatctcccaggttcaagcaattcttctgcttcagcctcccaggtagctgggattacaggcatgcatcaccacacccggctaatgtttgtatttttagtagagatgggattccagcatgtttttcaggctggtctcgaacttctgaacttgtgatccgcacaccttgacctcccaaggtgctaggattacaggcatgagccaccgtgcctagctggagggcatctcttaacacattgatacttaaattgagaaatgaaaatgaaaagtaagtaggaattagtgaaattaagaatggcaggtagtttacttcagcaggaaccacgtgtgtggagaccctaatgatggaaatagtttggcatagttcggaaatcaaaagaaaaccagagttcgtggagtgtactaagtcaaagtgagccggtagctctatggatagtaggtgagtgattgaataaatgagtgaatgaatggatggtgtggcatgaaactggagaggtaggcagaaaccagaatatataggatagtcatgttaatgattttaggttttatctcaaccacagtggttatcttttaagtaattttaagcagaagagcggtaagacttatttcctgttttaaaaagagtattccaggctgggcacagtggctcatacctgtaatgccagcactttgggaggctgaggcaggtcgatcacctgaggtcaggagtttgagaccagcctggccaacatggtgaaaccttgtctctactaaaaataccaaatttagctgggcgtggtggtgcacgcctgtagtcccagctactcaggaggctgaggcaggagaatcacttgagcccaggaggcagaggttgcagtgagtccagattgcgccatctcaaaaatagagtattccagcaattatatgaagaataaataggagagtaagggtagaaagggctgaggacatgttaggaaaacatataatccaaggacatgtagggtgatggcaaaggagatggagaggtctatttggagataaactcagcaagatttgctggtcaattgcatgttgatgatgagggagaggagagggaagtggcaaggttgatttctacgcttcttatcacgaggatctttaagtggatggttgtcttattccatttagtgttgctataaaggaattacctaaggctgggtaatttataaagaaaaggagtttatttggccatggttctacaaactgtacaaggagcatgatgcccgcatctgcttctggtgagggtctcaggcttccacttgtgtcagaaggcagagtaccttttattcttaatacaaactacaattcttgtagatttactgacacttactgattacctactgtctgccagtcactctggtacattctttctttataatattattcagttgttaaacaacagattctcagatatatgtaatgttttctaggtcgaaaacaagtgccagttcttgttgggtcctttttcagaagagtaaagaagggcttacatgtcttaaactacatgttccttctgagtgaagcaatctcttcaaccttaccttattcccttgtctggaaaaatcctacttcttccataaaaccttttctgaccttccaagtctgagttacatgtctctctcatgtttttgtttttctttttctttttctttttttttttttgagatggagtctctctctgttgcccaggctggagtgcagtggcgtgatctcggctcactgcaacctccgcctcccaggttcaagcaattatccctgcctcagcctcccaagtagctgggattacaggcgcccgccaccatgcccagctaattttttgttatttttagtagagacggggtttcgctatgttgaccaggctggtctcgaactcctgacctcaggtgatctgcccacctcagcctcccaaatgctgggattactggcgtgagccactgtgcccagcctctcatgtttttcaactgcacttgtacttagtcctgttttttttttttaataacactgcattattattacgtatttactacctattgctttaagagactgtctccattttgtctcctagaatgaaagctccttgagggcaggagctgtgtcttatttactgttgtatcctcagcgtctaccattgcacctggtacacaatggcattcaatgaatatttactaagtaattaaattatgagcgaataaatgaaattttgtcctgacttaatgtttgcagcatcactgtacttactaaacaatttaggatttaatggtaattttatcatatttttatacttatctaaacagtgttttgaaatgttttctttgttgcaattgcgtttccactggatttgataaactactttttcatctgaacagaagaacttaaaggtgtcagaattgtagatttaaagaattagaatagatatttatgtgaaagttatttacatttttgtgcttgattttaaagaatggtagccagagtggaaaaatacaatttagaaatcattattatccctgacctgtccttcagtggcaaaacagagggcttatatgtctcaaaaagtgaatgtgcaaaattgtaggcccactgttgttgacctcttagctagtgggaactagctgaaagtcttatgtagcagtgagccttccactcggaagtaccaggccaccatgtttatgaaaacatgtaataattcaaaacattctgcagagcaggtataaactgattagaatcatttgaaaatctttttgatcctactttatttccttttagtgggactgatgcttctgatcatcactggtaaatttgacattaggtttttcaagatttgcctcatctttcccggacttggaaataggttcataatattattaagactgattcatttcatatagtgctgtaatgggttacatttaatagtttacagaaatctcttcttaacatatcctaaattcattttctttgcttgctcttataagtcttaactgatttctgtgagacattcttgaaatgagtagctaagcagtccaaaagtgttacagatacaaacgttattcagaactatgtagaatcattctgtcttacaaaaaaaatagagtgttacgttggtaacataaacggtgcttgtaaagcagtttactggtttctgcagaagttcatcatgtttggtcaatgcacagattgtagatactgttgttcaaagatacttcatttttaaaatgtaagatgttattatggaacatgatattgataagcatatagaaagtatatttttaatgtttcaggtacctaagagatatgacagttcacgatcatcttctctttgccgttgtgtaatcagttcagtctttcaatcaaattctgtcaagaggaacctcgtaggtttcactgtagactctcgctctgctgtcaaggagtttgaatcccctttgttatggtggctggttatgaaatcagtcacttgacagaccctgaagtgagactgctggaaatacgtcatgtctgccttcatggtgacagctggttacaaaacaaaccccaccacagccattctgcaattgacaagggacttcaaaagccaacagggctgccacttcaaagagaattctgccatctctggcttgttgaaagaagttgttaaatggctgtaccctgccctaccagaaatctccatgtttagacttctccttcttttgatctttgaaagatgtatgaaatgacttaagttagaggaatgataaagtctctagtaatggcaacccagcactctgcattttgatccatttattaatggaaattacccagatatgttctaatgacaggaggtttaaaaactcaatgtctcagagaatgaatgtccaaaaaaagagttgaaatttcatagtattgttgtagccaccttaaaaaatctggaaatagtagggaagaaaatgaaactcagtgtgtttttaaaaccttccatttcttcgtgtaatttttagcccttttaatggaatcagattctgaatattgatagattagaaaacaacacaaatctttaatcataagattaaatttcatggttaaaacggacatttctccacttttagtaactctgtacttaaagtttgaagctaccttgtactatatttaaagttatattcatccctttctgctgaatacaattttaaaataattaccttgtgtttatcttaaacaataaaaaaagccttagagttttaatagaacccttaataaaaggtcagagtgctaacaatcaagggaaaaggcagcaacatgaactctttcttttagaatacggatagccctaaaagatggagtaatgtttagtatacttgaaaaagaaagcagaaaactttataaataatataacagtaaaaaaaaagtggagattttatactcaacatgaacttggagtgtaaattagttggaatttaaaatccttctaagtgaatggcatgaccttttcctaattgtatgttttctctctcatcctatgtgtataggaagataaagctaaagatctttagattcatttgccctgatctcctattttcttatttctcttaaaatatctctttacataaaatttttagaaatcgagttgacagaagctttaacgactgtaacttcctctataattttaccagatggggtcagtagataactactaaagaaattctgaagcagaactgaagcccccaggaaataaccccatgacatagtatgaccaaaaaattctctagaaacatgagtagtcgctcttcaagtaatgcatttggatttgtctttttttgttgttgttatcttagtttcttcctctagaaaaacctccagaaaatttttttgacaaagtagtacatgatattactgtcctggaagtccaggaaatatctatgcctttaaatttaggctcgagttttcattttattcagcaaaaggactgtatctgtgttttcaaaagttagagcgatgtgaaaaaattaagtccagtggaaacaaacctttggcacatccaaaattaaaccccagaaatgactgccagaagtctatggatactggttttcaaagcagacttttttttttttttaattttattttattttatttatttatttttttttgagacggagtctcgctctgtcgcccaggccggactgcggactgcagtggtgcaatctcggctcactgcaacctccgcgtcccgggttcaagcaattcttctgcctcagcttcccaagtagctgggactacaggcgtgcgccaccatgcccagctaatttttgtatttttagtaaagacgaggtttcaccatgttggccaggctggtctcgaactcctgacctcatgatccaccctcctcagcctcccaaagtcctgggatgacagatgtgagccaccgtgcccgaccagacatgtttttataccctatactctatctaaactgcagagcaacttctgtagcaggaagcactcttggagtctatgtggtggatctataccaagggatatatcgttcgcttgtaatgagttcttggggtgtttggctcttatttcttttctcctactgagaagtttgataaaccaagttattgatcatagaagcagtcatccaagatacggctgaaagtaaagccttgggagccagatggcttcccgctgatttttatatgcagtttatattctccttggctgtgtcttcctggatgtttcaatgaaagatatttttttctggagaaatgtgcacggtgggatttatcctattcaacagatagtttttgtgtgtgtcatgtcccaagccctatttggacattcaattgtcccttcctcttgtctctaccctctttaataaatgaataaagatgcattaaaattaatgtaaagtgcttcggattagaagtcaagtgacgtggattctaatccttgttctgtgtactaacagtgatttggcataagttttgtaatctctccaagtatctgtaatctcacctagatggaagaaattattatccccacaagtatccactcaccacctcacattgagataagtatttgcaagggttttagtcgcttacaaaggcagcatacaagtgttgagccttattatggccaaaatcacacacacacaccagacatgcgcaaacatacacgtatcatatatgcacatacatacacatattatacacgcacttacgtgatgtttatgagtttccctcttggtgtcctagggttaccagacataaaatcccatccttttacttttctcccttggctaatagtatacttttgataaggtcaagtaagtgtcattttatttgccaacattgtgtttctaacaactgtccagggttgtgttgaaataaattttctccacaaaatgtgtgtctaattaatgaaatgtcaactttatttatttctaggtggcagtttggtttttttcaccattgcaaatgagaagaattaaaatttccagttaaaatggcagtgaacttttatttttgttaaaaacttaaggaaagtgtttgagtctgttttactcacattatttcatttgatcttagaagaagggctgaatccctacatggtctgttttgtttgctgttttccgaataaaatgcaataaatattttctccatttgagatgatcagattatttaaactaagaaggaaatttctttccaaaacctggacaaattatatagccattcaacacttgctttattctattgtgttaactccctagcaaagcaaaaaaaaaatgccttttcagaagagaaattatcagagctcagagttctagggatggtctttgtcattccacctctattcatatttcatttcctaaattagacatttgtcacaaaccctaatgaaatattaagagctctcagacccagatgcagaagaaagcataaaatggtggttgccacatcttctttgttactactgctggaggaagaaaatgcaatctattacttagattatttctgtcctcccttcttccaggagcttatgtgtacccagtagatcattaattttttgtgttaattgattccattacaatctgttgctgaaataagcaaatcttgggagataaataatattttgctgtcaaagcatgatgtaggctgacttaaaaatagaaaaaatgaaataatattctgctgaaaagatagtttgttttcagggcattaattcaggtatttattttttagttttgatgctgtgctgtcaaagtcacctaaatagaattggcagtgatgaaacactggcccgtcttagcctctttctaacatcagtgacgcaagatactgagggtcatagcagcagggggatgtttgctttgaaaatgtgcatccacattttattgtgtcttatttttcaaaccctacttaggagtgatgagtgcttattacgggatttatcttcctaagccttctgagttgattttttttttaaataaaaggaaaattgagatggcttgaaaaagaagcatttctttcacactgatacgtttccactctcttttaaaaagagtgggaatgggaacactccccagagtgactcatgagataccattgtgggtgattttggtaaacactgatacatggtagcaaagcagcgctcagtgtgtacagcaggatggagtcggactactcagcttggaatcctagctttgctttctctgtatgacctcggacaaggcacttaaacccactaaccctgtttcttttgccataaaaatgaggataataatactttatacccaccatataggatcattttgaggctttaatgagacaatacatctaaagcacttagaacagtgtacttcaaagtagacaaataatgtaagtaattattattgcaataactatagttattccatagttataaaatactgtactgccggtatatatcttgtcaaagaattaccatgagttggcaaaaagaacgtattggaaaaaagagatttctagtgtaaatgatagcctaaagctctcttgggaaatgtaaattcaaattttcattagcaatagttgtgagatcctctaaaggaatttcctaggaaaggatgatagaatttatgtatgtaggtatatgtgtatatatgttttcactaatacttcaaaaatgctcctccactcaagagcttgttacctttttttcttcataattataaaacagtaggttttaatctggaactttgttctagtcagggaaaccagtggacttctcaagtgacaatctggcttgcatggtgactgctgaacctctggataatctttttgtaccactccctttttcttctaattgttttcttcttgtggagacttacgccttttactctcccaagagagtataacaagattttccatacgcatcttggaaactacaaaaagtgtttttctcctggttgtggaacagaagaaggtgggaaacttgaagaagcgggctttgccagcctctgaagccccctgttgtgctgctttcttaaggaaaataggtctgtggtaaagtcataatttgttcccttcttattctgagcaaaagtttattagcttgtgatttaagcaaaccatctggtcctgctggcactgcacactgtcaggccccgtgctttctgcttattatgttactgaaggcagttacatatttgagtcccagctctggcctgagcttttctgtgttttaaaacgtctgcttttgaaaattgtgctgtgacctggagtatatttttaaagtgtggataaattcttcattgtttagtataggatttatctcttcttttcttctactcatcggtctttaccctcgtttctctggctgtacccaatactgtacaactgctcagtggtaggcatgaaatggaaccaagtgattctagctggaagtgttctcctggattgtggaaacatagcagaaaatgaagtaattaaatttgactttgaaactgtttccctggcttagagccagagagcaaatcagatgattgattggaaataccaggaatgtatggtaccattcttgccttgaatactaaaatgctttagaacttacttggatatatgtataatctgaggcagaaatactttgagggtctcacactcaaatggatgggaaaattaagcaatctttaagaaaatgattttactaacagataaaaatctgaaaggtagagatttttaaattttttaacaatatgtaatagttgtacgtatttatggggtacatgtgatattttgatatatgtgtacaatgtgtaatgatcaaatctgggtaactggggtatccatcacttctaacatctattatttccttgtgttgcaacattccaaatcttctagctattttgaaattcacaataaatgatttaactatagtctccctactgtgctattgaacactacaacttactccttctatctaactgtatttttgtacccattaaccaacctcccttcatccccctctccctcctacccttcccagcctctggtaaccaccattctgttcactatctccatgaaatcaaatttcttctagctcccacgtgtgagtgagaacaagcaacatctgtctttccgtgcctggcttgtttcacttaacataatgttctccagttccattcatgttgctgcaaatgacaggatttcattctttttatggctgaatagtattcgtgtgtgtgtgtgtgtgtgtgtgtgtgtgtgtgtgtgtgtgtgtatacataccacattttatccattcatccactgatggacacttaggttgattccgtattttggctattgtgaacagtgccacagtaaacatgggagtgcaaatatctatttgatatactgatttcctttcttttggatatatacctagtagtgggattgctggatcatgagagagttctatttttagttgtttaaggaaacaccatactattttccatagttgctgtactaatttacattctcactaacagtgtatgagtgctctcccttctctgcatccttgccagcatttgttattttctgctttcttggtaatagccattttaactgggatgagatagtatctcattgtggggtttttttaggagtggtttgagggagagacagtgtcttgttctgttacccaggctggagcgcagtggtgtgatcatagctcactgcagctgcaaactcctgggctcaagcaaccctccagaatggccgagactacaggtgtgcactatcgtgcctggctaattttttgtagagatgaagtctcactctgtggcctaggctggcctcaaaccccttcctcctgccttggcctcctggaattacaggcatgagccaccactcccagcttcactgtggttttggtttgcgtttctttgatgattagtgatgtcaaacatttttcatataacttttggctttatttttatgtcttcttttgagaaatgtctatagagatcttttgctcatattttaatcgaatttttttttgtttgctttggaagtaagagttttgaatgaagggtaaaatgtgtccttaaacatgacagacttgatgctggggaagtaactttcacagaaacaattgaagatagtcaataaaattgcatttatatcttggcaaaaaggtaagaaattctcaggtcaggggatgaacaggtagggaattcaaaaataagtacttgataattattgaacattgggttttatatcttcataggataaaagaaaagatcaaggcagcccaagatagtcaagtgggaaaccaaatccctgtcactcttttataaaacaaatccacaaagcccaaaattcattctttgaaaacaccaagaaagtcagctggtctttggtgagactaaaagaaaaaagaaaaatggcacaatgaacaatatttattttagaatgatagagggttcacaactactagtcttgtaggtgctagaaagatataaagatatctttgccagcacatttgaaaatttagactaaatgaccaaatgccaggaaaaattgaacttagcaaagccagctaaatatgaaaaagaaaacctgagaaaaatgaggcagtaataaaaatttttcctacaaatttcaagcccagagatttatattggtaacttttggcaaatatacaaggagcaaataatttcaatcttacagacacaatttggaaatataaaagagagggaacaatcactcaacaacatatttaataaggttcacataactttatatcaaaactttacaagttaatacaggaaaagaaaagcttaggcctgtctcaatcctgaacatgtagaaaaattcctaaacataatcagaccaatccaaaattagtgtacacaaaaaagaaaaatgtgcatgagcaagttttattccaagagttcaaggttggcttaacagtagaaaactactgtaatcctggctaggcgtggttaattttttgtagagatggagtcccagcactttgggaggccaaggcaggtggatcacttgaagtcaggagttcaagaccagcctggccaacgtggcaaaaccccgtctctactaaaaacacaaaaattaaccagacgtggtggtgcatacctgtaatctcagctacttgggaagctgaggcaggagaattgcttgaactggggagatggaggttgcagtgagctgagatcactccactgcactccagcctgggcaacagggcaagactccatctcaaaaaaaaaaaaaaaaaagaaaactaattactataatccatcacagtaaaagatgatagaagaaaagttaagtgttcatctcaagaaatgcagaaaatttaacattcatttataattttcaaaaattcttaactacctagcaatacaagggaatttccttaacttaataaagggtatctattaaaaattacactacttgtagataaaacttataaaggattctttttaaagataggaataaaatagaatgcatgctatcaccatgtctgtacagcgttgtagtagtcattctagattatgcagcatggcaagtgaaagaagtgaatattataagaattacaagaaaagaaagaaaactaccatatttgtctatatagtaaacttcaaaatctgtcagtaagagcatttaagaagactgctagatacagattcaatttccgtaatctgcactgaacagaaaatttacattttttgtaaaaacgatactgtttactagaaaattaagcatataaagtacctaggaataaatattattaggatgtttaacattttaatgagaaaaattattaaactttatgaaagatattaaagttctaaaaatatatctagttcattacgtgttctagaacagtacctggcatatgataaaatctaaatatttttgcagaagttcaagaatagctaagatgctcttgaagagaacaagctgagacttattagatatcaagccttataaagtgataataattaagataatgaatgtagtattggtacaggactaggcaaaagagtggatcataatagaaagtgcagaaatatccatgcttgtgagtatacttgatatatatcaaaggttaagatagaatagatttttaaataaatggtactgcacattggctatccatatggggaaaaatgaaatcagacccctgcctcataccatatacaaaaatgaattccagatggattaaggactaaacatgaaaagcaatactttaaaactcttacaaagtttatcaatcagatattgtataacgaacaaccacaaaatatcagtagcatattgtgatggttaactttatatgttgacttgactggctacggggtgcccggatacttgctccgacagtattctgggtgtttctgtgagggtatttggggatgagactaacatttaagtcagcaaaattgagtatagtggattgccctccctgatgtgggtgggccttatccagtcagttaaaggcctgagtagaacaaaactctgatctttcccaagtgagagagaattccctctgcctgactgccttcgaactgggacattagcttttccttgcattcattcagactcagactgaaaccctggctcttcctgggtctggagcctgctcgccttcagactggagctataccattggctctcctggcttttcaagcctttggatttgggttggaactatgccactggctttcctgggtctccagcttgccagttcaccctatagatcttgtgattcatgagccagtttcttataataagtctttatttacacatatacactctgtttctctggagaattctgactaaggtacagacaataccaagcatttatttctcgttcacatacatggagggtgagcatggttggctctgagtttttttgcagaaattgacaagctgattctcaaattcacatggaaataaaaaggagccagaatagccaaaaacatcttgaaaaagacaacagctcagattttcatagagattatgttgaacctgtagatcagtatagattatggttcttatccattactgattttatgttataaaaacatagcttggtgtattatttgtacccagttttagataaaattttacatgaattaaactgataaaatggaatcaatggtatatgttcatgtaaagcttgcagatatgcaaatacatatcccagtatattacatagcaatatattctcttttttgtttgtttgtttgtttagtagagacagggttttgccatgttggccaggctagtctcgaactcctgacctcaggtgatccaccggccttggcctcccaaagtgctgagattacaggcacgagccacagcgcccggccgtaacaatatattcttatggcaactgggactgtgaggatgctgttagctgaagacatttaacttgctcacttctggaaggataaaaaaattcaggtgccaaaaaaactaaatgcatttgcttactatcattgtttaacagctgttaccaatcaacgtggaaactttgtttaggtaggaagcactaatttccaagggtcagtgaaacaactttgatttgtcatgctgatttttgactctaggtttctctgttttagtatcacacaaatggggtttatgtaggagtcaatgaatggcaaatgccccacctctacctgccctaccttctacttctgaaaagactggttattaccaagattatttcttggcaattaacaacctaacataaagtcttgtaattgatgcagttggctgtttgattacatttgcttctgaattaaaatgaacaagtttatttaaataattctgatttggtagccacctggaataagtggaaattactgataaagtacttaccttgctctcttagtttcttttccttatgttttagcattttgtctgtcttctctggtggctttttgtttgttgtttttcaggtctgttgctgtcaaggctttttttttttccccatgtcatttttaaagcattctgtctcctttctatctggtatgtacacacacacacacacacacacacacacacacacacacacacacacataactatataggtatatagggatatatttccttcctgcctatataatatatagtatatatataatatatatatatacactgcctatgtagtatataggtatatatatgcctgtatagttatataggtatatagggttatatttccttcctgccttccttaaaaaagaaaccctacctacctggatttagagcaagaaattgtctgattgaattctagcagtttctttaaaaagaaattcttcttaatgatgtaaataggaaaattttagtttagaggactaaaaattattcgtctatgtatacaggaaatctgttatttgccaagtttatgtcttttatttcctaaaatcgttctgtatatttttttatatttgtattgtattatttccatggaaatttctgggtcatttccaaagaacttccttaaaaggtattgtctgtggcagcgtgcgacttcttaaactgataacttgtatgcccttgcatgtattaagttctttctgacctaagctgaaaagaattatactgtagggatgttattatctgctatattgattcttgatatatacacacacataactgatccagaaagagtacagaattttcaatgtgttcctgcgtctcttcaattttctggacccaggagttgcgtgttacccaggtcctctgactctgattgatcaagacactctgttgttctctttcccatatttatgataggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagtaagtgtttgtagtcttattcttcaagcatatgcttagtggaaatactttttctccctgcattcatcttctggctctgtgttttaccccaatacacttacttaattttagtgctaacttgtatttctcactctctagaataaatttggtcaaaggtggaacaaatcctgatcaaatagaaatatttttggttcctctttaatgatttttaaatcctctggcttatacatatctgtgtgtaattacctctctgaaattcctaaaatcttctggaaagttcaggcaaaatggcgagcttactggggaagagggctgttggttctgaggttgtatgaagactaggcaatttttaaacacattttttattgtaaacatttccaaaggtacacacaggtagagagaatgaacccccatatacctgtctccaagattcagtagttaccattttgccacactggaagccaatttttagaaaattgtcacttttagcagagctttgctatacacattttcctgcttcccccacattttgtaggttgctgagaccataatctgttgtgaagcatgtatacatctgctaatacatagtagatgtttcttttacttctcagtgaccttctgtttaaaacaaacatgtgtcttttgaaaatccagttgtaccctctcatttaccattcctaatccttccccttacctaaagaccctactgctattttactgaaaccaggtctatcctgggatccctcagttaccctcagttaccctcgttctgtgagcagttatctttatttttgttgtcttcttttctgtctcagagaataggtttttttctccttcataaggccagattcttctttctgtcacagatttcaagtccccgcctcagcagcctttcactgtcagttctttctcacgtgacccttgctcacttcttctctgcataaatgcacagtctgtctttggcctaaaataaaattttttcactccaactagtgctttaaactgacatcagtttacttttctgctactttgaactatcagtaaactttgaatacctgaataatagagctgtacagaatcttgccataataccttagcatgaattctcatgggacatgatgattgtgatattgtgactgcaacccaagaatgttgaggtgtcctctgtgctttcacgttcttgggctatagtgcaaggctacgagattctgtccttttagaaaagcattatgagtgatatgtcttggaagtaatgtgtaagtgaagccggaagtggattggcatagggggagaattaagagaggttagagttccgagtagcatcatcagaaaaaagcttgcaggtttaagtagagaaaggaaagtcctccctgtgactgttggcaatgacactagattcttcactctgtagtcactgcaggacccaccatattttaaaggtttaaattattcaattattgatcattgaacaagtgaaaagatttagtctacctagagaacttgagaggcagaaatatgaggggaatgaagtgtgcagggagactgaaacatgcgtatgtgtgactctggagctagaataagacagagtcttccctcaggaaaaggtagttggcccatttgcatagaaaattcttcagcaaagcactagaatagctttgttttctggaataatcctgacttcatcaagccaagagaaatgatttaatagctattttccattcctagcatatattaatgtaatttttgagcgtctgttacagataaatggtgaccgtaagtttggggagacgtaaaacggttcacttggtagcctgccagtggtgcattggaaacatttgcgttggttatagccagccctggagaggaggaacgttttaattggcagatcccacaatgggtcttctcttccttatgctgtggttttgttaaccattacttttttattccacttttatgttagcgtttttcccttaagaaagaaaggataaaagggagcaggggaaaaataataaaataacaactgtaataactgtaataaattttaagtatcagttgaggtcatgaggttcactgttaagaattctagatgaactagttcattcgacactgccctgcattcaaactcctcctgcaggcccaccctacattagcattcagaataaattttacaagtccattttttatttttaataaaatttttattaagctgtgaatttgactgccctgacaactggtttgttcagggaaggggtggcagagctctttggtttcattgagagtttagagctattcaataggtagcctcctatatgcaggcagttagttgtaagtcattcaaagaatgaaaccaacgagtagaagttaaatcactatactcattgggagcttaaaaaataaataaatatgatttaaaagatgatgtcaacacaggtgaaaaaggaaaaatattagaatctcctgaactgactagacagacatgtttagaagactggtcttctctggaaacaagtaaagctggcagagaaatccaaatatctctgtgttaaattatatactcatgagatgctttctggccaaaaaaaggtctcccacaaacagagaataaattttcatatgtacctaagaagagtccagtactaaattctgacatttaaaaaattattgactgttaggagagaaaagtagagtacaattgtgattaagagagctgttaacaggccgggcacggtggttcacacctgtaatcccaacactttgggaggccgaggcgggtggatcacctgaggtcaggagttctagaccagcctggccaacatggtgaaaccccgtctctactgaaaatataaaaaattggctggacgtggtggctcacgcctgtaatcccagcactttgggaggccgaggctggtggatcacaaggtcaggagtttgagaccatcctggccaacatggtgaaccctcgtctctactaaaagtacaaaaattagctgggtgtggtggcgcacactgtaatcccagctactctggaggctgaggcaggagaatcacttgaacctggaaggcggaggttgcagtgagctgagattgcaccattgcactccagcctgggtgacagagcaagactccatctcaaaaaaaaaaaaaaaaattaaccaggcatggctgggcacggtggctcatgcctataatcccagcactttgggaggctgaggcgggcagatcacgaggtcagaagattgagaccatcctggctaacacggtgaaccccgtctctactaaaaatacaaaacattagccaggcgtggtggcgggcgcctgtagtcccagctactcgggaggctgaggcgggagaatagcatcaacccaggaggcggagcttgcagtgagctgagatcgtgccactgcactccagcctgggcgacagagcaaaactccatctcaaacaacaacaacaacaacaacaacaattagccaggcgtggtggcgtgcgcctgtaatcccagctactcaggaggccgaggcaggagaatcacttgaacccaggaggcggaggttgcagtgagccgagatcgtgccattgcactcccgcctgggcaacaagagtgaaactctgtctcaaaaaaaaaaaaaaaattgtggggttgttcacattctaaaaaaatctcattagggatttatgacatggtgttccaaattaaccacaaaattgtaaatagttaaccaaattatatcctagtaacaatttaggggggaaaataaaaatgaaaatgcattctgagttacataagagcatgtttactcttcacaaagccatatttatttatacttccaccaaaagccattttttttaagtctgtagacatatgataaaggacttttagtggacttggaagcatttttcacaatgggctagaatactgaggttgaatgttatgtaggaaacccacataatataaaattattttacacttgaaaaagaaaacaatatgttgtacagtatagctataaacaaatagcattggtgggtctgggactagttaaaattatgaagcaaagtttatatctacaatcaactatcccttgggactcctcctcagttttgcttaactctctcattctgcttcccttttttctgccctgatattcagtgcttttatacggcccaccctatagacatttctttactttcttgtgacatgaattggaataaattacaaataaccctaaatgttctttgcctttctccttctttaaattttaaacttattccacattttagctttttaagatcagacataacttccaaatagaagaaaccatgtttaaaaaaaaatccatgctttttaatcattttcttatgtaaaaagcctcaagtggctggaataaggtctaagtaacaaataaagaactaaacttttcagataaaggctccgaaagtccctcttgttttcagctttcaaaattctttctctctctctatcaatatatggttcacgtgtaaaaatgtgcttacctgtgtagggatgaaattaagactgtctgtcatctactcctcacaaaaggaaggaagtgagattattgtcctactttttccttatcttttctttttttctctgttggaggtataggatcaaccctcatcccttttgttaaatataaatgaatcatttaaaaggttaattattgtaggtaggtaacctgatgcgttaacctaattgcaatacccagttgaagaaaatctgatatataatttaccagtatggcaggtttttttggttttgtttggatttttgatgttttttgttttttaattttcctttcaggaccatctttttcattgttctccagagtgtaccttataggtagctactcactctccaaataggtaaaactcccctcaagctatggatgtcaaagatagtaatctatccatttaatcataagcttttcttccagaagttactgaatgaaagaggattagaagatggtctgtgtagcaaaggatttgcttacattttgggccagtttgcttacccgtgaagcaggcatagtaagacttagacccacctcatgaagttgttgtacggatcaaatgagattttaaaaaagcacgttgaagttggtaaagctgaatgtgcttgcaaagcatgacatttacaactgaaaatccaatttgtgcttttgtgttcgtacctggagaaatcacttagcttttcaggtctgcagttttctcactcagattcgaaaggtcccccatcgatttaaaaattgtggactttggccagatgacctcctgaggtcccctgattctgtagttgtaaatgtcctgtgtaaatcagggaagtaattcatatacaagcacagtatactgaggagaagttggaagccaggtatcatgattcctggctgaggactaggctacgtgttcactgaatgagactgcccaaggcttaccagagattagatgctacagaatgagagtggaattgtaatattagagatagagccgtggggaatctggagttccaacccagtcaacatggagaaatccttgttaacttcagttatctagctgagataacacaaaagataggtttgaggaacaaggaccatgctctaatataaggcctactctagacccaggctaagactagtaaaagaaggccccaattaattcttacagggtagaccaaatttggacaatgagtctcaccgagatagagaagcctgggaaatatcctgagctttcagcagatcagcataccaaaggttaaatccaaacctatacaagttcaaggagtcaactattaactgacttatatgtactagaataaaaatcactgctcctcagaagaaattaacagaaccatatttgcaatatatcccatgttgaacttttaattaccagacatgcaaagaatcaggaacatatgatctatagagcagaaaagagcatgcagtagaaatcacctctgaggagtcctatttggtttaacagaaaaaaaaaaaaaaaacaactaaattcacccttatacattaaagaattaaagaaaaatgtcatgttgatgatggaatagataggaaatctcaacagagaaaggaaaagtattttaaaatggaaatttgacatagtgagaacctgtctctacaaaaatgtttttaaataccagccaggtgtggtggtgcacacctatagtcccaactacttgggagggtgaggtgagaggattgcttgagcctgggagattgaggctgcagtgaactttgattgtgccagcatactccggcctgggcaacaaaatgagaccctatctcaaaaaagtaataatcataaaatgaaaatggaaatttgataattgaaatagaaatgaaacatttattggatagtctttttttttttttttttttttttttttttgagatggagtgtcgctcttgtcccccaggctggagtgcagtggcgccatctcggctcactgcaacctccgcctcctgggttcaggcgatcctcctgcctcagcctcccgagtagctgggattacaggcatgcgccatcacagccagctaattttgtatttttagtagaggcgaggtttttccatgttggtcaggctggtctcaaactcccaacctcaggttggcctcccaaagtgctgggattacaggcgtcagccaccgtgcccagcctattggatagtcttaatggaaaattagagctgtcaaaagaaagagtcagtgaacttcaaaatagatcaattgaaattattcaatctgtagaacagggagtgaaaggatttttaccgaatgaacagagcctcagtgacatgtaggacaatttcaaatgggttaacatacatgtggaacactagaaggataaaagagtgagaatgaagcagatgaaagacagtttttaaaaatggccaacatatttctataatttaatttgaaaccatgaatctttgatttacaaatcccagaaactaagtgaaaccaagcaggataaatacaaaaaataaaaaaatcacaactagaaataccatagtccagttgctggaaacaaaatatgcagagaaaaataaaagcagcctaagaaaaaaggcacagtgcataaagggaaactatgatagctgagtccttatcagaaacagtgaggacctgaagacaatggaacttctttcagggtactaaaaaaaaaaaaaaaaattagcctaaaattctgtaagcaaagaaaaagatcctttaaaaactaggattaaataaagacaatttcatataaacaaatatgaaaagaattcatctctagaaagcactctagaagaaatgctaatgagtgttcttcaagctgaagggaaatgaatccagatgggagcatgaatctacaggaaggaatgaagaacaccagacatgggccgggcactgtggctcatgcctgtaatctcaacgctttgagaggccaaggtgggaggatcacttgagtccaggagtctgagaccagcctagacaacatgacgaaaccctgtttctacaaaaaaaaaaaaaaaaaaaaaattagctgaggatggtggctcatactcttgttccaattacttgggaggctgagactgaggattcctgggcccaggacacggaggctgtagtaagccaagatcacaccactgcactccagcctgggtgatagagtgagactctgtccccctgccaaaaaaaaaaaaaaaaacacagacatggtaaatcagttgatacatatagaaaatgtattttttcttctcagaattcccttaaaagacaactaaccatttaaagcaaaaataacatgatgagttggcatttataatatgtgtaaaagtgaaagatgggacaacagtatcccaaaatattaggaggtagaattgtaaggttcttacgttcgtgaagtagaaaatatgaactgttggctgggcatggtgactcatgcctgtgatcccagtgctttgggaagctgagactggaggatcacttgagcccaggattttgagtttacactgagttctgtttgtgccactgcacactagcatggttgacagagtaaaacctggtctctaacaaaaaaaagaagaaaggaaagagagaaagaaagatagattacgaagtgttcgatgtgaagtagtacaatttctaatctaaatagactttgataaggtgcatgttgttagctgtagagcaactaccaaaataataacaacaaaaattttaaaaaccctgaagagcggccaggcaccatggctcaggcctgtaatcccagcactttgggagcccaaggcgcacggatcacttgaggtcaggagtttgagaccagcttggccaacgtggtgaaacccccatctctactaaaaatacaaaaactagccgggtgtggtggcgggtgtctgttatcccagctactcgggattctgaggcaggagaattgcttgaacctgggaggcagaggttgcagtgagccaagatggcgccactgcactccagcctggacgacagaacgagactctgtcacaaaaaaaaaaaaaacaaacaaacaaagaaaaagcacctgaagagctaacagaggaaataaaatgcaatgctaaaaattgtttcatttatccaaccaataaaggcagaaaaggaacaacaaataaagaacagaaacaacaaatgaatgacataaattcaaccatatcaatatttatggcaaaatgaaatatagtaaacacaccaagtaaaggacagagatactagattagaaaaaaaaaagcaaggctcaactgtatgctgtacataagacctgtactatcataaacactggctggaattaacggaaaaaggtacttcttggaaatagtaatcctaagaaacctggcatagctatattaatatcagacaaagagtattcccagagataagaaaagaccatataataaagataaaggggacaacacatccaaatgacataataatcctaataaatatatatctaatagagcttcaaaattcatgaaggacagaccgacagaactaaaggtaaaacaaatctgtggtcaccagtcattactggggattttgacctctattccttagaaactgatagaattactaaacaaacaaaagcaatcagaaatatagaagatctaaagactattaacttgacttatttaacatttatagaatactacatctaacaactgaagaaaatatatgttttttaagtgcatatggaagtttcacagatacagaccatatgctgggccttaaaagtaagtctcagtaaatttcagaagactgagatatgctaaagttgttctctaaccacagtagaattcagttagaagttaataagatacttagaaaatgtttggaaattagataacataattctaaataccatggcttagagaagaaggaatgttaggactcgttttgaactgaatgaaaattcaaatgtgaagttttgtgtttcacagttgaaaaagtggttagaatgaaatttttacccttatatacctgtattagaaaagaagaaaagttgaaattcattgatcttagtttctacactaaggtaccagaaaaagaagcagagtaaaccacagtaagtaggataacggaaatattaaagataacagaaatcaaacacatagaagacagagaatcaacagaaaattcacaaaattcataaccgggttctttaaagaattaaaaaaaaattgataggtccctaccaaatggatcaagggaaacaggaaggcacatgaattgccaatacctggaacgagagaggggttatcactccagtttctaaagacacgtaaaaagataagacaatattttgagcaaacttataccaataaatttaatagacaaagtctttgaaaaatacaatttattaaaactggctcaagaaggaatagaaaagtgagcaggcctttatctattaaagaaattgaatttgtcatatggaaccaaaaaagagcccaaatagccaaggaaatcctaagcaaaaagaacaaagctggaggcattatgctacccaacttcaaactatactacaggactacagtaaccaaaacagcatggtagtggtagtaaagcagacacacagagcaaaggaacagaatagagaacccagaaataaggctgtacacctacaactatctgctcttccaccaacctgacaaaaacaagcaatgggggaaaggattccttattcaataaatggtcctgggataactgcctagccatatgcagaagattaaaactggactctttccttacaccatatacaaaaatcaactcaaaatggattaaagacttaaatgtaaaacccaaaactataaaaaccctggaagacaacctaggcaataccatgggcgcgggcaaggatttcatgacaaagacgccaaaagctgttgcaacaaaaacaaacaatgacaaatgggatctaattaaactatagagattctggacagcaaaagaaactaccaagagagtaaacagacaccctacagaatgggagataatttttccaaattgtgtgacaaaggtttaatatccagcatctgtagggaatttaaacaaatttacaagaaaaaaacaaccccattaaaaaatgggcaaagggcgtgaacagacacttctcaaaagaagacatacatgtggctaatgagcatatgaataaaagctcaaagtcactgattattagataaaatgcaaatcaaaaccacaatgagataccatctcatgctagttggaatggctgttattacaaagtcaaataacagatgctggtgaggttgcagagaaaaaggaactcttacacactgtcggtgggagtataaattagttcaaccattgtggaagatgatgtggcgattcctcaaagacctaaaaacaaatacagtttgatccagcaatcccatcactaggtatgtacccaaaggaatatcaattgttctatcatatatacatcatgaaatattactcagccgttaaaagtaacgaaataatgttttttgcagcaacttggatggagctggaggccattattctaagtgaagtaacacaggagttaaaaaccaaaagccttatgttctcacttataagtgggagctaagctatgagtatgtaaaggcatacagagtgatataatcgactttagagactccgagggggtgggggagggaagatatggataaaaatctatatattaggtaccacgtgtatatagtactcagttgatgggtgcactaaaatcttagaattcaccactgtataactcagtcttgtaacaaaaaaacacttaaaccccaaaagctatttgaaataaaacaagacacatgtacacatatgttcattgcagcactgttctcaataacaaagacatggaatcaacctaaatgctcatcagtggtggactggataaagaaaatgtagtgcccatacaccatggaatattgtgcagccataaaaacgaacaggatcatgtcttttataggaacatggatggagctagaggtcattatccttagcaaactaacgcaggaacagaaaaccaaataccacatgttcttacaaggggagctaaatgatggcaacacatggacccatagaggggaacaacagactctgaggtctattggagggtggagagtggagggtgggagaagggagaggatcaggaaaaatgactaatgagtactagacctaatacctgagcgatgaaatagtctgtacaacaagacttcgtgacacaagtttacctatttaacaaaccttcacatgtgcccctgaacttaaaaattaagaaaaagaaagaaaaagaaatagaatttataatcaaaaacattcctacaaagaaaactccaggccccaatggctttactgttgaattctaccaaatgtttaagcaagatgtaataccagtcttagagaaactcattcacaaaataaagaaggtattatagaaatacttaccaagtcagcttagaattgtgaccctcctgcctaaacttgacaaagacattgcaaaagaataaattacacatcagtgtcactcatgaacattgacataaaagtccctaacaaaaccttagcaatttgaattcaatataaataagaaagctaatatatcacaaccaggttggccttatttctagaatgtaaggtttgttcagtattcaaaaatgaattaattaaactcactacctgaacaaaatacagaaaaaaatcatttagtcacctgagaacattcagaaaggcttttaataaaaggcaacacccatttatgataaaatatcttagctgactagagatagaaggtaattcagcttagtaaagagcatcatgaaaaatttacagctgacatcatacctaatgatgtaagctgaaccctgagattgcaaaagagataacaatgtctatatccccctattcaatactatattggagatcctagtaatgcaagaaaagaaggagggaaaaagcataaaattcaaaagaaaattctaaaacgtatgtattcataaacatggttgtttagggcattttaggcatagtttggggatactgcaagttttgttccagactactgaaataaagtgcatattgtaataaggcgagtcacgcaaatttattggtttcccagtgcttataaaagttatatgtaagcagggtggaatgggtcacgcctgtaatcccagcactttggggccatggaaggtggattgcttgagcccaggagttcaggaccagcctgggcaacatagaacctgtcgctacaaaaaaagaaaataaatagcggggcatggtggcacacaccagtggtcccagctactcgggaggctgaggcaggaggattgcttgagcccagaaagtcaaggctgcagtgagctgtaatcgcatcactgcactccagcctgggtgataaagtgagatcttgtctcgaaaagaaaaagttatatgtacactatgctatagtctgttaaatgtgcagtagcgttgtgtcttaaaaaatgtgcatactttaaaaatgctttatttaaaaaaaattctcctgatcatcttgagccttcagggagtcatgatctttttgctggtggagggtcctgcctctatcttgatggctgctgactgagcagagtggtggttgctgaaggttcgggtagctgtagcaatttcttaaaataagacagtaataaagttgccacatcaatggactcttcctttcacaaaagatttttctgaagcatgggatgctgtttgataagcattttacccacagtagaacttctttcaaaattggagtcaatcctctcaatcttgatgctgctttaccggccgggcgccgtggctcacgcctgtaatcccagcactttgggaggccgaggcaggcggatcacaaggtcaggagatcgagaccatcctggctaacatggtgaaaccccgtctctactaaaaatacaaaaaaaaattagctgggtgtggcggcgtgcacctgtagtcccagctgctggggagactgaggcaggagaatggcatgaacccaggaggcggagcgtgcagtgagctgagatctcgccactgcactccagcctgcatgacagagcaagagtccatctcaaaaaaaaaaataaataaataaaaataattctatcggccaggcgtggtggctcacgtctgtaatcccagcactttgggaggccaaggcggggcatcacctgaggtcgggagtttgagaccagcctgaccaacatggagaaaccttgtctctactaaaaatacaaaattagctgggtgtggtggcgcatgcctgtaatcccagctactcaagaggctgaggcaggagaattgctggaacccgggggcagaggttatggtgagccaagatcacgccattgcactccagcctgggcaacaagagcaaaactccatctcagaaaaaaaaaaaaaaagaattccattagctatatccaaggtttgatatatatctagatttttttttctcatgtatgatgaagtctctggattcctgagtgtttctttttaacctatttagggtgtggtggtttcatttcataaaattgggagttgggagagaggtatttgttgtggagttcacagtattattgtattgtggtgaaaaaacatagtctataaaaggaaaacacaggaggtgtaaataccactacagtcaagattttaaaactatccactgaccagatgtactggcattgaactgttgatttttgtcctcaggctggtgtcaagtgatgccatccttttgagtgttcctaggtctcttccttagatatatgaaaatgtttctcagaagtcctgatatccagcctcccccaacagtagacttttactcacatctgttaggctagacagagtcccgtgccaagtcattgaggagggaaagtgggattatcgttcttggcctaatctaatcagcacctacctctgaggtttagagatagtctttaaggcactctgcgaaggcaagatacatgaaaaacagttggaagcacaactggttaagcagccaaaagagtcttcggttgtctctgagttgctatctttcaatatgcctgggtgtcagccaatttattggaagggagaaagaatattggttgatctggagagtctgataattggcattctgttaggagaacctctgttatgcttatttaaaggccctttaacacagttctattatttcgagtttttacaatgtgaagtcttctgtttgttgtaactcttttttttttttttttttttttttttttgagacggagtctcgctctgctgcccgggctggagtacagtggcgtgatctcggctcactgcaagctccgcctcccgggttgacgccattctcctacctcagcctcccgagtagctgggactacaggcgcccgcccccacgcccggctaattttttgtatttttagtagagacgggtttcaccgtgttggccaggatggtctcgatctccggatccacccaccttggcctcccaaagtgctgggattacaggcgtgagccactgctcccggcctgtttgttgtaactcttaaacgaggacttgttttctaatctttggtagctgtgcttctgtggagctactttccttgggagtcctgttccttcagagcagcgtccaggttctctctctggggacttagtacactcactctttctggaccagtttttatgttaatttctgtgcttgggattctgtgtgtctctcatgcatcagtgatttctaatgagtaattcttttcctacccatagcctaagagtctttgttgcttcattgggctagtaagtaaagtttttctaaaggtctctatttttacagggatagtcaacctttgtgactttctttaactttatgcagaaaggttagttccatctcctcctgagccccagtcctgggatctcctccctaaggcttataacccagtttttaacctaccgctccctcgccccacccccgtaagttatttccacttaaactcatcagctataactgaattctttgttattagcacttctcctgctttggctaaagctcaatacctaattattattttctttttatgcactatttttatgagtttggagcaagaggggagggtcatgttgggttccttcacaatatttatcacaagtacaagttccaatttaagctaatttattttcagtctgttaggatttttttctccttctctcctaatttttgtcaactgttatttttgtaatcattctttttcttcctgaagtcttcaaaatccatcagatggatttgattgttgctttttagatatatatctgttgcaaagtttttgccattgcttatgggatgggatgaattacagctctcttaaacaacagttttctgtggaaaggcagcagaaggcaatgatgaaagatgtacttcctgctcttcatctctatttctgaaatcttattttgtttcctgagtttctgtaagagttacttctgcttaaaacttctgcctttacccaaactttatggtgtcttctggaatagtttatttttccagtatactttaaagaaaaaaaaaccttcggttctcagcctgctcatgacatccagctcctgttgctttggctcagagttccattctacctcatgataaacaccttcgtatctcattatatcttaaattctctaagctctaggagcagacttacagagggagcatactgtactatttaaatgagccatgacaggcctgggagtggaacttactgctgggaagtagaccaggtggtattaaaggggcttgttccatgtggcaattgctccacccgttaatactgaagtagaaaattggaggagtaaaccacgttcagttgctaatttcctgtggagataagacagacacactgtgcttgtgtatttccatctctccatgtaaaactgtattggaaaacatttctttttatttctaggtctgatttttttgttgtagttttattttattggcagagttcatgtagctaaacccctcagtgcttcaatttaagacatcgggagatgaatgaaattgttatgttattaagtagatgctgcagctctgcttgctagggatgaaatcctattttatgaaataatatagtgtgaagctgtcagtaatttccaattgtagaagaggcctaatcagaaagttgggttttttttgttttttgttttttgttttttttagacaggcccagacagttttttgaccagacatctatacatgtttcagtgagttaattactcattttattgtaatttcatctgttagaaagtacccaaataattgcaaagtttatgtatataaacttttatggatatatcacaggcaaacaataggtgatctttggcatggttgtagttgggaggtttcagatggagatactgtgggcacatgccctcttcttcccagctggcatcctgggaagtgctgacgggctccggagcaagtgaggccctagagactgtttatgacacgtcagtgttcatttgtgtctcatctctttgatcgctaagaagatacctgttttactaaagctcagctgttgtcagtttctttggattgattgtcttaaagggaaagataaatcaactttgtttttttcctgaagatagctaatcaggtcatttaattttggaccaataagtaaaagaataactgagtttaatgagtattgcgtaaaataagttcttggtgatttgaccctgggttgacttggcatgaattttctttcttttcaactccctgctgcccactttgtggtgttgtatgaataatgagtccacaggccctgtaaacatgttaggtgaggtgtttgttgtttattagtagttgggattaaatagaagttgcacactgaaattgagtgaagtgacttttctgcagttaacttggatgtcattggtttgaaggagtttttctgttgcagctgcttgtcctactacttttagctgtgggtgcatcctttctgcgtcctgctaaaaattatattcttgttttcacttttaaaacctaagacggttccagagctgtgtttggtttttgctttaaactaatgcccgagcgcccctttagttagtcaccaatcactgtttaggtaagttgatgattcctttttgctacccaagatttttttatttaaaattgagcatttttaacttgctttttaggtcagaggatcaatgtcctctgtggtattcctcctccatctaagcttcttaaagcagtattataaatagaggctttcaacctaaaaagtactgtgtatttcattgactagaactgaactgaactgtaggctaataaaaagtaccaaatgaaaatattatggtatctcattgcactccattgtagatgtaatgtagtgtgaccagcagtagctttgattcattgtaaatcccatctgaatactgacaacagttcaaaacatcaggagataaacctcaaaggtcacatttgtgtgaatggtcattgtgcatataagacatcattttattatttgaaaactagtagtgtagctcttaagacagggcagtgtcctaacctctgacagggatagaggcgagaggagaatcagtgggctgccaaacagtcatgtgttcataggtgaggttctgtttcttctttagctgttactattgttattattattattattattatttgcatgaatggtagcagttacttcacaggcaaatttcctatgaatcccagagtattgcaacagattagcagcaaataaagacctgagataaagaaaaaaaaaatgcttttattcagttatattaaaattaggacatttcaataaaaaactaaagcagcttatgttgttctgcatgcataaattgaaagaatacttgaaaattcttcaaacttgatggtagacattatcttacagctttcttaaaggaagtcagtttcttggcagtaggacagaggttcccaacattacttggttctagcacaatcactaaatttttcgtgacttttagaccaaaataaatacttaacagttcctaacagtttgttgtgttccaacagtttgtaatcatgtcaaaaaataatagacatattagtaataataaattgaaagaaaatattttaatttcttattacttactcatcaaatgtgtgattgttgggcatggcacagttttttaaaccttggaatcagattggccactgccaacttcatttcttgttccacgctaatttctgtgcagaactgtgctgtgcttttagtcacagtgctgcggtctgaatggttatgtccccccaaaattcatgtgttgagattctgaccccaaggtgatcatattaggaggtgtggagcctttgggagtgattaggtcttgaaggtggagttcttatgaatgggattcgtgtccttgtaggagagaccccagagaactcatttgccccttccactgtgtgagaaaagctgtgagtagatgccatctgtgaaccagaaagcggactgtcaccagatactgaatcttacagcactttgattttaggctttccagcctctggaactgtgagaagtaattttttgttgtttataagctacctagtttatgatattttgttacagcggcttgaatagactaagatacaccgcaaccatcaaaaactcaatttcgaagagatggaatatcatgaacaataattttgcatgatgtcgtattgaactgtgaaataccacaagctagtaatttgcacactgtctgacagcactgtgtttctcaaaatttaaaatgctctgcagtacccctgtgagttccctggggtgctgcagtgcacaatttgggaactgtggtagtattgtagatagtaagattatctaataataagtattgatgacatcttagtttaggaataattattagtatgtcagactataggggaagtgagtaaatcatatactaggttgttatcagaatgattatgaatttcttcacccacctgtggagagacagcatggcctatttttttactctgaccccaataagaaaagtattctgtaccttcccccttctctctccctttttgtctcttcgttatctctcactcttgctctaacagacacacacatagtgaaataagtatttaacaaaacagtattctcattatgtgcactctgactttttttttttttttttttaatgtctccttaagacctactgaactgacggaaactagttaaggtcacagactcgagagactgacgactttaaaatggccttcaccatttcctgtctgtgtgactgtaagcaagttatgtaacctctcagttactcagtttcctcgtctatagagtggtaatttgtaatagtacctagtgctgaggggatttgttttcttttgttttgttttgttttgttttgttttgttttgagacagagtctcgtgctgtcgcccaggctggaatgcaatggtgcgatcttggctcgctgcaagctctgcctcccgggttcacgccattctcctgcctcagactcctgagtagctgggactacaggcacccgccaccatgcctggctaattttttgtatttttaatagagaaggggtttcaccgtgttagtgctgaggggattttaaggaagttaatacatgtaaaacactttaaacagttcttttttattttattttattttattttattttattttgaggaacagttttgctctaatctcccagactggagtgcaatgggacgatctcggctcactgcaacctctgcctcttcctcagcctcccaagtagctgggaatacaggtgcgcgccaacaggcccatctaatttttttgtatttttagtagagatggtgttttaccatgttggccaggctcgtctcgaactcctgacctcaggtgatctgcctgccttggcctcccaaagtgctggaattacaggcaggagccacaccgcgcctggccatttaaacagttcttgatcagtaattactgctttattactagaatctcaatgaataatcagaggctaaaacatttgggaaattagggagatgcagtagttctgtgctctaaagggtactgcatacagtcaaaaggcttttctgaatttctgctcttgggcagatagattgtgtatcccttgccaaagattttccgtatttatcctcttgaatctggatccagttgagtagtaaacgggagtcaaaataagggagatgaaaatactatcgtcattactgacaaagctgattagagaacatgactttatatttgcagccaagtagcttcactagtatatcactcctgccaccagcacagctgcataactgcaggcttcttactgcgtggcagagagtagaacaggatggaccttctgcataagcagccaggtctgaagaggggagagcagaaggggctgaactgagtgtgttcacctctttcttcaaaatctgccaatgatataactcacaagggagggagacaagaaacataggcacagaaatgtgaagaatgagaatatcaccttaacaaaggaaacattttataaggatacaggaggtccataatcaagttcatgttttgtaacttttagtagttaggtatcctttctggcacaaactttaaaaacagatacaccagggtttgaattctgcctgtgtcacttaattgcactggcttaggcatcctagaatttctaagagccgtaaaacagacaaaactacttggcaagaaaaattgaccactgacttctctcccctgttctgttgatacaacattaaatttatcaatgtttgtttttgtcaaacttcagtagtgttagaggtatgagatcagccttagttgattagaggtatgagatcagccttagttgattagtaaaaaggattttatatgcctaagatagcaagagagatatgcctttgatctttcttatttataggaaaataatttattaacctaatttttattgtcacttctaacctaaatacatagttgtcctattaatggggacctttttttcccgtgagcatctgaaacagtcttttttttctatgtatgtgaagtggtaatagtttttctcgtgtatcaggcaactaccaacttattttagaccagaaattcttggaaatggtaccgatccagttggcataaaatgtgcaagcactattctattgattcctcaaaaagatgcaattgctttactcatagagttatcagttatttttctggctatttcacttgaagtagccatgctttgtctttttttctatggagatacgtggccaaaactaagtcttttcaccagctggatgataggaaatttgataaaatttgagcagtataaaaactttcccattgactttatatgattgaatttccactatgtaaaattaaactaattatttcttatgctacccaatatatagtttattatttgaaaactatgtccccatttttcctcaagaacatgattttgtcttttgcatctcagtgcaggggttggacagcataatttcttctcctagaaacacattttctgctgcttgtagctactatttctattttttcatcaacagctacaggagtaagtggagttcctgacatctctgtgtaatcagtggtatgatcacataccccatattgactttttcttttgaagtttatgctgctgtctcttcagtaccttgagcttgacctctagctttaagcagtaaaggtatcaaagaaaatcagttgccagagtcagtctgtttgcttgtgtcctcctaacccactgatggcacctctgactccttgacattgtattatttgtttctcagagaagtaaagcaattttttttttcctctgtcacccaggctggaatgcagtggcgggatctcggctcactgcaaccacctcccgggtttgagtgattctcatgcctcagtttcccgagtagttgggattataggtgcctgccaccatgcctgactaatttgtgtatttttagtagagacgaggtttcaccatgtgggtcaggctcgtctcaaactcctgacctcaagtgatctgcccagtttgccctcccaaagtgctggtatcacaggcgtgaaccaccacacccggccaaagcagttttttttacatatagacatttaatatattgactttggttgattcttacctcacttccaagataattgtttctgttaaattacatgtatttttaggcttgagtcatccactatatttatgagttggtcatttctttcatgagttgagcttgtttttaaaagttctacttttaaagtccccttctgtctctcctgcagccactttcactgtaacatttatcatgttattcctggcagccagtcttcttaactctccatcattacttttggcaggttacagcagtatcacttagggttctcttagttcatttttaatgaacatccaaaagatgctcctattgcaataaaaccataagaaaagattaatagaataagggtttattctattaataggcaatttggggctgctacagtggctccatgataccaatggttctgggctctttcttttccgctatccttagtatatggccttcttcctcctgcttgcaaaatggtggcatacagaagcctttcctacatattccagaatatgaagaaagacaagggggaaaagggacgtgccaactggttaaacaacaatcaccatatcaaagacccacccactagatttcttcttcttactggccagaactttgtagcgtgcccaccctctatacacaacaggctgcaaaggaggctggaatatcacgttttagttgggcagtgactatccagtgcaaaatccagattccgttagtaaaggatgttgatggagtggatggatattaaacagagattcaactttcctgttcagaaacgtgttataactccatatattgctttaattctatctatcctagatagacttacaaggctagaataagacctttagaggcactaaccaaccaccaaaaagaggctaatcacctcccatatgtaaatcaaattgtacaaaaaattgaaaaaaatacatgtaaagaccgaaaacattttgatttatcctatgacgtttcagtatttttctggaagtattaaatattctaaaatttttttttttgcccgggtacggtggctcatgcctgtaatcccaacactttggaggccaagctgggcggatcccctgaggtcgggagttcgagaccagcctggccaacatggtgaaaccctgtctctactataatacaaaaatcagccgggcatggtggtaggtgcctataatcccagctactcgggaggctgaggcaggagaattgcttgaacctggaaggcggagtttgctgtgagcccagatcacaccattgcacttcagcctgggcaacagagtgagactctgtctaaaaacataataataataaattaaattaaattaaagtgtgtggtagtgataatgggctggagggtatggtgagtctatgttgctgacatgctaacccacatcctgtctacttcatcagtatttcctattgtattagaaagatgagaaggttccttaaatttttaactccatagaggtgattcatttactataaagccttaagaaaaatacttaccctatctgggcctctgtttctccatccatgaaatgagaacattgatcataatagaaaagtaggcaaagaatataatcaagcaattcacaaaactatacacgcagatgactaataaaattataagaaaatattaagcctcacttatgacaaaagaagattaaatttaaataaaaagttcctttctaaaaatgtaacatagtagcagagatgtaatacccagtggcaataagaatataaagaaacaagtatttgagtgtaaagatagtctgaagtagtaaacgagggcaactaggtgtatttatcaaaggttttaaaaaatgcgcaaaaacttttgaccctgcaattctactttgaggaactttcctacctgaatttttgacaagcacacaatgattgaccctggtaaattgacataaggtatttttaactccagccagtttttttctttactgtagtaatttgtgtgaagctttctaagaagtaaatatgtaatttactgtcaaagcttttttcttttagaaaatctaagccatgaacatttaatatgttttcgttttaccttatattaggaagataatggcaatcttttaaaaataaaaattatttctttgttcatatcttaatttttgtttcaatctgtctgtccattttggtcttgtctattttacctctgggctctatctttactacaaccagtcttcctaactcttctcccaactttcagaagtagttttctaactatgtcaatgaagtatttccaaatgaaacttgccaaatggtctaatgccataaagacttctgcttctgtcttcattggattttagtcagtaaattttctttcttttttatttatttgtttatttatttattgagaatggagtctcactctctctgctcactgcaacctctgcctcccgggttcaagcaattttccttcctcagcctgccaagtagctgggactacaggtgtgcaccaccacatttggctaattgtatttttagtacaggtgggatttcaccatgttgtccaggctgatcttgaactcctgacgtcaggtgatccacccacctcggccttccaaagtgctgggattatagaagtgagccactgcgcccagcccatattcagaagttttctacagtttttttgttttgttttgttttgtttttttgagatgaagccttgctctgtcacccaggctagagtgcagtggtgtgatcttggctcactgcaacctccacctcccaggttcaagctattctcctgcctcagcctcccaagtatctgggattacaggtgcccgccacaacgcctagctaatttttgtatttttagtagagacggggtttcaccatgttggccaggctggtctcgaactcctgacctcaggggatccgcacttttggaggccgaggtgggcggatctacaggattttaaaacatgaagttgtgcctcttcccaaatttattctcagacttatttttttactagttttatttctgaatggcacattagagagagagaaagccagagagagagagagcgagagagaggaaagaagagacaaggtgggaccgatggtataattgagttcatagaaagacagtgaagtgaatcatgggtgtttcatcactttacaaaactgataacaataatatcatttctagaaacgtgaatttacagtatgaaatggtaaacattttttttttttgagacggagtctcactctgtcgcccaggctggagtgcagtggtgcagccttggctcactgcaagctccacctccagtgagccattcccctgcctcagcctcccccagcagctgggactacaggtgcatgccatcacgcccgactaattttttgtatttttagtagaaatggggtttcaccgtgttaggcagatggtcttgatctcctgacctcgtgatccacccgcctcggcctcccaaagtgctgggattactggcttgagccaccgcgcccggctggtaaacatctttttatagctaatgggcacttttaggctaactgagcagtgaacactattaaatatatgagaagctttttaaaccaccttccacttaattcataactacttgtcaggttgagactttcttttctctgttaaccatgccaatttttgctcagagcatgctgaaaaagctactagattactgtcacatataccaggcatggctctgttaacctgtttagttgtattattgctgaaaagttatttattccagctattcttgatattttaattatatatttttattattataagaaaccaatgacatactcatatgaaaaaatatctctgtgaaataaagcaaaatgttttggaaaagggatgcaggtaagtcatttcaaaattgctgttgttaatgcgggagaggatttggaaaaataggaacgcttttatactgttggtgggagtgtaaattagttcaaccattgtggaagacactgtggcgattcctcaaggatctagaaccagaaataccatttgacccagcaatcccattactggatatatacccaaaggattataaatcatgctgctataaagacacatgcacacgtatgtttattgcagcactgttcacaatagcaaagacttggaaccaaaccaaatgcccatcaatgatagactggataaagaaaatgtggcacgtggccaggcatggcggctcatgcctgtaatcccagcactttgggaggccgaggcgggtggatcacctgaggtcaggagttcaagaccagcctggccaacatggtgaaaccccatctctactaaaaataccaaaaattagctgggtgtagtggcaggcacctgtaatcccagctactcaggaggctgagacaggagaatcgcttgaatccaggaggcagaggttgcagtgagccgaggtcatgccattgcactccaccctgggcaacaagagagaaactctgtctcaaaaacgaaaaaaaaaaaaaaagaaaatgtgtaacatatacaccatggaatactatgcagccataaaaaaggatgagttcatgtcctttgcagggacatggatgaagctggaaaccatcattctcagcaaactaacacaggaacagaaaaccaaacaccgcatgttctcactcataagtgggagctgaaccgtgagaacacatggacacagggaggggaacatcacacacggcctgtcgggggatcaggggctaggaaagggatagcattaggagaaatacctaatgtagatgatgggttgatgggtgcagcaaaccaccatggcacatgtatacctatgtaacaaacctgcacgttctgcacgtgtatcccagaacttaaagtataattttaaaaaaagtaaatccaaaaaaaaattgctgctgttgaattaggttaacagttactgaatattgggagactttttgaaacctcacagtttgaaattggcattgtatttcaaatgtctgcatactgactagccccactttcacacaaccagagctgaaaaggatgtgaaaaagacaatactgaacctaagtcatcagattatatggtgatctttggatctcgtctaaatgaaaaaccagcaaagcagcttcaaagcagcaaaacactctctatatactttctttattctttaagaaatattttagttaatcacctagcagacttgagtgtcacataaaggggcttcttctatagtttctcataaataatttgctgattctgggaactctaaaaggtaaatattttatgtagcatgtgtatattgtaaattatttataaaaatgttttaaaagacctaatcctgaaatagtaaataactaaaaatttacaaatactattctcaaatagtaaataagtatatatgagctttcaagttagaactaaaatttccatgatgtgatatctattttaagatttgtttatcaaggaatattgtaatttgggaggattttttaaaagcagattttattttttctgcccttcacaaaaactaaatctgagccttgggaaatcagggcagctgcatcatgatgtgacttgcctggggtttggtattttgctgagatacctgccagttggaattagaaccctatgggtataactagggtagacttaattattggcttactgtatttaaatcaaaatgaaaagctcatacaaaattttgtacccgtactctgaaaaaatgtggaactgtttttggactaaaattttatagcttttgtggctaatgaggcatgaaataaattggcaagctcaaactgttcggagtacagtggtacagtgtgcattttctaattcccagcccttgggattccagcaaaggtcacaaattaaacaaagtcaggattaatcaagactataatcaaataaaactcaatcattaatcctcttctgacttacaatagagtgattgtgtaattgtgtgagaagcactggagagggctcttttgtagtgcgtaggaaaatcaacattaaggtgtcagacagaaaagtgaaaccctgcaggtgaagctgtctctggagccaagagaaactggcaatttatgcagagttgcaagtgaagctttggagcattgaaaggctgttggcactgagctgcagagcgtgtgggtctctcggtgaggcctccacagagatcagtttacgggctgcagcaggccgtttgctgagaagctcagtgtttgggtgcagcagctccaagcaacagtctctccaagttaactgccagaaatttactgtgtaattctcagctctttgtaattttgaagaagaggttatggaaaagcatttcctctgtgggagtaattatgtgtcagaaaatgccattcctcaataaagggggaaggttcacaaagcacagaactttgtcctatttattccatgttcctgacttctgaactgatgcttgctttctgctattttatgttctatagtgatactttcttcatttttcatcccttcatctcaagtcagcgtcagttttattgctttaaaagtcaacagtgatactatccagttctgctaagagtgaaactttaagaataaaatttgattttaattcatcccttattatatgtgagtatattttttatattcgctttaaggatagtatttacctctgtttgttagctttctgctttccttcgtataccaaatagaaaaattctcattcactcacccccaaagcatgtgcctgttatcacatgattcagtttgagtttctatattacacaatttctgtttcttacattgctttttcctatttatgtactaagctctctgtatatgcaggatactgttaggtatgatatgagatatttattattttctttcaagtaaataaacaaccattatccatgcatagctggtcagtcccataaattttagtactaaaatatcacttggattattttattagcaagactttattgtaatgatgtatttcagattttgtctttccatttaggctcatatatgttacattttggtatcattattgaaacaaattcatgaattgagttcatcattagaaaatgaaagcctcagaattttggtaattgttttggaccatcacaaaaatgtgcttggcatatttaaattctgtatttttttcccttacctgtaataacttttcaaagtacctaaagctatgatagaaatggaatagcatatagaatacttgtgtgtgtgtttgtatgcaggggggcggcttcttatttttaccttttttctgattttatatatacaatgttagatatattgttctgcaatttatatttcagtggaagaatattcatggttattttttaaagtcagcataaagatctgttgcattctgtttaacaagtgctttgtgttccagtgtatagatactgcattatttatttcatcctttcttggttgaagattgtttaggttatttccagttgtgtaatattgcagataatactgtaaagaaaatcattatacttgcatcttttcacatatgtaagcatatttttctaggatagataatggagttgctgggtcaaaacataatggcgtattttattttgaaaactgttgctcaagcactcttataaaaggctctaccccacatgtgctctcacccaaatgtgtatgaaagtgtgcatctccttaattgttaggtgtagtggatactatccatcttttacatttttgctgacttttatatttgagatatctttctacaccattactcacccttttctttccagcagagtagtattccatagtattatatttaattagtcctccattaatgaacatttaagttacttctaacagtttgccattacattcaatgctacagaattttaacaaatttgtaatgcagaattttcataagtataagaataaccttattacaaaagtcatttcacatgtatgcaagtatatctgcaggataaattccaaaatgtaacaaagggagtatgtatttgtaattctagttgatagtgtttttttggtttttgttgtttttttgagacggaatctcactctgtcgcccaggctggagtgcagtggcacgatctgggctcactgcaagctctgcctcccgggttcacgtcattctcctgcctcagcctcccgagtagctgggactacaggcgcccgccaccacgcccagctaattttttgtatttttagtagagacggggtttcaccgtgttagccaggatggtcttgatctcctgacctcgtgatccgcctgcctcagcttcccaaagtactgggattacaggcatgagccaccactcccagcctctagttgatagtgttaaatggaaaaggaagatgtaaaacagtatgctaccatttgtttacaaggggaagggtataagaatatccatgtgcaggcacacatggtaacatggcgagtgcgggggaaaatgaggtttcaagttagaactaaaattaagggtacactgtgacttaggtcacaacaggacataaacatttaatttactctgagcctcagtttccacatgtatgtaaatgaagctagtaaatgcctgtttgatagtattatgagaattaaatgcaaaattgtatgtgaaattatgtgacactgtggccagcatatgatacgtgtgtgtgtgtgtgtgtatattttgctctatattgtgccatatgtggcacagatatttcttgtaaaggtagcaattgcctgttgtattcatacaatgcggagcctacttgtcaatgatgcttttatttaatcaattatacatagagttgtcagcatggaaaatgcagcttctgttttgaattatgttttacttctgagtataatttaaaggcaaaatggcttcactcctagaaactcgagacctctaaagcttgttctcttcctgatgaatgttctctttgggcacttcaaatagagtatcttactcatggctttaggtgatatactgggaaagcatgcagttgctttagaagcctttataaataatacttgagtgttcaatataaaaccaatgtttggctttcgtaaccatttcctacatctcttctataagtttattgaattcacagtacacatctacactgtgagaagcatttatctccttttgtgctaataaaattaagcaaaagacaaagttactcccaagttcatagcatattccttgaaaggaatgattataagaacaaacggggatcaatgcattacatctttagaatacaggaaggagtttttactacttcattttaaaaataaggaaatagagatgaaaagctttccatctttccataccacgttcggcagtggtaatatgttttatacccactaatcaaggcatcctctgtgttttgatgctttgataagtagtcatctgcttttaagtttgtgatagtagattgaataagtgtcctcgtgctcacgcaggattatatacttattatatacttaggcaaatttgtctttttgaaccaagttttatcacttaaaatgagcataataataactaattcataagaatgctgtaaacataaaatgagtattactaactgagaatgtacagtagatagtaggctctcactacatgctggttttccttcttcctttccattctcttaggaaaactgatactcagaatggctaagtgatctgtgcatagtcaaaaggccaatttagtgatagaactgagactggatccatcactttgattacagctagattctttccattataccaagcagcatccatagtaatttactttcatttgtacaattttctatgagaaaaaatgagcaacaactatcagtttgtcttcaatcctgataaaatctagcacttacagaaattgctaagaagtaaacatttattacacaaacccatgccagagaggggtatgttgagttctagtctaaacatctttaataatgataattccataattctcagctgtttcttttagattgaccttttctcacctgataaaattttccaattctaagctctttattctgattgaaatctgacataacttgtctcagtcatcatttttccattctgagcttgcttatattttctaaacttttaacttggttctccagcctggcgaccttaatttgtccattttagaacagccaaaatatccttgattttgctggattaattcagttatctcaaattatctctgacttcctttttcacacctgattttccttagttttgttgattaaagattaatatgagtttgtatgccctgacagtggatgatacaaaagaaaactggtctaggaattaggaaacctactttctgtttcatctctcttcttattgccaagctgtttcctcactatgatgggaaaaattatgttgtaatcttatgtcttataaaagagggctcaaattggtatagactgtatattttgtggggaattaattatgtgactattcaacatttgacaaataattttggacgtaagtgtgcaatgtctaaagcccgaataattctaattttaatgtcaacgcacttgatgagttgaagtatggtgcttgctggtaatggggaaaaaaaaaggctacaaccaaaagtattgtgttatataaaattacatgtgatttgttgtgccttcactttgaatattagctttcctgacagccaatgtaagatattagttaacatggaaaataacttcttacatttacatattgcagtttttcagggcacttctgtacacatgtggtatctatataaattatatttcagaataaagaaatggtcactgtctataattcttacactgccacaccatttgaaacaggccacagagatttattactccatgagttttgtgaatattgagactcaaatgctatgtttgtacaaggaaatcacaaatcgtaactagaatacattcacttacatattacacctagagttcgttttctcattgttcttttaagtttttttctctgagtatgggtaggtaaagtatagcaaatttgttgcagaaaattaactgtgaccacattaaagacttgaaaccacactccaaaatagaaaaggcattaggaaaatattttgcttagaaggaatgattgttcttgtcttttcaattttttcttttaaatgtgcaacatgaaactactccttaccttgaaagctgtatggctgattgttgctgcttcccaacatcttcacccgttttaccggaatttcgcctctgctattttaccttctaagctgtgaacccttgtcatcctatttgaaccaccccctgccctcccacctccctgttattagcagtacatcaaagattggtcattggtcttgtctccctgctaattcatatcttgatgttcttgaacagtatttgaacagtgcccctttagaggaatatctaatgtcagtcatttcctattctgagttaagttaattgatctgataaattacaatgagcaagtgaatatagtgggtttaaaacgtatccgtctattctggatttgcttttgctctggagaaggcaaaaaggccaggaattagtgagtgacttagtcttctctcgtcattggcagctgacagacctactgatgaggtgataatgaactccaaagtctaccctaggagcaactgggagggaaaagaacccagacagaaggcatgtctcactttggagcctgccaagatttttgctttttcatagaattcatttcgaggaggttaacaggtagactttgctggatgcatgtcagaagtgtaacttatcattcatggacaccaaagacaaatatatattttatttctctcaacgtaacaagccagaggcctcagtctcagagacggtcactggggtaatccagtcagagagggagcatccgaaacaaggcttgaatataaagttcattttttaaaataactcttccttctttccattaaaattattatccaatacatatggtatgacagattagaccttccagaattatttgctactcctgtttatttgattcctagaatgttgcttagcggtctcaaacttaattggagataatgagtatacctaaggtaaatcttccaattttgtttccagttatgaatgttggtgaatctttccttttccaaattcagtttaggcctccactgcctgtttttcttcaggtatcatgaaagtgaatgaagtattttcaagtccattcatccccacctcacatgggcagtcgcccctcatacacatatattttgtagcccacacaggaggcaacttaatgtacaaaatgttttaagttaattactggaagtgtgttaaacatagaatattagtgagtttttaaagtctctgaactttaaaaataatcaactgtttgtagaaaaaaaatgaattattgttgatgactcagcgttccttatgtaaagacttggctttagtcttcaagaagctcttcagcttccctttttcggttttaggcagaacatggactttgagaagttttaaaaattctattattcccacccatgtttccctctgtctttaagctgtaataaaacgtatcaatgttctgggagtctgtattgctgaattgtcagggcctttcttgcttagtttcgcttgatgataaatttcaaggaacccatagtgcactatttttaaccagtttcgaggttgaaaaaatgctaagagtttgtgtccagaggtttggataacattgttaattgtgccaagtatccattgagtttggctttattctttatcctgtttaactggcattttctctgctgtaagaaaacagtccttaggagccacgacaactgattttattggtaaacatatgaatgaggcatgtttcataaaactttataaatttaatattagaaggacagaagtttgaccagacagttcaataaagacaattttatatatattttaactttctttgattccattcacttttcaaattagatatttcagattgtaattcttagaattgaccatgccatttattcctctttcttgaaagacaaatagaataaacaaaaatttgtagacatctaaagagtaatctaaggactatagttttgactcatttctttcatgagtatagtttctcttttctcttttataatataagatatgcacccgtttgtctattcattcctttttgcttctccaaacctgtttgcatctttggttgtgactcatttctttatttgatcaattgttaccattgtatacagtctctttagttggatatttgctgaagtcagataaaccttactggtttcagggatatgattgtggtatgaaactgccaatcttctactttgatgttcatgattcaaaaacttcttgttcctttggagaaaatgagcctaagttagtcgtcatcctggaaataagttttgatttctttttatgaaagaatgccaggaactttcaccagtttatctttgaatctttattttccaaaagtaaggtagaaaaatcctcaccgttttactgatttgcagactggtaaagtgaacaaggtgttagaatcaagacattttactcaaagaccactaatttaaaaaggtaagtcagaatctggcccaagaccttgacctctcaaattagatttaattatgaactgcattaagtcccattatttctcctattttgcttatcaagtgataacttctagtcagactgggataatcatgaatctacagtgccgaaggcattcatgacaaagctcaccctttgaagcagaaaagcaattcatctgtgtcaaaaaaggatgcaaactaagttttgatcctgcctgatagtaccattttccagctataccttgtccagcattctttatcaaagccagaaagactatatgcaagaagaatttagaacagactaggtactataattctttgtgtttgaaaggtgatattttagacgtagagacaaaaagtctcccttgagtttttgaaagaaattgcttgtaagggcaaatgttttaggttgaaaagttgatattttttagtttccctgtttatgaatagttcacagggtaatgttgtcagtcattttaaacttattatttctccctcttggaaaggttatagattgccaacagaaagtagaactccctgtttctgcgtgtttttctctgaaatagtgtgtgacgtagtcacattactccaggctcaattatagacagtttgtgggttttttttttaataatgccaaaaatctgtggataatgtataataagctgatgtacatcctactagaactgaggtatttcagtttgtgacaaattatgtcttaacatgttacctcgttaatagtcattggttcataaatgctggggattttaaatttaactctttttatacctaatattaaaaattaacccaatttaacattatttcatctaccacattactggccttgttttgattctaaatctcatgtcctaatttacaaattaccaaattaattcaaatgtataacctctttatgatttgaggcccactctggaaaagaaaaatactagacatttctattaaagtcatgagtgatttttatgtgtcttgtggatccatcccccagagtcttgtcttatatctttatgttctaacaatgaagtttttttaacgtacttttagcaaaatatacatatatttacacaagtattttagagttacctacagtaggatttagaggtcttttattcccatgattatataacattaaacaatatgtagcccccaaataaatttttctgtgggaacttcttcacgttgtctgcacatgacagttgatcttgggttgtttcagtactttccttggttttcctcctgtgtctttagccattccctagaagtcccctttttctctcccttacaactgatggtctctatgagtccacttttagctcccttctcttcttctatactttcttcccctatattttttccaaagtaatgttatctgttcagtggcatcagccgctattaatatatgctcatgacgtccaagtacaaataaatacacaagtggtttactctagcccatatctctgttcccaactttgggcccctatcaactgccaactgcacctgacagcttgaacattccataaacgacctcaacatacctaaaatcatctcatcattttttttttttacaaatatgctcctcagtatcttcatcatcaagaaatgtcgtttactcagttgttcaagccagaaactaattaaattgttcctaacaactttttttcccttgcctctcatagctttttcaacctttgagacatatctccacatcattttgcttctctcttcacaggaattattctattttatcactttgtttttgcaacagcatcttagctaatttgtaactaattttaccctttgccagtccttttcttctgcttcttccaggttaatacttggttgtttgtttgtgtttgtttgtttgtttttcctttggagatggtgtctcattctgtcacccaggctggagtgcattggcataatcactggtcactgtaacctcaacctcccaggctcaaggaatcctcctgcctcagcctcccaagtagctgagaccacagatgcatgccatgatgtccagcttaatttttttttgttagaagtgaagcctcacttcgttgcccaggctggtctcaaacccctgagctcaagtagttctcctaccatggcctcccaaagtgctgggattacagacatgagccactgcacctgcccttaatacttttgaaaacacgtgtatggtcatgttatttcctcttaaaattttccaaaggcttcttatcctttcaggataaaatgcagactccgaagcctgacgttgaaggttccccataatctgacttctcctgttgtacgccacgcccatgtgacctcacgtttctcctttctctctctttcgcttccccctcttgcctttttcctttctcccccctccccttttctccctcagttaagatgctacttcttccatgacaaatgatgctataggaggaagtcatttctttctctgcgtttgctttgaacctctcctattgctttgtcttttttttcttaccatggattaaaatatctgtgtacatgttttctgttgaattaggagcatctaattcagtgttagacacggttctacgtgttagcagtatcatctggaataagacagcctctgttcttggggagggagggtccttgtctttttcattcttggaactttttagaggtgatttgacaaataaataaatgtctatttaaaagttactaaaaaaaaaaaaaaaaaagccttagcgaccaggcacggtggctcacgcctgtaatcccagcactttgggaggctgaggcgggcagatcacttgaggtcaggattttgagaccaacctggccaacatagtgaaaccccatctctactaaaaaatacaaaattagccaggcgtggtggcacatgcctgtaatcccagctacttgggaggctgaggcaggagaatcacttgaaccccagaggcggaggttggagtgagccaagatcacgccactgcacttcagcttgggcgacagagcaagactctgaatcaaaaaaaaaaaaaagaaagaaaagtcttagaaaaggttttttttttctaaatttttcaatatagattcatctaataatctcaaaataattttataatagcctaaataaaatcaactacacacgtattaataatgaccttctatccctatttgggatgcaaagtgaggcaataactacaacaataataatatattgttttacgttttccatgtatatattctgaaagcctcacgagcagcctgtgagaaagctgctttcattatactcgttttatagttgaggaaagtgagtaattttcccaattatactaataaatgagaaggaacagatccgtaactttggtttccttttgctatctaatgttgctcttctagatcttacctagctggggaaggggaaaatgtgaataagataccaaaataagtggatgttaaagtaattcaggcaagaaattatgaattagggttatgtcagaggtggaccatgaagaaatattgaggaggtagaatgaacagaagatttaatgacaaagggatatgtggaatttgaaggaaagggaggagttaaagatgatttaagctaaaagctcccaggacttttgaccccacttttctagtgtgcttggtttctcctttaaaaagattctggagaatagtttaacagttcccaatggaagtaaattataaaagctgagatggcaatatttaaaccctagagccagcagcagtggattcaaccctgaagtttcaagcagtatcctttgttttatggctaagaaccagtatcatctgttatttaactaggaagtacaagttcacctttacaggaccaacattttattttcttctgtgaaatgcataaacaacataatacacgacaatgggaaaagtcagatagcacagaaaggcctataaggaaaagcaacaacacatctaccttttctgtccccctttccacatcctcgagtgagtgatcctttcagctttcttcactcaaaactttgcacttgctcttagctaaggctgagaagcaatcatcactcagaactttagactcataatgttattttttattgactccttgcaacagtcagtatttagcttacttaaattgctgcctgttttccctcactccttctcccagtttttgtattattattattattattattttatgaatcctcttcgttacctttgtaactttaaatcatacacttaaaactcttaatttctctttatcatcttcccacaggctctctgcctagtgacatgtaaaataaggttatcagtacctctactcttccttccacttttcttcccctcccttcttctctcttccccttccctaacttctgacagttgaatttttatttttattcatttacacaggacatgcagccatatcttaaagttgaagactcatcttgtccttctattttggaaaattatgaacaattctcccaaatactgttttctctaatattttgttctgcaactcctagtagacttagagtctctttgtcttttttacatgtctcttaatttatcttctcttttttatctctttatgtcttttatcctttatgttccatgttttgactaaattgctagtactgtctttcaattcactgattctgtcttcagctacattcaatgtactgtcccctgcttatttagtttttgtctgtaactttactcacatatttgttaaattttttattggagtgtatactatacctctgaaagaatatgtgtactgtcagtttagttcactatatttttgcagtctgaaaaatttatgtaacctgacacccaaatcaagaaacagaatattcccaatactccagaagccctctttgtgcttccctccagtgagtaacacctcccttgagtaatcactattctgacttctgaatgcatattttaattttacctgttttgtgttatatataaatggagttatcaaataagtactcttttgtgtctgggttctttcactctgtgttgtgagttttactcatgtttttacatgtagccaatagttctttcaatcttatcccataaggtatcatattgggtgactatacaatatttatttgtctagcagttatccatctacttacttattcactgttgatggagacagagcccatttagtttggggctctcacagatagtggtaccatgagcatttccagtgaagtagtggttcttgacccagggagatagtggggctgtcacagagacccactcacagagccggtagataccttggttctgtttctgttcttgaatccatctgcttgattcgttatgccctgatcctaacaaataattagtcattgggacaggaggtgagtacacgattgcagttcctggtgttaagcgatgagcctgtatcttctataaagtgttgttagtccccctcatccaggaggagtgagagttctagctccccgaggctgctttcggatccatattcctggcaggccatggtgtattttgcagctctgttccatttatgcaccacacatacgtttaagttgtatttgagcccagctgtagctttctagatctctccttatagtcattgctatgtattttatatctcagagcatgactttaccaaaccatcttaaccagaagtatttctttgaatctgaagactcctggatttcaggatatatttatgacttctttttttcttcctttgtttaagctcagaaaacttcttgtattacttctttggtcatttcctttccttcattttcactattctcaccttctaaaacttctagttgttggatttagatttctcttaaattttttactctgtattttttatctccttttcttcatttagttcttggttgggggaacaaaatatccttgactttatcttacagtacttttgaatttttttattttgctaaagagcattttaactttcttacaattggaatgttctttttcatagcctgctgtatctgttttgtagctttagcgtcttcttggatttctcttaagaaattgattagaccttttaaaaaaatgttcttctacttcctgaattatttgtgtttcctacagccttagttgttaaactcatgtatcttctcttttatttcagaggtttttcacgtattagtcaattcttcattgtcccttcatgtttaaggagaactagattgattgtggcacatggccaaactgaaattcctttggtggtgtttgcaggtttgcttccctgctaggcctctgctctgggtgatacagctgactagcagctttgtataaccggcagaacctgtccactggtagccgtctctttaggatggatggtgtggatccactgtcaggttggaggcaccccccaaatttaagaagaaaaaggatttattctgggcaccaactgtgatataagcagtcctggatcatttcagtagtttatttagtatcatagaaaagatcatttcaggtttctctgcttacttgttacaggtggggaaaataataaactgcatgtcctatgtaagagcatagggaggtgaggaggggaaaccattgcagctattcaaaatagacttgttttaaagcttttattttaagtacaggggtacatgtgcaggtttgttatgtaggtaaacttaggtcatggaggtttgttgtacagattatttcctcgcccgggtattaagcctggtaccctttagttactttataattcgtcctgatcctcgtcctgatcctcgtcctgatcctcgtcctgatcctcgtcctgatcctcgtcctgatcctcgtcctcctctcaccccccctcctccattaggcgccagtggctgttgttcccctctatgtgtccgcgtgttctcatcatttagctaccacttacaagtgcgaacatgtggtatttggttttctgttcctgtgttgtttgttaagggtagtggtctccagctccatccatgtgcctgcaaaggacatgatctcattctttatttatggccgcatagtattccgtggtgtatatgtaccgcatttttttttttttttttttttgagatggagtctcactctgtcgccaggctggagtgcagtggcgcgacgtcggctcactgcaatctctgcctcccaggttcaagcgattctcctgcctcagcctcccgagtagctcagattacaggcacgtgccaccatgcctggctaatttttgtatttttagtagagacggggtttcaccatgttggccacggtggtctcgatctcctgacctcatgatccacccatctcagcctcccaaagtgctgggattacaggcgtgagccaccgcacccggccccacattttctttagtctatcattgatgagcatgtaggttgattctgtatctttgctattgttaatagcactgcagtgaacatacacgtgcatgtgtctttataatagaacaatttatattccttttattatgtacacaataatgggattgctgggtcaaatggtatttctgtctttagttctttgaggaatcatcatgctgtcttccacaatggttgaactaatttacactcccgccaacaatgtataagtgttcaggttccttttcccacaacctcgccagcatctgttatttttttactttttaataatagccattctgactggtgtgagataatattgtggtttcaattttttctctaatgatccctgatgttgagcttttttcatgtgcttcttggccacgtgttatgtcttcttttgaaaagcgtctgtttatgtattttgcccactttttaatggggttgtttttttcttgtttaagctctttatggatcctggatattagacctttgtcacatgcataccttgcaaaaatttcctcccattctgtaggttgtatactgttgaaagtttcttttgctgtacagaaactctctagtttacatagatcctgttcatcaatttttgcttttgttgcagttgcttttggcatcctcattataaaatctttgcccattcctgtgtcctgattggtattgactaggttgtcttccaggttttttatagttttgggttttacatttaagtgtttaatccatcttgaattaatttttgtatagggtgtaaggaagggatccagtttcaatcttctgcatatggctagccagttaccacagcatcatttagtgaatagggagtcctttccttcattgcttgcttttgtcaggtttgttgaagatcagatagttctagatgtgcaaccttattttggggctctctcttctgttccattggtctatgtgtctttgtaccagttaccaggctgttttggttactgtagccctgtagtatagtttgaagtcaggtagcgtgatgcctccaggtttattctttttgggtaggattgccttggctgttggggatcttttttggttttcatatgaattttaagatagttttctagttctgtgaagaatgtcattggtagtttgataggaacagcattaaatctataaattgctttgttcagtgtggccattaaacgatattgattcttcctatccatgagcatggaatgtttttccatttgtttgtgtcatttctgatttctttgagcagtgttttgtagttcttcttgtagagatctttcacctgcttggttagctgtattcgtaggtattttatactttttcaggcacgtgtaaatggaattacattcctgatttggctcttggcttgactgttggtgtagaggaatgctagtgatatctgtatattgatttcgtatcctgaaagtttgctgaagtttttttatcaccttacgaagattttggaccaagacgatggggttttctagatacaggattgtgtcatctgcaaacagggatagtttaatttcctctcttcccatttggataccctttatttctttcttttgcctgattgccctgtccaggaccttcaatactatgttgaataggagtggtgagagagggcatccttgtcttacaccagtttttcaaggggaatgcctccagcttttgtttattcagtatgatattggctgtggatttgtcataggtggctcttattattttgaggtatgttccttcaatacgtagtttattgagagtttttaacatgaagcaatgttgaattttatcgaaagccctttctgcatctgttgtgataatcctgtagtttttgtctttagttctgtttatgtgctgaatcacattgatttttgcatgttgaaccaaccttgcatcgtagagacaaagcctacttgatcttggtggataagccttttcatgtgcttctggattcagtttgtcaggattttgttgaggattttgcattgacgttcctcaaggatattggtctgaagttttctttttttgttttatctctgccaggttttgatatcaggatgatgccgacctcgtagaattagttggggaggagtccctcctcctcaatttatttgaaatagtttcaggggtaatggtaccagcccttctttgtacatctggtagaatttagctgtgactctatctggtactgggcttatttatttactgtttatttatttggttggttggttggttggttggttggttggctatttgtggcttcctcaatttcagagttcattatgggcctgttcagggattcagtttcttcctggttcagtcttgggagggtgtatgtgtccaggaatttatccctttcttctagatttcctagtttacatgcataaagttgttcatatattctctagtggttgtttgtatttctgtgggttcggtaataatatcctttttgttatttctaatcgtgtttgtttggattttctctcttactagcctatttagcagtttattttattaatttttttttaaaaaataaactcctggactcattgatcctttatatgggttttcatgtctcagtgtccctcagttcacctctaatttttatttcttgtcttctgctggctttgaggttggtttgctctcggttctctagttcttttagttgtgatgtaaagttgttatattgagatctttctaactctttgatgtggacatttaatgatatgaacgtccctgttaacattgtcttagctgtgtcccagagattctggtatgttgtatctttgttctcattagtttcaaagaacttcttgatttctgccttagtttcattatttatgcaaaagtcattcaggagtaggttgatcaatttccatataatggtatggtttcgagcaaaattcttagtcttgatttctaatttgatcatgctgcggtctgagagagtgtttattatttcagttcttttgcatttactgaggagtattttctgtccaattatgtggtcagttttagagtatgtgccatgcgaaggtgagaatgtatgttctgttgcttttgggtggagaattctgtagattcctgtcaagtccctttgatcctatgctgagttcaggtcctgaatatctttattaattttttttttttttgagacagtcttgctccattgcccaggctggagtgcagtgatacagtctcggctcactgcaacctccgcctcacgggttcaagcaattctcctgcctcagcttcctcagtagctgggactacaggcatgcacgagcatgctggctattttgttctgttttgttttgtttttgtatttttggtagaaacagggttttgccatgttggccaggctgatctcaaactcctaacctcaagtgatctgcccacctcagccttccaaagtgctgggattacaggcatgagccactgctcctggccttaatctttgatctaatactgttagtggggtattgaagtctcccactgttattgtgtgggagtctaagtctctctgaaggtctctaagaacttgcttcctgaatccgggtgctcctgtgtcaggtgcatatatatttaggatagttagctcttcttgttgcattgaaccccttactatttagtaatgctcttctttttcttttttttttttaatctttgttggtttaaagtctattttttctgaaattaggatgtaatcctgcttttttctgtttgcttcgtagatttttctttatttattttgagtctgtgggtgtcattgcatacgaaatgggcctcttgaagatagcacactggtgggtcttggttctttatctagcttgttgcttggtgccttttaataggggtatttagcccatttacattcaaggtttgtactgatatgtgtggatctgaacctgtcatcatgatgttagctggttattatgcagacttgtttgtgtggttgctttatagtgtcactagtgtgtttacttaaatgcgtttttgaagtggctggtaatggtctttcctttccatatttagtgcttccttaaggagctcttgtaaggcaggtttgatagtaatgaatttcctcagcatttgctggtgtgaaaaggatctgatttttccctcacttatgaaggttattttgtccagatatgaaattctggcttggaatttctttaagaatgttgattattggtgcccaatctcttctggcttgtagggtttctgctgagaggtccgctgttagtctgatggacttgcctttgtaggtgaccttaccttaccctctagctgcctttaacatttttttctttcatcttaactttcaagaaccttatgattatgtcttgaggatgttcttctcatgaaggatctcattggggttctctgcatttcttgaatttgcatattagtctctctagctagggttgggaagctctcatggatgatatcctgaaatacgttttcagttgcttacgctctccccatctctttcagggataccagtcattcatagatttggtctctttatataataccacatttcttggaggttttgtttattcctttatactctcttttctctattattgtctgacttccttatttcaaaacgtcagtcttcaagctctgagacactatcctcaccttggtctattctgctgttaatacttgtgactgcattatgaaattcttatagtgtgtttttcagctctgtcaggttgattacatgttttttctttgctggctattttgtctgtcagctcctatattgttgtactgtgattcttcgcttccttgattttgtttcagcatactcctgcatctcaacgatctgcattcctatccatattctgccttctgtttctgtcatttctgccatctcaacccggttcagaacccttgctggagtggtggtgcagtcattttgaggaaagaaggcactctggctttttgagttgtcaagagttcttggattggttctttcttatctttctggggtaatgtttgttcaatctttgaacttgctgacctttggatagttttttttttcttcttcttcttttacactatttgatgaccttcagtgtttgattgtggtataaggtggattcagccaactgactgtttctggaagactttagggggccaacactcagctctgatcttctagactgtgtgctctaactttgggggacttatattgggcaatgactttgttctctggctcctctgaggttaggagtccactgtgctggtggggccgaagtgctccacgatcactggtcactacactctaatgggtggtgtctgccaaagtgcttcatagtgtggcggcagcaggatccgtcctcatttgcacatgccagcaacagcagcagcgcagcagagtgcacgctggacaactgtgacagggtgctagcaggtgccagggtgcctgcccccatgtaggcattcaccgcagtggcagaggcagctcagctggacgactgtgacagggtgctagcaggtaccagggtgcccgcccccatgtaggcattcactgcagtggcagaggcagctcagctggacgactgtgacagggtgctagcaggtgccagggtgcctgcccccatgtaggcattcactgcagtggcagaggcagctcagctggacgactgtgacagggtgctagcaggtgccagggtgcccgcccccatgtaggcattcactgcagtggcagaggcagctcagctggacaactgtgacggggtgctagcaggtgccagggtgcccgcccccatgtaggcattcactgcagtggcagaggcagctcagctggacaactgtgacagggtgctagcaggtgcccgggtgcccgcccccatgtaggcattcactgcagtggcagaggcagctcagctggacaactgtgacagggtgctagcaggtgccagggggtgccagggtgcctgcccccatgtaggcattcactgcagtggcagaggcagctcagcctggggggccagagagcccttgctggtgactgtgcatgtgatatcactggtggttgtgttaatacggatgtgggttactggtggggacaggtctctgtgtgccccaggcaggggtggttgctcagggttggggagggtctgctgtcctctgtgcctggtttcactcctgtggcagtgttggcacaagggcagggctggctggttctgtgctcaccaaggctccaactgcagtgacggtccagcagaaggggaacaggtggtagggtgcacacacacatgcacactggcagggcaaggaaagcaaaatctgtccacgtacacatgtgctggcaaagagatgtggaggcttgctgtaggcctgggggaagctgtaatgtgtggagaaagcaggcaggcctggtgcgtggccagcgtgtgaccgtgggggccagcctgcttgagttctctgccagtcaggcatagttccccagcacaggagctataatgacagcctccggggtacccaaggctatcctgcaagcaggcacagctaggctgtggtccctagagagtccagcagaccaagaggtgctcaggttggaccagccccatctgatgggcaagacctccagagttcaggtcttgcagaggttaggtccagttgttcccctggggctaaagtctcctatgggagcaagtcaagcctagggagatgggcttccctagccatgctccactacagactctaccacaccaaaccctctgggttccacctcagctgacgcgctgcccttgcttctctaagcagctctccctgccaaatcggtgtctgtggtagatgaggggtcatcttctgctggaattccagaggcccgtagcaagaacagattactcttcgtgagtacaactcgctcattccctcagggtcgttgggggctaggaacgagtccctgtgtgcagtagcccggtgcagcgttcccagcatcctcccctttcagcctgcttctgtgtgttccctccatccactctcactgccttccctctgaaggtctgttgtgccagtcagctcggtttctcgctggcagctgttccacctggctgcttttagtaggctttagtgcccttcccctcttttttaatatagagacagagtctctccatattgccgaggctcgtttccaattcctgggctcaagcagtcctcctcccttggcctcccaaagtgctgagattacaggcatgagccactgtgtccagcctagtactctcttttaaggatgtgttttccagttcttgttattttcattctaaggggtacattgccagtatattctaccttcttccaaaggaataaatacagattggtttaaaacatagaatattaacatttctatttttccttgaatgtccacttattcttttctttttcttttttttttttttttttttttttttttttttttttttttttgaggcagagtcttactctgtcgcccaggctggagtgcagtggcgcaatctcggctcactgcagcctccgactcctgggttcaagcagttctcctgcctcagcctcctgagtagctgggactacaggcgcacgccaccaagcccggctaatctgttttgtattttcaatagagacagggtttcgccatgttcaccaagatggtctcgatctcctgaggattataaatcatgctactataaagacatgcacacatatgtttatttcggcactattcacgatagcaaagacttggaaccaacccaaatgtccatcaacgatagactggattaagaaaatgtggcacatatacatcatggaatactatgcagccataaaaaaggatgagttcatgtcctttgcaggcacatggatgaagctggaaccatcattctcagcaaattatcacaaggacagaaaaccgaacactgcatgttctcactcataggtgggaattgaacaatgagaacacatggacacagggaggggaatatcacacactggggcctgtcatggggtggggggttgggggagggatagcattaggagaaataactaatgtaaatgaagagttgatgggtgcagcaaaccaacatggcacatgtatacctgtgtatgaaacctgcctgttgtgtacacataccctagaacttaaagtataatttttaaaaaaagaaacttgaagctttgggatcagcctggaatatttttcataaattctgttgacagtttcttgctgaatcactttgaatggatattcaaaacttcgtttgaacttaagaaaaataagaatttctttttgtatttcactgaatggtaaacagtttctactctcttctgggaattcatagatgaaaggggatggtttttacctgtccaaatctatggagaaatacacaaaacaggagattatattaataatatactataataatataaaggaagtatgaacagctttcagtgggagcttgtagagagagtttttcctgaaaaagtcaagtaaagataaaattcagtaagcaaaaagttaatgcgggccgggtgcggtggctcacgcctgtaatcccagcactttgggaggccgaggctggtggatcacctgaggtcaggagtttgagaccagcctggccaatatggtgaaaccccgtctctactaaaaaaatacaaaaattagctgggcatggtggcacacgcctgtaatcccagctacttgggaaactgaggcaggagaatcgcttgaacctgggaggcagaggttgcagtgagccaagattgcgccatcgcactccagcctgggcgacaaagagcgaaactctgtctcaaaaaaaaaaaaaacaaaaaaaagataaagcaaaaaatgcagggatagagaaaccatggcaaaaggtgctaagtgctgaatttaagtgtagaacctagactcaatctgagaggacatcatcccatgtctgcctggtattgtacagaccctcctagtcttttagctagctcttaaaggataaatcagagaagagagcgttgcgcgtattcttagttgataaaatagcagatgaaaagtcacagaggtatgaaatattaatattaatgtgtatttgaggaactataagaaatttagtattgctagagcaaagaatgtttgaggagaattttgaggaaaaggctagaagggctttctatgccatgccactaatttaaattgctattctatagcaaggaagtgatgtgatccaatccatatttcaggaagatcgtgctgaccctgtaatccattacatgaatgcagacagtaacactctcaaaatttattaaacacacttaatgaaataaataccagtatctatgttatctgccttttttgcctgtcactcatgcggtcctcacaactccttccagcccctaaactaatcagtccgggcattagagagctttgaaatgtttattaagaaaacagtcctgttttgacagacaggagttagagcacctggacttaaagcaggctttacagctctactggggatctctcatgtaggcaacatgaggccagcagagccctgtgcaaacaggcatcataagcaaatgaccatttcttttccattatagacttcatccttcaaaagggagtgccattcgtcccaactagtattttccccccttttatctgtgtcactaatgctaaattagttcatgggtcattcaaattctagcagctttggtgttagtctttatatttcagttccagtgctccgctgattattttggcatgaaactatcccatacagtcatcatgctgcttttaattcaaaagattcctatgagctgcaccaggaatatcgtatctagtacaaaaactgtatgtctgttcttccctgaagcagattctcttgtaacttgagtttagttatcttagtattgatattgagttatttttagagagttctgtggtggttagtggctcggtgttttcatcagtcgttcacttaactatcctttcggaacatctgtgccacttacgctgtctcacttctcacccaagtcttagatgctttttcattcttcatattactaggaaagattaaacacatcatataatgccagtgactgcaggactttcctttaaagcttctaaactacctgccagtatgctgaaataaggtatattctgaagcttatcgtttaaattgtagatttcatatgtaaaaacattttttttttttaagacagtcttgctctgtcacccaggctggagtgcagtggcgcgatctccgctcactgtaagctccgcctttcaggttcacaccattctcctgcctcagtgtcccgtgtagctgggactacaggcacccaccactgcacccggctaattttttgtatttttagtagagacggggtttcaccgtgttagccaggatggtctcgatctcctgacctcgtgatccccccacttcggcctcccaaagtgctgggattacaggcgtgagccaccgcgcccagcctgtaaaaacattttcatctttgtttataaataaaacatctgattatacaacaatacttttatgggactcaaagaggggagtcagggttggggtggggtctgtcatttatttacttatttttaaaagatacctggcctggttctgtggcggtggcttttcttcgctaatcatgagctgtactttgagtatgcagtagattccgtcagcatctcagtgggagaaaggggggaaagaggggttttaacacagtgttctctttgcattgagtgaagaagctgttgatctctgaaggaggaaaggagagactggaaccacatgaaggcttgtgctgtgaaaccctgaaaccctgacggtgccttttgatcactgtgttttaacaaagctgacaatcctcagccacacaaatcttgggaactaaaataagtattcatttaactcttgactaaaggttaaaagatacagttaaaaagaaatctaaaacccagagtggtaattccactttttctttctctttctgttgttggaacctgagctctctaggaaaactaacatttgttaagggcctgccatgtgccagattcctgtctgtaagagaggtataattattattttacactatctcaatcttaataacaactccgttaagtttacacatttatatttccatttgacagttaaaatcaaggaagttcaggaagctgcttgtctagggtcatacaactagtaagcggcactgtccagctccagaacacatgctttttcttgtgtattttagtgctccttcagtcacttatatgatttacttatttgttattcttttataaatttaagcagtagtacaaagtagaaagaataaagaaaaaaacagcccccaagtcaattgcctagaaaataatcattatttgtagtaggtaagcaggattcctgtcatattcctatgcacatatagaaaaaaattaacatataacatgccattttaaataaaaattgaatttaattttacttgacattagcagaataaagagaatttcagtagaatatttcttctttttttttttgagacggagtctcactctgtcgcccaggctggagtgcagtggcgtgatctgggctcactgcaagctccacctcctgggttcacgccattctcctgcctcagcctcccgagtagctgggactacaggtgcccaccaccacacccggctaatttttgttctattttttagtagaaatgggatttcaccgtgttagccaggatggtctcaatctcctgatctcgtgatctgcccgcctcggcctcccaaagtgctgggattacaggcgtgagccaccacgcctggccagaatatttctttactataaaggagaattcctaagccatccttccaagtttaagaaaagagatagagattggggttatgttttacaacagcatcttttatttttattttaatcagtattaattcatgccatgctctaaaagatgaagaaattatcacttcttctcaccagtttttaatgatatagttttatatcagctttaccaaggtttataatatttacatcttattttataactcccaggctacttagtctgggagttaaattcagcacttaacaccttttgccacattttccctatccctgaattttttgctgtatcgttttgcttatttaattttatcttcacttgactatttcaggaaagactgatgctgaattctggttttcttgttttatgtttgcatgcttgatagtgtttatttgccattctacttgaagtattacttagctagttacgaaattcttaggtgtgttcttctaatgcagagtggatgaatgttcccggatgctctcttcctgccatcactgcatctgatgttgcccctctgagttagaacagaagggccaggaattgacttcagcctgcttttctataacctgggaaatgtgaggagctaggactattctcagctggatctccactgtctttgtggaaggcctggactcaagtttttgttgtttgtttgtttgtttgtttttcctgaaattttgataaatatcctgtattcatcctggtaagcatgagaaggttcagatcgtctgtgaaattctttagagattgctagaaaacagcatatcctagtaatttttcttgcctttatgaggttgccatagttaaatgttttgtcctgactcatctcttaaaccaccagtccacccttttccatctgtttttctccacatttggggatattactgggaattctcacagttttatcacctcacttctgaattgcttctgggcttagaatagggtaaagagcaacactatttttcaccaaaatttttgttgattttattacctgcagcccaacacaaaaatactgacaaacctttcatttctaggagaacaactgattgaccctaatagaaaaaatagactctatcagtcaggtattccagtgtataggaaacagcgtgttgtgacatttgtttatttaagagatgatggttttcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggtgtgaacccgggaagcggagcttgcagtgagccgagattgcgccactgcagtccgcagtccggcctgggcgacagagcgagactccgtctcaaaaaaaaaaaaagagagagatgatggttttcaggttttttgggttttgtttgttttgatcctttgaggatggtatgttgtagtccagagaaggtatttagaattgtgacaaggtaataaaattgagacaaacacgattatttatctttgtcgagagtcactcctggcaattttcacatggaccttcgttgaaatgcatcattgaaatactagcgtacattttaggtattttactgtttcacggtatgcttattagtcagtgtaaaatgcatcctaatcaaaattaactactttgaaaagggaagttgatcgcttcttggccatttggctaagatcaactgaaaagggaagtagagataatatggtacagcaatttatttttaaaacaattagtttttttaaactgacaaataaaaattgtgtatgtccatcatgtacaacatgatgttttgaaatatgtatattttgtggaattgttaaatcaagctaattaacatatcattatctcacatgcttgtcatttttcatggtgataacacttaaaatctatactcagcaattttcaagatgtagtaatttctatatagagaaaatctgtagaactcaggattgtctattttgaaggttcttaagatgtatttccaagaaaatacagtataaattttgtgattgataccacttttcatgctagccacataaattgtcctttttgctcccaggttaagaattcaaggcttacaaaaatgaacacaaggctgggcacagttgctcaagcctgtaatcccagcacttgggagaccgagacgggcagatcacctgaggtcaggagtttaagaccagcctggccaacatggtgcaaccccgtctctactaaaaatacaaaaattagccaggggtggtggcgcatgcctatagtcccagctactcaggaggctgaagcatgagaattgcttgaagccgggaggcagaggttgcagtgagcagagatggcgccactgcactccaatctggtcaacagagttagactcggtctcaagaaaaaaaaaattataattgaaaatgaacacaggtttcttgtatgtctctccacttagttgattctctagagtgtggtacattttacaatgtgttgtctgcagtgtttatttacattgtctggcatgctacaaaggttggtagcatttgctaataaggaaccactatgtgaccagtgtaaatgatctaccagtgcctcttcctggtttcgatttctttcctagcaaaatacgggtataagaagtgaaccagacgtctttaagaaagagtatgtctgctactcttgtttccaaaagtgtttatatttattcattaaagaacttttgttactgaattctttttaggaaacttagtgaaccatacactgcctgtatggccaatgatgaagaatcagcttaaggggaaaaaatgtataatgtccagccaggcgcagtggctcacgcctgtcatctcagcactttgggaggccgaggcgggcagatcacttgaggtcaggagttcgagaccatcctggccaaaaccaacatggtgaaaccccgtctctaccaaaaatacaaaaattagctgggcgtggtggcaggcgcccatagtcccaattactcgggaggctgaggcaggagatttgcttgaacctcggaggcagagcttgcagcgagccgagattgtgccactgcactccagcccaggcaacagagtgaagactccatctaaaaaaaaaaaaaagtataatgtctcacaatataatgcaacaagatttcctactcaggacttacaaagacctgtgtctcttaaaatacacgggtcaccggaatgtaggttttttggtaagtgctgagcattcctatattcatttccttcctctgttttatgattcactggaaagcttcaagccttgaaatatttctgatttgatttttgcaatatactttttcttcccattgccatgctcgtatttctgcacacctcatgtgcttatacagtccaatcattttgatgacttggggaggtgtgaagaggctgagctagacttcatattttctcctgtcccgtgttcttattgtaaaggaatgtagtaatgcactgtgtcttttttgtgtctgttgttggctacatgtcctcaaaacatattcaacaagtagacgtctattgaaaagaaattttcctaagttgtccccaagaaaacgacgacactggagtcagttccgtgtttataacagagtcccaacacttgtttttctccagggtttctacaagaagaagcataaaacagtgttagtatgtgactgacctttggcttcaaggcttcagtaaatccgtaaagtgagattgattaggattaatagctttttgtcctagctaaaaagtgttcgagatcttggcttaaaaagagttctttttggccgggcacagtggctcacgcctgtaatcccagcactttgggaggccgaggcgggcagatcatgagatcaggagtccaagaccaccagcctgtccaatatggtgaaaccctctctactaaaaaatacaaaaattagccaggcatagtgccatacgtctgtagtcccagctactcgggaggctgaggcaggtgaatcgcttgaacccgggaggcagaggttgcagtgagccgagatcatgccactgcactccaacctggacgacagagtgagaccgtctaaaaaaaaaaaaaaaaaaaagttatttttgataccttggaatgtgttggccgttttaggtgcttccagcattttattcaaagagttgagaacataaaaggatagcttgattatacttagaccttaaaaaacttttaggagttcatcaaacacataacctttacaactggttagacttccagctttcctaaacaagagtatggcactcttgccagtgttggtttaaagtacatgtaatttacataaaatagcactgactgcagcctaggtctctaagcagagaatgctctgacaactttgtctccaggtccactctactgttccttattgaggagggaaaccaggttcacagtgttgtgctttcttcttttggcaccaaaaggggctcctcctggtttatgagttttaaaggatgagggaaaaattcatcatgggggatgttattttcctcagtgggtaagtgaagtcagggaaaaacagaaaacaatggagataagaggatgggatgcgttcagtttattctgttgttctcaccacagtaattgactcagaagggactcattctgaatttagtatctagtgttaaaagaacaggcctggggcaggcggaggccagcactgagacacagtggtgggttgagacctattgtattttttaagttgttccaaggctgtccaggtgtcctgatttaaagcctgcttcttaagtcaggaaattgtatcttgttctgaggtttactgtaataaagtacacagtcctaggggatggtacttctggctccatgaatcactttacaggctggctgtactgacccaagcctcatgatttatttatgccataccacagtaggaatggcaaatatgtaagccacacatggtctatgggatgggcctttaactgggaaactgccataaatccgtgaagtcaggtaggacagagccagcaggagctcatgtcgtgtacaagatttcttcctgttttatagggacttacagttctagagctaattaagttcatcctccttagagtgtatctgtcttagtctgttgtgtgttgttataaaagaatatctgcgcctggataatttataatgtaacaaggtttatttagctcatggttctgtgggctaagaagttcaagggcatggccctggcttctggcaagggctttcatgctgcgtcacaaaacagcagagaaggtcaaaggggaaggggacacatgcaaacaggagaacctgagggtccatcctggctttatcacaacccactctcctgggaactaatctgttccctgcaatacctaatgcagtcttgtcagagtgggaactcactcactaccacaagatcagcaccaagccattcctgaaggattcatgcccctgtgacctgaacacctcccatcaggccccacctcccaacaccatcatactgggaatcaaatttcaacatgagttttcgtggggacagacaaaccatatccacaccatagtgatatccttggactttttgtgtgctgtgtttatccagtctttgatttactgcttacaaatctaaagaatagctctgaaatatagtctagtcctattgtcactgatattttctcttcgatttatttctataaagtgttgcccatgtttttcaaataatttctatgttttgagtaaatactaaggagtgcgatggccagatcttaagagtatgtttagttgtgtacagaactgccaaactgtcttccaaagtgctgtaccattttgcgttcccaccagcggtgaatgagaattcctgttgctcagcattcttgccatcatctggtagtgtgtgttctggattttgtccattgtggtaagtgtgtagtggtatctcattgttctcatatgcatttcctgattacgtatgatgtggagcatctttttgtatgcttatgtgccatctgtatatattccttggtgaggtgtctgttaaggtctctggtgcattttcttccttttatcttgttttatttttgttttttataatattttcaatttttaattgatacaacataattgtacatatttatggggtacatagtgatgttttaatacatgcagtgtatcataaggcccattttttaatcagatcatttattttcttagtgttgaattttaagtatcttttgtattattttggataacagtcctttatcaaatgtatcttttgcaagtattttctcccattctgtgtcttattttctcattctcttaatatttgaatatttaaacacatattatttataaattaatggtacattatttataataatggttaaacggttggtaagtaaatcactgctgagtatatactgctttgaagggcccaaggatccattaggcctccagctttaacccagcacagcattctgaaatacccaattctccccagagtttcaagagtcaccaggccttaaccttcttattgcctcaaggactcttagagctcaccaggctcctcctaccacaagccttcatcatatcaccctgttcctgttgcttagggagctttctcaggatagcatttcaagattgagtacccatcctagttttctcagtgttccttgtgagccgtgtcacatagaaggcatttaataaatgtgtgctgaactgagctgaaccagcaagggcaaaagggatttaagagactgccgttttaattgaaaaggagtaaaaagacactgggaaaggcagcatgtattgggggaatatgagaaatttccaaatcactggaccatcaggctggaaaatttaggttggagccaaactgcaaatggtttgaatgtcatcatgtatagtttatgtatttatatatacttacctttctcatagaagggtgaatttttatattataatagctagaatgttcttagaatttatcttcttaattcagaaaacatcacattgagatctgtcagtaaaccccccacacacacaaataatttcttgtcctcattgaccttcggtctgagctcttaatgcagttttctctactacacttgtccatgcacatagtggtcgcagacatttgagagaatgaaaatcatgtgtttaatgagagattgttatcggagactgtagcacttgttttactttattctttctattgctttttctctttttgtttctttcaaagtacatacaaatacatattcattatatcctatgtaagggaatgtgtatttactctagaataggactactttaagtttgagatggctttttgcttttaaaaatatagatgagtgtgatttaggcatgtatattcagtcagatcttttagctctcaccttgataaaattattgggtacgagaagcaatcaagtcttcttttcttttcttttttttttttttttttctgagatggagtctcgctttatcactcaggctggagtgcagtggtgtgatctctgctcactgcaagctccgcctcccgggttcacaccattctcctgcctcagcctcccgagtagctgggactacaggcgcccgccaccacacccagctaattttttgtatttgtagtagagatggggtttcaccgtgttagccaggatggtctcgatctcctgacctcgtgatccgcctgcctcggcctcccaaagtactgggattacaggcgtgagccaccgcgcccggcctacaaataatgctttaacgctaaagagacaggagaacattttcaaatattttaaggacagttatttgaaagaatgaatttcttttatggagcttaaaggaatagaactagggttacaaagagacagctctttcagtcttaataattatgcaggataataaaaaatataaataaaacttaaaaacagagagcttttgggatcagttctataagtaatttcctaagaggttgtcaaagctggtataggcaccagctcattcaatgtgtttaaacataggctggggggccacttggcagccatgtggtgtggaacacaagcaagccgtgattttcatgaatggatctgttctgtgaggtctcttgttatgctaagagtttgtgattctggttttgttttgtgtgatcttgaaagactgatttatgatctctttccacttgtttactgctgtttactgctcagcccattgcaatatagcttctgcctccagccctgaaactaccctccaaagtagtaactttcgaaaaactaaatccgatggaaattttgtattctttatcttgacctgcctgtgaatctttaacatgttttatctcttcttatttctggaaactttctttatctttggcttccaggggaccaccttctttttgttttctttttcctctaagaccattccccctcagttcttcatagacttcttccaccagtgctgtgtgccccgcctcttatcttggtggtctcgtgtcttatcttggtggtctcatgtactcctgtgattttaattactttcagtgctgatcattcccacgtagtctttaatcgggtcctgattgcaggactgtcagtacaactgcctaccaggtatctccccagattcataaggttgatgtaaagattaaattacttagttaaggccaggtgtggtggctcatgcctgcaatcccagcactttgggaggccgaggtgggccaatcacttgaggtcaggagttcgagaccagcctagccgacacggtgaaacccctgtctactaaaattagaaaaaccagctgggcatggtggcaggcacctgtaacaccagctactcaggaggctgaggcaggagaatcatttgaacctgggaggcaggggtttcagtgagccgagattgccccgttgcattccagcctgggcgacaagagtgaaactccatcttaaaaaaaaaaaacttagttgaaggtgcctagtagaatatctggctctatagtaatcatgctggcaatgctaattatagtgagtgtttacccagttcattcatactcttgaagaatcatttatttatccttttcttgggtcagggcgcaacagagccttgctctgtcatccaggctggagtgccgaagcgcagtgtcggctcactgcaacctccgcgttctaggttcagttgattttcctgcctcagcctcccaagtagctgagactacaggagtgcgcccggctagtttttgtgtttttgtagagacggggtgtcaccaagttggccatgctggtctggaactactgacctcaggtgatccgcccacctcagcctcccaaaatcctgggattacagcagtccgcccactgatttatctttaaatcaccacttcccaaactgttttctcttgtactagtatccctcaaggtggtaagtgatgttccacccagaaaagagagaaggtggggttccatgatcagttaagtttggaaaatactttataggtagggttggaactttttcaggggccagattgtaaacttactgggctctgtgggccatttggtctctgtcacactactcaaatctcttgtagcaccagcgtagccatagaaaatatataagcaaatgagcaaggttttgttcactaaaattttatttgtggacactaaactttgaatttcatataattttcacaaaatgtaattattatatgttatatgctatattatttggggttacaaaagtattattattttcttttttttcaaccatttaaaaatggaaaagccattctttgctcatgggccatgggctggctttgaccatgagtggcagtagcttgctgattcctgctttaaaatatagccccctattaaagatatgcaacctacaccataaaaagcttttctaagttctgcagcagtgctgttatgaccagtgttcctcaaacatatttgaccgtggaaatcttttgtcatgcttatttgttactgtctcttgctgtacttctgtggaatgtgcttttgagaaatactgacctagagaatagctatgtatgccagaggtaaagtttggcctgtggagcagactgtaaataacaagagaaagcgtcttgtctttattcctcttgctctgatcgtcagctccaactggtcacagacagaatggtattttgggaaactgaattcactctacgaggtgggcaccagtgaaccactaaagctgagtcaaagattagctgaattgagggtggacatgatgaagttaattccgtcaaccagcttcagaaatgggaaaaatggctttaacgtaaggtaaaatagaggtgctctaagtgagataaaatactcggtcctggctgggtgcggtggcttacacctgtagtcctagcactttgggaggccaaggtgggtggattgcttgagctcaggaattcaagaccagcctgggcaacgtgatgaaaccctgtctctacacacacaaaaaattagccaggcctggtggcacatgcctgtggtcccagctacttgcagggctgagatgggaggatcgcttgagcctaggaggtcaaggctgcagtgagctgagatcacaccactgcactcctgcctaggtgacaaagtgagactgtcaaaaaaaaaaaaaagtgtgtgtgtgtgtgtgtgtgtgtgtgtgtgtgtttatatatttatattccgttgaggaagaagagatccagaggtcatatgcaaaatataaacagtaataggtatcaatttctatagttttgaaatctttactgctgttgttttaaaatatgcaaaagtttaaaacttaaaaaattgagtttatatataataaaattctaaaacttgctttgaaataatattttcagttgctgtttttgtgtgtgtgtgtctttgagaagtaggatgtgtgactcagtagggagtaaaggttattgctttactattttgagcatatttttccctaataaaaataatgccatagctaaggagagaaccttcaaattaaaaacaaaaacactttcattttaaaagtctacgcttcccatctttttatgtctactttaaccgtatgccccttattaaaaggaaaaattggtgtagtaagcattgtttttaaattctgtctggcatttggcaagcagctagaacctataggaggatgcagaaaagatgggaccatcccagctgatgagaatttatctacctgatgcaggcatagtcattgcccattcccacagaatttacataccaggtgtctcattccaaacctgtgtaggagaaaagggactcttatagtttttgccaacagattgatagctgatgaataataaaattgttgaatcattaatgcaagaaggtaataaattaccgggtttgttttcatccatttggccaacaaatgtttttggtgacctccaagatctcagtagccccaatgtcttcagtactctctcagcatcccagcatgcactcatatatatccctgacagctttcataagcttcctatacagctataggagtatatctcggatacttacgcattggagcagctcctactttttttgtaagtgtaccacaaatcccaaaattagatgttctatgtaacgctggctattttatgagatcaagacacagttggatcttgattttgctggaggtggagacctgagtgccctgacactgctggcattcttctagcaaacgtcatgacaaacagacgtggaatgcagcacaggctaaagaaaggcgagcaagccccctcggtagcacagtgtggacagctggtatggacatgctatccatctaaaactgggaaaggttaaataaacagtgggacagtgacaaagtgcagagattaattgccgaaagcattcaataattcttaaaacagacatctaaataagcagaagcattctggagtttgagttctgagagacaatgtaagaagactttatttacttttggagacagagacttcctaaggaaagaagacaagataaatggtgtagtccaaaagtagacatatataacaacaggtgtaccttagtttgaagggactacatcttcatatgggaagattgtattctgaaattttctgttcatattacatacactataaaacatgaagcgtaaaggacatactgttgtaaaataataaagacaaaatgagagaaaaggccaatataaatctttttatcagaccatctccagatgttactgtgaacctactacttagcttcatctcttgaggctcaagctcagcttcccctcctccaacttcatccccagatctccagcgcagatcagtgggtttaagacataattcagtagagattttgataggatttgagtaaatccctaacagaaactcccttggcttgccagctatttttaaaggcagatatgtagaaagcagaagatcctaaattcacctatctgtcttgtgatagcccttgccaggaaaataggagatttgcccaagaatatattataggatgttcttgtggtacatgcctgtagtcccagcttcttgggaggatggcttgagcccagcagtttgaggctacagtgagctgcgatcatgcctgtgaaaaaacattgcaccccaacccggacaacatagcaaggccttgtctgttcaaaaaaaaaaaaaacactaaacttttttttttttcaaataatacattagatagaaccaacccatagaagtcatctctgcataatatttctaagtccaataatgatcaacattatgagtgcctgcaatatcatgagaatttaagagtcaaaagttactttgatcattttcactatggaattgaaagattctttttatatacttattggattaggaaagtacatacaaatgctaaaaatccagtcttggcaaggatgtagggaatcagaggtatgtaataccttaatgttggtcttttaaatcagctcgtcttcctctaaaacagtggatctcaagtatagatgtccattccagaaactcagtaggtctggagtagagcacagacttccattttgaataatttctttcatgtttgagagccaccattgtaaagcaaatctgataccatgtaataagctatacaactctccacagccgctgacctatttgtgagcccttcttgggttctgcaggggaaagctgcttcccgctcatagactgaattatgtcttaaatccactgatctgtgctggagatgtggggatgaagttggaggaggggaagctgagcttgagcctcaagagatgaagctaagtagtaggttcgcactctggattgattttcatatgctaaatcatttagaatttccatatccattttcacttcaaccgttatagtttggcatgacataaatcttcttacatcgacaaagataagagtttgcttcattttttcattctggtgtttgggagtaattttctggaggaaaatgtcactgataggtctttgctctgctgccttgaagtcaggaatccaaaattgtcattagtactatattggagccctcaaaactttgaccaaggtggggaaagaaaaagcataacagcttcagggaaaagtaggctcagtcgaggctttctccctgaggatcagtaattgtagcatggtgaggggttggataatcaatcattttaggtcaaattaaacatattttctttacgagttctgtcaaaataggtagacatgaggtagaatccaggagtcacttctacactcaacagaaatagagacaactcactagaactaagactgtaaggaacagtctaagatggtcttagttcattttattgctgtaataataaagtaccacagactgagtaatttataatgaacagaaattttggcttatggttctggaagctggtaagtccaaaagcaaggaaccgacacctggcaagggtctttttgctgtgtcatcccacggtggaagggcaaagagggtaagagaaaggcggaaggcaggtaaaaggaggccacaccccgcttcctcgttaacagacctacccttacaataatggcattaatccattcatgaagacacagcggtcatggcctagcataccctaagcgttctacctattaatactgttacaaaggcagttaaatttcaacatgagtttgggagggaatagtcaaaccttggcccactcactgaattgatgttgttttcctttctgttataatgtttcaccgtaaactgtagttccctacatattatattgaaaggactattggtctgtatatatttgtgtatcacaaaagagttacgtcatctttagagtcttctaacatggagaatatatagatacattttatatacaatttgatagttaactaattctatagatgcaggcttttttttttaaagaaagatactatgtgccattattttgcaaattaatgtaaatcttaaaaatttttagtggattttattctaaacagtaaataccaaatgagcagacattgtcgtaactaggtactcccttctcctctggcatcttttttgtttgtttgtttaagaagacattctgaggcttattgtaatttcttaatttctcttctgatttttaaatttcagttatgttgtctgttttactattgacagacattgttaagtataattcaaaagtaaagaagcttagaatataaacagggatctggatgtcattcagcagaagtgctctctagtcatgaagaaaatgaagcttggctatgaagtagaagaatctttctatcaaaaaataagaacgttggaacttaggatccaatagagtcgcacaatagtcatataggtgattttacacttacttcattggggctgtcatggctcaaatatatttgtgatccttttcttggaaattgctttcagagccagtttgcaggatgcccctaaaaataaatatgcacttacacttcactgtaatccaaaacctatcactctgattcattgtgcacaagacttggtgtcaaaattaaaattcagttaataaaaagggtatttgtcataattccaaatatttaaataatgcaataaaactgtgaagcttaaagagaaatttggcagcatcactggaataaatttttgtgtaacttcccaaaattaattccctgaagaatatatctttcatttcaaatataagtacaagtatattttataaaggaagcagctagataacttttgctaaagtaacgtttaaggaaatacagggctgggtacagtggcttacacctgtaattccagcactttgggaggccaaagtgagaggatcacttgagcccaggagagcagcctgggccacatggtgaaaccccctctctaataaaaataaataaatagaatagaataagctaggtatggtgatgccagctacttggtatgtagtcccagctacttgggatgctgatgtgggagaatcaccagagtctgggaaatctaggctgcagttgttggctatgatctcaccactgcactccagcctgggtgatgggagtgaggctctgtctcaaaaaaaaaaaaaaaaaaaggtgggcatggaagatgaatggaagatactcaaagatagacccacgaaactgaggatatgctatttcagtctctggactaaaaaaaattgcctgttttcatggacacaggaaggggaacatcacacaccggggactgttgtggggtggggggagggaggagggatagcattaggagatatacctaatgctaaatgatgagttaatgggtgcagcacaccaacagggcacatgtatacatatgtaacaaacatgcacattgtgcacatgtaccctaaaacttaaagtataataattaaacataaaaaaataaaaattaaattaaaaattgcctgtttttattaaactagtaaacaatttgtagaaatgcatgatttgattaaatgagttttgggtgccaccttcataagggaagctagaactgtgcttaaataccaggagccctgctaccttcttaatcttgagcactaaaactaagacctatatctaaaaacttagcctaaattcgcattccaccgtcatgaatatggaatgaaaatctctcatgaagttggttttcatgaaagtgcctccaggaaagcaaaactctggaacattgggccacatttataagaccgtgattattcattaaaaaactgaggatgtaatatttggaaggcctttacttactatcaactcatcaacagtatgggatgaaactagcagcttgactttctgtatgaagtatgggggaaagagtggaaagaatgtcagagttcactgggaccttctttagagccatggggctgaattttatttaaaatattcattggaaaagcacctggattccaatgcttcttaaagtcattctgtttttccatgcagttcgttatttgcttttagaccttttatctccaagttgttttatttagttgctagtatttcttcaggtgtcattatcttgcatccctctagaagataagacacactattgtgtgcatgtgaaattagaattcctataaatatctcattcttgaacaaattttcagtatcaccataaatgatatttaacactaagtggccaaaaacaagtcattcacagagattctgcatcatattcagtctgacagcactgaagctgtggttgtgtatttttaactacacttaatgaaaaaggacatcaggactccagcaaagttgccagcattcaccaggtcttatgagttcttctgccctagaccttttctcatctgctctgtccatccgatcttggcactcgccagctctgccttcttagtccagcagtggctcgataagaaccgttgatcttcagagctctgtctctctctctctgtctctctctctctctctctctgtctctctctctctcgaagagctggaaaagaggactcgaggaaaaaatattcatagggtaatttgtatcttccacattatttaaatttggaagcataaaaatacattgtgcttgaatcatgctgggtgaaataagccagatacaaaaggccaaatgctgtgtgatcctacttatatgaggtacctggagtagtcagattcaaacacagaaagtagaatcgtggctgccaagggctggaaggggcagaggagggtgttagcctttcataggtgtagagtttcttttcaggaaaatgaaaaatctttggatatggatggcggtgacagttgcacagcagtatcagtgtgcttaatgccacagaaatacacactttaaaatggtttaaaatggtcaattttatgttatctgtatttgactataggttaaaaaacgtgcttatacttatcatgtttgctatatgagaacattcctcattcagaagattttatggttcttaaagtaacttgattaaggaataatataaatacaataaagtgcgaacattttagacatacattttggtgagtttgtcaagctacagtcatttccaggagcttctgtctgccctttctggtcactcgccatttcccactgcagtccctggcaacgactgatctgcctccgatccttgtggattagaatacagttcatttttatattttttaaacaaatttggaatgtacaaacttttgttttttgacaagtagagatacagatgtcgagttttttgcccatctgagaagcaggtagaggctttatagcagaggtctcaatagcacagtaaaactaagtcttctaaacttgccataatcttatgaacatgctcatttttcagaaaaggtgaaggaaaaaactgaacgcaagttttccacctacaattttgttcaatcaatgtcatttactgagctataatcaccagcagtttctgcctttataatgttaattttgatctttttcaagaacttgtgaaaaatggaagtcagtccatattgggataacttctctacccattcccttgtaagtgtatttctttccttttttttttttttttttttttttctagagacagggtcttgctctgccacctagactggaatgcaatgtggtgccatcacggctcactgcagcctcgacctcctgggctcaaaggatgctcccacctcagtcccccaggtagctgggactataggcatgcaccaccaggcccagctagttttttttattttttgcagagatgaggttccaccatgttgcgcaggctgggctcgaactcctgggctcaagtgatccacccgcctcagcctcccaaattgttgccattacaggtgtgagccaccaagcccaaccatgagtgtatttctcactgtaggtcagttcctttcccttgtttcaggagatagagaaacatgagatgagcagcaagtgagaaatcttggacattgtgctttgcacaggacttgccattgtgctgcaggagggctgtgctaggcaggaccccagcgtgcactgttggaactatgccctgaaatagtctgtatttggtgacctttgaaagtttctttgtagcatttaagcgtaaatgtgatagttattttgtgttgcatattcattgactagcatagcagtctttcatttagagtcctacctgcaattcttgaatccaagagtcagacagcagcgttttattcttcattctttaggaactgtttttgtaatataagatttttacttctaacacatctctagcagtagcatcctggcctttccccttgcagaatcttctaatctctcctcattaccttcaactcagtctttctaagaccttgctttacttctctaaaacttttggtatttctatattacgtacaaaatcaaatcacttctcattcagcatttttgtgtaccctctgcctgctgggttctggttaaaaccctcaaggatttcacattctgtttattccttaggccaccattccagaccatctctactctgatttagagctgcctcttcagcttctctgccatttcctgtccctgtagacactctctaatccagttctacgatgtgtcctcacatgtgactggtgctttcacacttgccactctgtctttcttatttctctgtcaaaatagggcccatgtcagttcccacgtccttagcctgaggtgatttctctctgctgtactacctcagcatttactgcccatacagtatatttggcacttagcatttattgtttcatctcattagttatattaaaatcttagagttgaaaaggacagtctcaccactgaaaacaaaattacttacacaatatctctgataatctgtttaaacacctagtcatgggaagatctataattttttagctttccaactctacttactaacaaatattaatacactagatgttccttttataaaccaaaatctctctcttttgcgacttcccctgctttagtaacaattgtgccctctggacaaacacagattcaatgttctgtttttgcaaaacctaccttaaaaattttggtagaaatgattgtgctatgttagtaaatctttttagattaacatagccttatataatcccactatgtcatcttcctttgataccttctacttgtgcaccccctcttaaattatgacatatagaattgaacctagtgaacctaggtgttcagttagagaaaaacacagctctttctttctttaaatgaaatgtaagttgcccaaagctcatggtttctttctagttgtggtttatgtttatcttccttacgtgctctgctcacttgcctagacgctactggcctggaaaaaaaaaaatgccttaaaagtgcagtgaaatacagcttcaggataggtgaaaacactgaacagcgggggaaccaccacaacagatagaagtgaagtcagaatcagaggtgcagttggttcaagatacattcattatgagcctactctgtgctgggaactattcttagcatttggaattcattacagaataaaacagacaaagatcctgtctttgtggagtttgtattccaactattcctaagcacaggctttgggcaaacattgaagactagcaaagtatatcagcgtattgagtatagagtatatagagtaactgcagccctaaataaaataaaacaagaaagcttaagcagtttaggctaatgcaatgcagaacatgaacaatacttgaaagcttttagttttcaagtttaggaaccaagactctcgaaggaagacattttttaaaatgtaaaaatagcagcataatacctgaaagatagacacaacccaagtgtccatgttggataaatggataaacaaaatgtggtatgtgggtgtggtggaatattactcagccttgaaaaaggagattcagccacatgctacatggatgaaccttgaaaacatcatgttaagtgaaataagccagtcacaaaaagacaaatactgtttgatttcacttatgtgaggcacctacagaagtcacattcatagagatagaaagtaaatgatgactgccagaggctgggggaggggaaaagaggagttactgttattggtatagtttcacctttgtaagatgaagagagttctggaggttggtcgcagaacaatctaaatgtactttactgaactgttcatttataaatggttatggtaaattttatgtgtgttttatcacaactaaaaaaaacctaaaagataaaagttaatgagctaataaacagaccaataaaccagaaacattaatcaattttgaagaggtaaatcataaacatactataatcagagaaacagaccctacccatgtagaagaatcaaaaaacatttacagagcaaatgcctgttaatatcatccaaactatgtaagtgctgaaaggagatgctgaatggagagaaattagcagttaagtgagtagccagattttgaaggagagaaagctacaggcatttcaggcagaggacataacataaacctaagtgaaaacacatagcagctctatgacagagagtccttggaagacagtaaggaagaaatgggttaaaaaattgtaggtgatcctgaatattaggcaaaaatatttgctatggcaagagacctaatgacgatgaccttggaaaagtaggacagtatagaatgatggagaaatcagagaagaggctttaagaataatgcaggcccaagataaaagggtgggagtgacgtgcacagacaaaacagtgggtacattaaaaactaaatgttgtcagcctgtggatccaggaatatgatggctctattaacattaaaagggtaatttgttatgttactaacatgtaaaatgttagtgttgacattttacattaaagagatatttctgggtacctaaataaacatgacctgcagaggacataagatatacagggaccaaagtttgcgagggcaggtatttcagtgaggtccacccacagaggctctcccatggactatggttttcacagagtttatttaagtagtgtatctaccatagtctctgaaacctctgcaagggaagttgaagaatctagtcattagaggatttcttcaggaaaagagatagaagagtagaagagatatattggtagtttactactcactctggatagttaattggttaaataactaggaaggtagcagaatcaaaggtttatttagtccatcagtaagttaatctagatttcagatttatcttaaaattagagtaaattaaactattcctacatgtccatgacattaaaatgtccaaagctacttatcttgttctagttttaatctggtatttttccagatgttttcagtatgatagaatgtatagaacatgattacacagtcattcaatttgacatactcagttggaggaggagcgaataataaaccttggtaacagcccttcattcatactcctctttttgtcttgcatttctgttaaacacacacacatacttaggactcattcagatttttaaccaccatatcacaacgctaattacggtctcttatttactagcaatagaagtctaatgttgtggcgttctcaaggattcaggaatgttattcaaaagcattttgagctccatttgcctttgatgtttgcctccagtttctgaaatttgcccagatgggggaaggggatagagggggtggtcttactatttcctgaagcacaaatgccgcagcagagcccttttagggacatcttgattctattagaatttgcaggtcaaagggcaggttcaactggcctggtagtttaaagcaccagggatagagtgaatagactactgtaatgacttaaagttggatttctgctgctacctactcattatgctaataatgtgcatgttggtcatgtgggcggggggattactaatactttgaaaggtttcgtgtccacattttccttttttttttttttttttttttaactctggaaaagaagggaacagaacaaggagagtaatttgacaggaaaagcattgcagttcttattttgccctgggcttgtggcatacatatattaccgttcacattttatgtgcttgtattactccctagggactcatgggaatgaagtcagaatgtgctacactagcaagcctcccctttctgtggatagtctttagttcgtaaagctcttaaagtcgatgattaattcctttgaggttcaatttctttaaaatatttatatcagtattagaataggtgatctcaaaccattgactcagattaaaagaagttataaaaaagaattacttctggtaatttttattttctttatacttttctgtatctttcagtttttcttcaatgactgtgtactacttttatcagaaaatactttttttcaaagaagcaattatattgagtagacagctattaaaataaaattttttcaatttgcttttttttccactgtgaattccattccctctgaaaagctgagtgtttttaacaacatttctgagtttagacactctcaagtgtgccatgtaaaacttaatcaggtaagtccgactataccatatggtcctttctaagagatggattagaggaacagcaattttcgtattccctaaaagtctttgctgttactgtctactagctttcacattcttccctatcctccaaatttttttcaagaggttgttctccctcatactatccacttcaaatttaccagaattgtaaccaagagaacaatactgtctttgtcccttttggaaaataaaagaaaaacctaaaagctagtatacctatcaaagatagacattactcagaattcatatgattatatgtgcaatatataatcaaaacattttattctcttgactatgaattgcccttcttaggcacctatacatgtagaaatcagtgtcaggagtatacgttgtaaatggaaagcagaaagacatgatgatctgttaggggatttttagaggatgagagccatggtcataggagagaaagtttgattctgtatagtccatagcatattatcattgcttagtaaaaaaaatagcatcaatgaaataaaatctctatttgaattgcataaaaaatacttcaaattatatatcttgttaaaaagacactattccaatggctcagactccaatgccacattcctcaaaactttgaaattagaaatctaagttgtcatctgttatttcatattgtgatttgcaaagttgacattttaccccagaggtgaactgtaccacactagctgtccaagcataccatttatgaaagagtttggaattcagtcaagaagcttcaacaatatggaattatttttactatgtcatattacaatattttccttaagcacaaaataggcctcaagtctgatcgcctttgtattttgcattcagcaaaggtgctggtatttcaatctaattaggtagagtaacttatctgtcattcacctgctgctgcttgcctgctactaaatatgtgattctgactattggtgcacagaaatgtagcacccttattgggaaagcatgctgcctcttccagcttggtcagtctttgagcttcccgaaagggaacagatgaccgcagtcaacaggaaactgcatagttagaccttcttgaactctttcacctttaagctcatttcaccacttaacatatttttttcaagtggtcagtggatatatttagactgtcattatccctttagtgttgactggatcctcgtggtataagttgcctgccatttcttagaattacgtagtgtggggacagtgcgatgagaatcttctctcctcttccagcagcaaaactagtgaaacaaatctttatttccatgatgtaaaccgagtacacatcttctatttgttagtattgctttcagagttgagtagacctacacatccagaataaaaaatatccattagaatattcagtagacagatagtcttccagtctgtggctaaactaaaactcttccatatgactgctgttgaagctcaattatcttaacaaaagacagaagcaaggttaaacttgggcaatgcattctcagattcagcatttcctcaggtcaaaagctcaggccacttatatagttcctataaatcaaatatgtcttctttcataaaagatgagctactgagaaatgcattttggattatgaaactaattgttcaccaactccattgtgattattttgtaaatttcttacatcagcttccccactaaatccacctttttttcctttggacacaaaccataaagtaattattagctaaaccacaaggaatctgtaaagtttaaattactgtttcaaagtgtgcagatcattgccagtaaagccacaactgcaaacttatttgcattcatgagatgaaaagaatgattgatgttcataatgcaccaggaatagatggctgtgtttctatatccacgttattaaagtctgcagtttgttgtacactgtatgcatgaaaatgtcttcagtgtcagtaatgcctcagatcatctggaagctacagaataattatcaaaggaataaattaaatggataaagtatgtaagttacaggattattcttaaagtaactgtttacttttcaaattcaactacaactataggaactctttttaaaatataaaatgaaatactaagttcttactaatatagttttttttaaaaggttaacaatttttatttattctttttgagatagggtctcactttgtcacccatgctggagtgcagtggcaccatctcagctcactgcaaccccacctcccaggctcaagagatcctcctaccttagtctcccgagtagtgagtagctgggaccagaagcgtgtgccaccgcacccagctaatttttgtatggttttgccatgttgcccaggctggtctcaaattcctggcctcaagtgatccacccacctcagcctcccaaagtgctgggattacaggcgcgagccaccacgcctggcctgaatattttttaaactttattttattgtagtaagaagacaacacgggatctaccctcttaatcacttaagtgtacaatgtagtatcattaattgtagagagaatgtcatacagcagatctctagaacttactcatcttacgtaacttaggctttatgcccactgatgggaactccccatttccccctctctcctctgccttgcaaccaccattctactctctgtttgcgtgagtttgactgttttagatccctcatgtaaatggaatcgtgcagtatttgtccttctgtgactggcttatttcacttagcctaatataggggaacttattaagataacaacatgataaagacaatttagagtcacattcgcctgaatgggattcctggctgtaccatttactccaggtgtgaacttgggcaagctgtgtaaactctgaaagtcttggttttattaccctcaaaatgggggtactgataatagtaacttcaaagaattgttggaaggggtgaatgatgctgttggcgtttgctttcttggttttattaccctcaaaatggcggtactgataatagtaacttcaaagaattgttggaaggggtgaatgatgctgttggcgtttgctttcttggttttattaccctcaaaatgggggtactgataatagtaacttcaaagaattgttggaaggggtgaatggcgctgttggcgtttgctttcttggttttattaccctcaaaatgggggtactggtaatagtaactccaaagaattgttggaaggggtgaatggcgctgttggcatttgctttcttttgcaggcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcaggtattattaaatgccagcaggagggtcagtggggccagctttcacaccattctccacacaggtctttgccagcttgtactttaaggtctcatgtttcatattagacatctgatcattggagctagttagtttccatcattagagactttttatctccgcaaatctgtgtctaggaaatgcagagcattcgtggtaagagggctgttttggacaatgtcacaggtcttctatgagaatgttttttaactttgtacaatggattgtagaaattattgaaattagcccatttgacatgaaaaggcttttttttttaaacatccagcaagatttctatgacagcagccactaaggatattttcatgaaaagatttccagttattcaggattgggtaagctctgaagataagaacaaaggttggcccttttcttttccagcctaaatgctctcaaaatttaatacttaatattcatgtaacaccttttgtttgtgaaaataaaagctaaaagtttcccctttgatgatggttgcacaacagtatgaatgtacctaatacacaaaaccatcaacttaaaaatcgttaaaatggtaacttttatgttagacatattttaccacaataaagaaatggagaaaaacatttcccttggaagataaggagagtgctggatgtttacatcggagccctgcttgaacggcagtgctcctcgttgagtgctcctggctgggcgcagcatccgcgtcccagcctccgtggctgtctcctgcattcccagtcacgttgtctgtacattttggctgcccaggtgtgctctttgccctcaagtaatgagaccgagaaagagcttttcaagtaaagaaatttattttcttctatttttggaggtcagtcatcaattgatggtattttggcataatgtttatattaacaagaatcaatatttaaacaacaaagttattttctctgtggatcaaattaaaactgcttagaaatagtctttatatgtatttatgttgcacactttgctgagaaaataccaaaagatgtcttttttctgcaggatggatagttgaccagcaaaaagtaacccattgcttattcacaagtgaaataaaacttttccagggtcctaaaatactttttagcaagaagaggacatcatctaatattttgactacctgttatgtaagataggaagaatgtgcttattatgaaagacatccgtccagtagttgaaaactgaaatttggctcatcaaagctgataatagcaaattggaggatattattggagaaaggagttcactgctgtgggagtttatatattcagcaatatcacttatcttaagtagttaggcttgaatacataggcctatgatttaagcagttcttgatctcttcacttaagacaccaaatagaattgaatatctagcagaccagaataccatacctcatttacagtggtttttgattagtggcctccaaagaacatatgttttcattatgtgaaaattaaggaaattggccgggcacggtggctcacgcctgtaatcccagcactttgggaggccaaggcgggtggatcatgaggtcaggaaatcgagaccatcctggccaacatggtgaaaccccgtctccactaaaaatacaaaaattagctggatgtggtggtgcacctctgtagtcccagatacttgggaggctgaggcaggagaatcacttgaatccaggaggtggagcttgcagtgagctgagatcacgccacagcactctagcctgacaagaggacgagagtccgtctcaaaagaaaaagaagaaaagaaagaaaagaaaaggaaattaattaatctctgagcttataaccttagaaggaagtagctaaacaattctcagtgtctttatatcaaaccacatgccttgaattttctgtagcgatgtgtcctgtatgaagagaaaaataataacagttctcaggagtccttcctacagtcatctcctgcctcccttttacattcctgccctttcaaagcgtatctggatgctgtgagcaagaaggaaggagtcttgccaaaggcatttgattctttaattcctccaagagtgtgtactaacttttggacaagggagaggccttttggaaagaggatatggcatcaatgttgttttaatttaaagcttctagtccatgaattgctggaatgtgcctcagtctaaaggctatttcctaacagggaagcagtcagcattgaccaggctttccagcaaatggagctgccactgcctgataggctcttggcgttcacatgtgattcctattgtcagaaagaggtgaagcaatgagggatatatagatttgggggtcaccttctaatatggtcccaatttacttaccccctctaaccaccgcccccccaccccctacagggtaacttgtctccttgactcattcatggcaaagcagcacttggagaggctgcatcagaggaaggggccagggccagtgaaaaaaataaactaaggctgtctaacaaactccagatgttctgtggtgggtgccagccagtgtgttcagaccttaagtcatgaagaagccccactgtgattgtcaggcccccgcacgagatttaatgtaaactccgatagaaccctggaaagcattaatacaatctgtttagtcacagcagttgtcacaagatggcctttctctcagcattgttttcttcttttcacctccagaattttacaacctccgtattgtgttggttgctggtgtgaaatctggctctgcccctgtgtgctctacacagatgtgttataggcaggctgggcttttcaggacaggctgggattttttttttttttttttttttctgtttttaagagtcaactataacagtataaaagtaaaggctacaaacttaaacagatttggtttgaatctagataatctcatttacaactacaattttgtaatcctgtgcattagaattaattgtcacaccatatattctttgattccagtgttttgtaggcgtgagggatacaaaagcacagtgctcgtcttaagggaactcacaggctaatgcatcaaaccctggttgttctagtcatctggcagacattctgtgtgttagtccgcttccacactgctgtaaagtactacctgagactgggtaatgtaaagacaagaggtttagctgactcacagatccacatggctggggaggcctcgggaaacttacaatcatggcggaaggtgaaggggaagcaaggcacatcttacatggtggcaggagagagagcgatcaagcgaggaactgccacacacttttcaaccatcagatcttgtgagaactcactatcttaacagcaaaggggaggtctgcccccatgatccaatcacctcccaccaggcccctcccctgacacatggggattacaattcgaggtgagatttgggtggggacgcagagccaaatcgtatcacgttctgtagaaggtaatcctggccttgccaactttttctgctgacagctttagcaggtcatccaaacattatgtaacttatttacccattcacttcagatttacctcacagagttggtgtgaaattcaataagatagcacacctgaagcgcttagagtccccccttccattccctgtcactgatagccctgttcgtggtcagaactgtgccataggtgacacacagtacattgagggaggggtagtctcagtaagcatggctcttgttccttttttttttttttttttttttgaggtggagttttgctctgttccccaggctggagtgcagtggtgcgatctcggctcactgcaacctccacctcctaggttgaagcaattctctgcctcagcctcccgagtagctgggattatgggtgcccgccaccgcgcccggctaattttttgtatttttagtagagacggggtttcaccagcttggccaggctgatcttgagctccagacctcgtgatccacctgtgtttgcctcccaaagtgctgggattacaggcgtgagccaccgtgcccggcctggctctacttcttggttgtctctagccactttatttaaatgtgcagactcacgcagtgttcagaattacacaaccagcacatggcgttccactcctctgaggaagaacgtatttctcagggcagttaggaaaaagaggtagaggtactttttatcctttcttttttccacctgttctttttaatgatatgactctcatatagaatttttaaaaaataattctaaattctaatatgtctttcttaaatcttacattttcgtcactgaagaacatttaaatgcccgtctggctgaagtcctcaacattaggaaaatgtcaactcccaagctacatcccatctcactcgccttcgagttctgtgattttccacatgttacctcccgttctgggtatccccgactagtataacttttcagaattctgtgaaaatagagcagtgacaataatggccaccacgtgccacttgactgtcgtgcgcagggcacaggggctttacatcaccgggtcttccccacagctctggagagtgtcttcattatttggggaagcgcttcagacccaaaaaggataaaactgtggctaaatttccatgaagaagactaagcggtggagctagaattagaactgattctcttctcactgtcaccatcttttgtgaagattccagatggttggtaatcagattgtattagaattagaataatacaaacaatgctattttatgtttttatgatactcatttgttccctgagacacagaaaaggggatctatttatacgccagcccttcccctctccatccgtaaagaaccagaaacaaaaaagaaacggtgcgatttgtttcccttttcactgttccaggctgagcatcacctttcggtacacgcggtctttctcccgtcatcccagcactacttccttgagatgagatgacatcaggtgatcccgttggtcttgagaatgatcccatattcttcagtcaagcattttcatacagtagttttctactgtgttatgtgtattttacttgcttaatcctccaaagaccgctttatttccctaatcactaagttcttgatgggaagagtatttcaccgttgccccaagtactttcagtaggtgtggtatgaaaaaatacctgaatcaagtgaataatattttgagtaactgtcttttattaacttccgtccactctctagtgaacagttttcagtctctcttgtggcactgcctatgatacctttgctcttgttgtttcatcggtaaagctgagtactttgacattcactgattaggttgggaaaaccagcctatgctttgaattggccgtttctgcaatctagcagacattctagcacacattcactcatctgtgaacctgcatttgtacatgctttcacacttccccatccctattagaatgccagttaccatgataacacgattcaatgctctgtccacatatcccactcagaaacaatttgtcctataatatggacttgctatctttcaattcatttatttagggttattttactcctttgttgttagcgaaaagaaaatgtatataggttaatgcctttcttattttgactttaaccttttttctcacatgatgtagagctggccattggcccacctttaaatggctgtatatcatctatcttttcctcctcgtggaaaaggctactgtctattatagaagcatggtgtactaattatgaagttgcggttgaaaagacactttatcatcactctagccacttggaactttccaaataaatcattatttggactaaaatttcccagtcttgtttatagtacaaaggtgaatacctttttgaaggttcagtaaactctctttgttaggaactgagggttatgacaacaataaaatatctgtttcagctttcagttttggtggacatgttctttgatcacagcttttatgagagaaaatgcagttttattattaattcttctctagccaaactcaaatcattttactggtttgaaatgtgtcgtctttacctatctcaaagttttgagtaaagaatataaatatattgttttgtatatgaaaaatgtgatttgttctcatttactaaaatttgggaagaactggcttaacattgatctgaagaatgtaggggtcagatacttttttaagaaaaggctcaaatttgattttcaaattcttagcccagggccctgaccgctccccgttggagcaatatttaggaccgccaagttggagacagtaaataattgattcttacatgtcagactgattgtcggctctctgcagtatacatgagttgtttttgaacgaagctaaaatcttgtgaagacgtactaataatctaatatgaacccagttagatgaaaatcaccttttgggacttattctgttctatgagaaaaaaattatacgaaaaattctcctaactagccaagaaaatagacctgtctgtagtctacttagtgatttaaagccttttccttagacatgaaatccatgatggaagcttgttgccaataagaataatggagaatcaacctttaaagccacatacatgatgtagaatttcaagttgccattattctgtattgtaatggtcagccagagagacatgtgtctagtcagttttattaactactttctacagcagtcctcccttccttttctctgtcctattttctgaaccaacagaggactaaattttcttacggagtcaggaagttaagacttaaaatttaaggaatatgagggtagagtgtaccttgttgacttacattattgcatctgaaccttcagatgacatcctgaaataaattgcatagttagggtattttatacctatgattcccattagggacttcatggttttgacaaatacactatcaaagggaagcacatcacaaagaacactacttgcaggtcaaatattgacgaatttagggaatatattgtgtgatattttggtctaatttttcactttcagtttgttgctgtaatacacatagggaatttttaaaatatatgtattttagatttatgctgtatttgtaaattcccataaatacataaaaggaccgtgctaagctgtctttggggtggccacactagtgtattttcctctcacgttttaccataagcagcaagaagaaaccaggcccccaccttcagcactttaactggaaatctacttagctagatctctgagttcattcagtacattctccactttctacacaactgtaggtgacattgttgctaaagttctggtactgcatatcaaggatcccagtaacaagttccttgcttcccttgaagatccagtggcagcctcctaaaagcccctatttcagtgaacagccaattcagggcacttgaggtttgcactagtctctcctcagaatctttccaggtcttccagtttccgcccactacccagctccaaagccacaccggcgtttgaagtttttgttacagtgttaccccattcccagttatgccaaaatctattagttatctactactgcataaaaattacccttaactgagtggcttaaagtagtaattattgtctcacacagtgactgagggtcaggaatttgcaggcagcttagcaggtggttctgacccggggtcctctgtagggttacttaggacacgagagccagcttctccagaagtgacccgagagaggaagagagcaaccaaaatggaatttgcagtgtcttccataactgaatctcagaagtgacataccatcacttctgccttattctgttcacacagaccaacccttatatagtataggaggggacagcacagtgatgcgaatacctggagacagagatccttgcaagccatcctgaaggctgactaccacagcaagtgcatgaataaacaaatttggtatgtccatgcagtgaaatgctgctcagcagtagacagaaatgaactacaaatacacacaacaggttggatgaatcgcaaagacacaccgagcaaaaatggagacacagaaaagtacatactgtatgattccaccatactatacagtgtaagaaagcagatcagacaacaaagcagaacttattcatcgtttcttcccctcgtcagctcacttgagaggcctgcagggggaaagggacaagttccattctctttcactcctctgccttcttcatcttctgatgctgcttctctggccaacattgtttcctttggggtggagcagcagccaaaagacgcaaacctgacagctttctgtaatatcacttgacccacagaaagcgcatgcatcctcgccgtgccaaacggtgagaaataggccgcctccgatacttctgtttccgtctgccatctgtctccttctcagataagcacaaggcaaatcaacaagtctgatggaatgagatgccagtctccttgacgtgtactcacactcagtctttaggagtggttctctttgagccctctctgtcttagctaaggcaaaggggactcttgtgaatgaacacgtaactctccatgtggcaagtccttccggcagtagcactacgctcacaacagtcttagacagatggatgaagggcacctgctgaggcagtggactgctgacagtagtgccttttcagccactggccactaagctgcctttatacatcttggttgcttagctcttttttgtcacctgctttgggccttggtcaccaattctataacaactggaaaagcccattcatcatactattaaaactgttttacattctaaaagaagataacaatggtaggataaaacagcagagagctcctgagttgttagtgaataaagggaaaattaaatagcaagtatcgcagcagcttaagtgctgcggaaactgtggaaagtaaaatgttgtaaacatctgttcatctcacttagtttaaatcctcgataatgaggccagcctcagagagcatttatgtacccatttgttttatatatgaatctgtcatctataatgccaggtgcctgttttatgactgagaagacattcctcaaaacacatctgtgttaggcactgccagggccccttcaccttgcccttgacggtgcctacttcatatctgctgtgcacatcagcatcagcctcccagctgtcctgcatgatgttatctccttgatggtgactgttgttttatcctagaaaatgaaaactttggttagaatattcagaatttgacagaagaatgcaattccgagaaaaacagaagattacagttcagtctataataattcaacggcccttatttttttatttactgatttatttttaataaagacagagactcactctggtgcccaggctggagtgcggtgtgcagtcatagctcctggcctcaagccatcctcccaccttgacctcccaaagtgctgagattacacacgtgagccaccacagccgtcctcaatggcctctattgactagttaagataaaaatgttaatcttttaaaaattattttacctcctttcaaccctaaatttgtgtatattaagtactcaaatatatatacttcttcctctgaaccattacaaacactaagatcaactagattgttcctactgatggtatccagattgttttgaaagaaactagatgcaaaccctttttcattcactgtcctcacttctggaattgccttgcacttcctcagctcaatctccactttaaacttctcttcaagactcatcatgataggtcggaatttcctagcctgaagtcactatttttccttatcgttagcaaagccattctgtgctttttttcattcacgtattcattttcccttggcttaagttgaacaaatgagaagaaaggagggagggagggagcagagagaaagagaaagaaacttttcacttggactagagttgttaattgtatttattctttatgttaagccaggttattcttgttggtgtgattatttgttcaaatctaagaattcccgttctataaccattcctgtcttgttttcctgtttgtatgtatagcgtggtacaatagaaatagtaactgagtgtcaggagacctgagctctagatccaactctgttgataaataagtatataatcttgaacgtaataacaccatcaacgaatatcaaacacttcacattttacaaagtactattcagatacttaatagcgcctaaccctagggctgtatgggcgaagcagatctcataaataaaaggagtgagtggtttaaagccacagcagaaaaagaactgtgagaaagtaggggccacatggtgttgtctacagaggcaggcacttctaactccagctctcgtgaccatgtcagatgcgagccctgtgttattcaggcatccatgtttccctggagaattcagatttttatacaaatctctttatgtctaagtgttggcagctaatgtgttttttatttttatataaatcagtccacaaggctgatttaattgtgtttgttttaacacaaataaggccacaggctgcctgacttgcctcttcgggctttatcttcctcacctataatattgggtggatagatcaaatgattttaaagtctaaaattcattattttctgtattttgataaatcaacatatttacctgtagctgtatcgtctgctaaaggctgacattaagagtttaaaaagaagcaaatcaaaaagcataagaaaacgtgtgtaaagattgtttaactctgtctatagaaatttgctttttttatgaaagtattattttattaaaaaatattgcattatgaagatgaaaaaatcttggtttttttgaatccttcaaagaaatagatcatattttgatgaattctgcttgattggagttactaataagtagaaagtccagaggctgggaatgtggggaaacctggactcatcccaggctcctttcatccatctgttgcatttttttgtcgtcatttccagatgtaggaaaatccctcacaacaatttgataagactcttcccttcatttccagcatcaaatctaacttgcctttcctatcgtcaaactgctgccttttatgatgccacagggaattaatttataaatcttctgtgtttcctgatccctcttgaattgtctcaacgcagataaatcaacctaggtttcctgcccatacgctggtgccctcctctccctgtttcttctgtgtccatcaggtggtgtgatttatagctgcctttcctatgctcattgaccttggtctgaggatctcattaagcatatgtaaaactagaaagattagtttgagggtcgttccctcctccgttaaacttctcttggtgggaaccagtcagaccaatatattccaaaaatctgttcctgctgcctcttttggtctcttttgaactaatgtagatactcattaaaagcaaatgtgaattagacaagtgtggtggcatgcgcctgtaatctcagctactcaggaggctgaggcaggagaatcacttgaacctgggaggcggaggttgcagtgaggcaagatcacaccactgcactccagcctgggtgacaaaacaagactctgtcacacacacacaaaaaaagcgaatgtggaattaaatgatatttgcattcaaggataataggagtggtgttaaactagaatattagctgtcactgagtgccgttttcagaagctgtaatttacatgaccaaatgtattatcacatgactttctggaaaacagtattcacgccattagtcatctcaagaaaatactgtttaacgtttaggcagctgagccctattttgagttctttatgtgaattaattcatttaatcatcactacagccctcagaagtggagttatcctcattttacagagagggaaagaggttaagtaacttgccctaagtcccgtagctcataagtggctgagccagggcaggattcagagccgatcatatcactccagagctgacactcctgatcactacaccaaaatgtgttaccatcattacagcatgtgcttttggtgagagatttcaatagccttcagccatattattaataaccccatcatactctgttgtaataaatagtactttaatctacccttataaattacagtgaaaatatatacattactgtaaaggactgcccccaattttaaaaaattaattcagaatcctgacaggtcaaactgctttctaaatcttgtattaaaaagatgtcttctaattttaacaattaccttataaatagttgactggattaatgaacagctgtacagcagaggagagggtaaaatgataagctgatttttaagcagctaagttcgaaaatctgtgtgctcataaccctaaattaccattggaaataattttgttattaaaatactattactgtcatgtatacatagacaagatgtatgcaaatctggttccaaagtattgcacagcatttattaagatagtgtttagccaccagcattttttttaattttaagaatcaattaatttgcatacttaacagctcatagagatgagtgattggaaagctgctgaaaagttcatagaaaatagtgactgttgaagaaagaacatctatcatacctgaagttcagtattttccccctatatttcaaaagttttatgaaatataagaatttaaataaataaattgttgagctttaatactaaaacagtatttgtggtagttggttttcagggtagagatgcttaaagtttatggtattgccagccttgttcctgaatggagcatttagaattggatatgatgtttttcttggtctcccagaaaattacaacctactaatggttaaatctaaaattatgggttctcagaaaataatttggaacatgtacagtctgggcctacctaacttttaacaagctgattcattagaaatatacaaagagattgaatggatattactgtgtttaaatctacatatgcactttacgagtacacccaaagtgcacacctggaaacaaacaccaaactgtctcctgagacccaggttataaaacacgcttagagaagcctggttggttctcagtcattggcctgaagccagtgaaaggacacagttgcatcatattcccctagtctacagtgtttaacatttcttaatttcaatttctgctaaatgaaagattcttataaatcaagttttcttttcctaacaagtttcctcgcaattaccttcctatcttttttttttctttttttgagacggagtctcgctctgtcgcccaggctggagtgcagtggtgtgatcacggctcactgcaagctccgcctcccgggttcacgccattctcctgcctcagcctcccgagtagctgggactacaggcgcccgccaccacgccctgctaattttcttgtatttttagtagagacgggggtttcaccgtgttagccaggatggtctcgatctcctgacctcgtgataacgcccgcctcagcctcccaaagtgctgggattccaggcgtgagccaccgcgcccggcccctatctatcttattattgagaaacaatagccaggaagaacagaaggaaacctgtttttaaggctggttctagttgagctaattgctatctagagctctctttgtatttagacatcaagacaacagtcacagcaatgttccctaagcccgcattgtcctcctgaatggtagatgaaattaccagcacctgacttgcagctcttcttatggctgtgcactgaagtaactatttctcttaatacatattttaacaatctcagatgagactaagtgggtctcttacttttgtgtcgtctagtaaggagccataactgaaatatcctcctttttattaccataatgatataactataggaaaagaaaaaacatgagccatgattgacagaaattactctccttgtcagagatcatttcctctgttgcttaaagcttcttgcaatgcagcccttttttttttttttttttttttttttgagacagagtcttgctctttcgaccaagctggagtgcagtggcacgagcttagctcactgcaacctccgcttcctgggttcaagcgattctcctgcctcagcctcccgagtagctgggactataggtgcctgccaccatgcccagctatttttgtatttttagtagagacagggtttcaccatattggccaggctggtctcgaactcctgacattgtgatctgcccacctcagcctcccaaagtgttgggattacaggcgcaaaccactgtgcccggtcacaaaaaaaattttaattgaaatgcatgcagccaggcatggtggcttatacctgtaatcccagcactttgggacgccaaggcaggcagatcacttgaggtcaagagtttgagaccagcctggccaacatggtgaaaccccgtctctactaaaaatacaaaaattagccagccatggtggtgcacacctgtaatcccagctactccagaggctgaggtgggaggatcgcttggatccaggaggcagaggttgcagtgagccaagattgcaccactgcactccatccagcctgggcaacagagcaagacttcgtctcaaaaaaaaaaaaaacattaaaaagtacacatgtctaagtatacatgtcagtgaaattttacacacttatgtaaccagcatctacatccaggaagcagatgattgccgacaccccagcaaccagttctcacactccgttttcaggtaccatcccctgcctattcctgcaggagtaactgctctactgaattctgacagtattgattaattgtatcttaaaaaatcaaaacttaaagattttctgtcaacagagcaaccagggacccagaggcagaagccaggggagccaccacaggcagagggcacagccttgagtcagaggattgttctcagaccttgaaacctaatggaattttctctgctggatttcagacttgcttggggctgatgagccctttttttcttccagtttttcccttttggaatgagaatgtctatcatatactggtcccaccgttgtattttggaacctgataacttgttttctgtttcgcatattgacagatggagaagatggatcatacttagtctccctcatacccaactcagattaattagatgaggagatttgggactttcaagtgatgctgtttagatggaattttggatttagagttgtgccatagtgggttaagatttttggggatactggaatggggtgaacctatgttgtgtatgggacagataagaatttggtgggactagaaggcaggctgtagtagatggaatgccccccaaaacatatgccctccccaaacttatagcccccaaaaaacattatgtccacgtccagtttctataacctgtaaatgaaaccatatttggataaagggtctttgcagatgggattaaattaaggatttcaagaagagatcattcttgattatccaggtggggccctaaccctaatgacaagtccttgtgagagacagagagaagacagatacagaagataaggtgatataaaggcagaggcagagattagactgggtggctatgaaccaagaaatgtccacagtcactgaagccaaaagaggcaaggaaggatgctcccttagcatctccacagggaacatggccctgccaacaccatacttttggacttggggccgctagaactgtgagagagtaaatttatgttgtgtttatgttgtttgtgatcatttcttacggcagctccaggaaactaacacatggagtaggtaacacagcttctcgagtccttcatgtatgacaagcttgttgcccctgaaggtattagggttcccctttatttgaaggagaaaggtgaatacattatctctgcttaatcactagcatttgttgatatatgcaaagaagacattcttaagacagcctcggggcagaagaggtcaaataatatttttggagaaaggagaatactaagagactaataagagttagcctcggccgggcgtggtggctcacgcttgtaatcccagcactttgggaggccgaggcgggcggatcaggaggtcagaagatcgagaccacggtgaaaccctgtctctgttaaaaatacaaaaaattagccaggcgtggtggtgggcacctgtagtcccagctactcggagaggctgaggcaggagaatggtgtgaacccgggaggcggagcttgcagtgaactgagattgcgccaccgcactccagcctgggtgacagagactctgtctcaaaaaaaaaaaaaaaaaaaaaaattagcctcatgaatgagctagaaaaggagctcttaggcagagggatcattgtggccagggttgctgaagcatgaagcatcctgagatcagggagccatagaaggcttcttattaccaagtctgcactactcctgggcagtgacgtgagactccagagccaggaggagacaggtcacggagagccctggattgacaatgctgagagtagcttggacttgctcctgtaggggatgccaagccatggagaggcttttagtctcaccgatgttttcagagttttcttttatagataaatcaatcactctggcagctaatggaggaagttaaggggagcctggagtaagaagatggtaagattaaaaacagggagactgtttaagaatctattccagttgcccaaatatgaaatgatgaggacaagaatatagggtagttgagatggagtaatgtattcactaggccattctgtgtatcaaacaccacctaatcttagtgccttaacacagtaaacgcttatttcttggttacacaaagtccaccgcagatcttgccggctctatgaggaagctgccctccatgcagcaattcagtaatccaattctactaaaaatttcctcctttagctctttcagtatgaggccttcttggtcactgtggcaaaggaacaagtaattggtggttcccgtgctgtttcttctatgcttgggtcccacggtcactacccacagaccactggccagtcagatgtctggtctggccaagtaagtggaagtggtctccctaattaaaatgagtaatcaagaagaaaggccatatatggaagagaatataacatgcttatttttagtagagttgaattcgaggttatttatacccaaatagatacatcaagaaagccgttggctggagatgctccaggtaaagatgagagctagaaatgataattttggagtcatcagaacagaaatactacttaaacccatgaaaatggaatagcttgcttaagagagaatataggcaagttatacttactttttactgttttctgacacatactaaaatattaacacaggccattcttttcatccttacagattatagttcaatgagcatatgccctctgtaagcctgttggtaatggatttcagaattggctctactggatatgcattgctaggagtttttatgcagttctagggtttttaagacctttttttcatgtcttacatgtgttgaaaatgctttaagcatttatggcacaatatatcacaggtgattgtgatcttatataccccatagccattttgctgatttgatatataaattaataaagctctgttcctggaaatgaggataatgctacatgaatactccaaagagttaacataaatgtagtcttgaaaagcactccctcaagaaaagaattctgtccaaatcctattaattcccgggtattttgcctattttccttaaaagcaccttacattaaaaaatctgttttgcattcagtctctaagcaaaaatatgtagtgcctttaaagaaacaacaacaaaaaaacccttgagtaggttaatctctccattttaagttacacacttatttcatgaactaatcaaacttgtcgttaaggcttcattaatttcctctccactcatggggtgggatggttgaatcatagcggggctgtgtgtgtctggaagtgacctttgtatatttgggtggtaaattatacttcaaaataccagtagacattttattaaaatttttattttctttggtagattatttccttctaattatagtagtaaacactggtatgttatgattagtgattagcttataacaaacatctaaacagggataagtcagcctgtttagcgataaacctgtctcttgatatatttagaactgatcactagccagtatggctccatatatttctaggacagtgtaacccacagtgacataaattaaaattttaaaaaaatcaaggatacagtaaataccaactgtctattaatattgattaataaatcaatacatttaaaaaataataaagtttaatttttcaaattgataaaagtaaaaattactaaattgatacattactgagttaataaaattaacatttactactattaatctaaatgggaaggtgaaacatgggacaaagaatgaatttttctgaacctaaaaactggaaggaaagtcaaaagtacttaccagagcatgcttaggatgcccaaaggtactgtcagttcatctcccggaggtggggttagtttagtcaccaccaaaataaaactgtggtcaaaccatgaattttggagtattaaatgaacccagttgtggattcactatggtcaaattactacaagaactgggactggaataggttgccctgccctagaagtttcctagttgattgagttgaggtctgattaagttgaggtcacttccagacacacacagtcgcactctgattcaaccatcccactccaggaatggagaggaaattaatgaagccttactgacaagtttgatgagggagggagcagctatgttggcatgtcttctaagagctgtttctgacttctggtgcccagcagtagtccagctatggtagctgatcagttgctgcctaattacctaatcctattggcaagatgaatgtttcagttcgctgctgtgcctttaatcataattgtcttttattcattcagtttgaggtcttcctggttcttgggatgttgagtgattctcagttgaaacctggacatgttggatgttatgcgatatgactctgggtcttacttagacttctgttttagctggttttctttgacaccactccagcaggggaagaatggggtgctgcctcagtattgcccagtggaggtagaagtccagtttctcccacttggaccctgctgacactcaaggggtggaggcttcttgttactcctaggtggagatgggtattcatgtccccactaggcttcactggtgtatccctgcctggttagggtaggaaggcctccactaacacagtgggggtgaaggaaggggggcctggttactgctgtgcggtagtgaaggtccgactccaccaggagacacggctgttactgctccatggaggtggaattctagaatcctcacctagtctctagtgacactgtggaggggagacttcattgctgatggttggagattatagccctgcctccctcggctttccctgacaccttccagtggagcaaggagaggctgaagcacctcctcacaacctggtgagcatggggcccgccgcttggtctttactgacatgagtgacagtgggaccacatggtctttggaatagagtgattgttgtcccacaggtttctatgttgctaggctgtccctttcctttggaggcttctttggctagagagagtgggctcctgttgaagcttttttggtctgtgcctgttggcatttcctggttgttggcttcttcagctctacctctggatatataaggcagaaagatccagggagctgcaggtcacagcactcctgactggtctgccttctctctgcctttttagtgtttgtctgtgtgtatagttcttgttgtacttttatacttagtgtgctggagaaaaaaaaatattcctgatacttcttaaagacagtaaggcagactattcaggggaccactgagatgaggatttgtgttagagggcagagattgggctcaactcagaatacacaaggaccaatggagatgtgtagcgaaggagcagggtgggggtcagtgatggaaaattactaagaagaaacgtcatggctgggggattcttgccagacctactcaacaggagttgctgaagacaagccagagagatgacatattgatagtgggagatgaggaatttgatcagatctcatgagtgatcaggcctcaagggtggggatttatttttgaaggaagacttaagcaaactaccttttctctttaggaaaataaaatgtatgttctgggcttagatatctaagtaatcagtaggttgaattttaatgcttacatgcagataaccgatttttttaagttataattttcattactacctcatcccttagcccaagtcacatatttacctgttttggaaaaccatacctctggcagcagttgagctttgatgtctagtatcattactttattcagcttccaattcattttaagtggtccttaatgggtattcatttcttatcagaatcaatctatacctgatacttgtatatttctggaaatcaaagtttttcaaatatttggatttataaaattataagtggaaatatttcaacaactatgaagagatagataatttaagatacttttctataattaacaactttttttagaaaagcctgattttaataaatggtggttttctgtttttttcttctacagaaaagactgaaagccatttagctcagttgtacaaaaaagaaactttagagaatagagaaaatcaagagtgcaatagtagctgtgggaaaattttaacaatgtaaccacgtatgtttgtacagatacatatatacagagaaatccttttataatgaatagtcagagtataggagaaaaaaatggtattggagagtttggccttatatcatttgctttcaatctgaatggttcagtaagaatctaaaaatgcctttatatcctctgggtttatttaaagatacttcactgtatgtacacacaggtgtatagttggtttatgttttgactcagttatattcttttcttaccatgtatggaccatgattttgtaaaaagaaaagataaaattccctcagaacatctagctttaagaactttggctgggtgtggtggcttacgcctgtaatcccaacactttgggaaactgaaaggcaagaggatcacttgagcccaggagttagtgacgagcctgagcaacgtggggaaacctcatctctacacaacaaaaattttaaaaattagctgggcgtggtggtgcacatctgtagtcccaggccttaggaagctgagatgggaagatcgcttgagcccaggtggtcaaggctgcagtgagctatgattgtgctactgcactccagcctgggcgacagaggagaccctgtctcaatttaaatatcaaaaagaacttttattcttgtgatctaaagttcttttttttttttcctttagagagaacacacgtgtgtgtgtgtgtgtgtgtgtgtgtgtgtgtgtgtgtgtgtaaagtgcttggattcttgaagatcactttctctgcttgcttagctgttcttcaagcaggagaaaatatgctgtatttatgtgattataaaaagcattgccaggcatggtggctcatgcctgtaatcccagcactttgggaggccggggcgggcagatcacgaggtcaggagattgagaccacggtgaaaccccgtctctactaaaacgacaaaaaaattagccaagtgtggtggcgggcgcctgtagtcccagctactccggaggctgaggcaggagaatggcgtgaacccgggaggcggaggttgcagtgagctgagatttcgccactgcactccagcctgggtgacagagtgagactccgtctcaaaaaaaaaaaaaaaaaacaaaaaaaaaaccacaaagcattaagcaatttaatttctgtatatttagtaaggaagtgatcatactttaaaaaaaaactttttaggccgggcacagtggctcacacctgtaatcccagcactttgggaggccaaggcgggcagatcacgaggtcaggagatcgagaccatcctggctaacacggtgaaaccccatctctactaaaaatacaaaaaattagccaggcgtggtggcgggctcctgtagtcccagctactggggaggctgaggcaggagaatggtgtgaacctgggaggcggagcttgcagtgagccgagattgcgccactgcactctagcctgggtgacagagcaagactcctctaaaaacaaaaaaagaaaaaagaaatttagtattacttcttgttttcgtggcctctgtatctgtaaaatacaactgtacactcagtgatatggtttggctttgtgtccccaaccaaatctcatgttgattgttattcacagtgttgaagaaggggcctgatgagaggtgattggatgggggcagcattcctccctgttgttctcatgatagtgagtgagttctcttgagatctgatggtttaaaagtgtgcgatacttcccccctcacctgtgctctcactctctcctgccaccatgtagaaaaggtgcttgcttccctttcaccttccgccatgattgtaagtttcctgaggccttccagtcatgtttcctgtgaagcctgagggactgagtcaattgaaccaattttcttcataaatttacccagtctcgggtagttctttacagcagtgtgagagcagactaatacactcagccactcagataacctaaattacagacaaactgtggtaaatgttcttggatcctggccattgttcactgatttttagaataacagaatgcacttgcctgcattttcttcttttctttagatatggtgttgagtctcactgaatccagctaataattccctttaaacattctgttctttgagaacagatacagctgggagaaatgatcctatgacattaaaactagaattggattgcattaggtttattgcaaggatgtgagatctgtactccaaagtggggcagtgaccaggagcaaaggctcaaccactctttgtttttgaacagtttcattttaggtactgcactgggccattataggcaaattggcccaaaaggtatttcactcctggaacttaagttcatgaccaacttttaggaatggctttttagatctgactgttactttttcaccagaatgtaccataattatataccatggccttgccagaaaacaggaaatctttcaaaaattaggagtggaatagaaattttgtagtttttttttttttttcagttttaaaatgttgaatgtgtttttatccttgtgttaatatatgtttgaagagagaaaatataggctgctcttctccagagttcgaagttaaagtctgcacagcatatgggaaagtgctaaatatacatggtaattggaattaaccattaagatgaacatactcattctggcagctaagaagggatatcttcagctcagggaaaactataagctatgtttgtaagtccacccagctgggttatgtgtctgggttatagaagccaggaatcccatgcaagcgtttctaaggattacaaaaacggtcatgatgagatggaagagaacagtttcttaagaacgagcagatagaccaaaaaaaattttttttatttgctttctaccaagagggggaaaaaagtagttttcatgggaaatatgttgaaagaacagatgtcttgtgagcttaattccataaatggtgatgtgcccaagaataccctgagataagaagaaaaactacatggagtcttaaaaaaaaaaatcactgagtcctaaagtaaataagtgaatatccataatcaacaattttccttttcatattaaatctatttgcgtggaaggaaatgaaggagaaaactttataaatatgtgtaaactggagtccctggattctagagttcttttgtgaaactagtgtaaggaacagaaattgtctttttatctgagaaaaaactgtgctagttgagatgtctattttctttgcttttgactgagataactcactgtggtaacactgggttttaaattctgattggtaactatatatctatttttgtttaatacaaagaggaaaatgaattatttaataaaggaatttttatagaaaaagcattcaaaatgttagactcattgccaaaaaatatatgtcgtccttaatcgtaggaaaggtgggagctacaaacctatcatttttttgcaccaatcatggaaaattgattcttgaattcaacaaacatataaaggattttatctaagctggcaattttactaggtactgagttgatagaaagatgaatgagactctgtcgcagccctcataaactcaaatctattggaagaaaagatatgtaaacagatgattagaatctgtttcagatagcgcggaaagccttttgttccaaacctcaagaagctgcataagcttttaccacctctaaaaatttgtcatgtgtggttgagctcatgtgagagaatggtgtcagaatcaaagagggggctgaaagataaagatgaggtgtgtgagcctatgcagcagctgcccaggggctagcagacgtagttatgactagaaggacttgggtttacaaaatgcctatacagagaatggaggtgaggcattgagctcacaagaggtggggagttggaaccgaacctctgctgaagatgggtccattagaggctcgctgtgcagaaaagcaagactcgttcagtcaaacgcctaccagtgacagatgacaaagaagcttttctctgccctgactctgggaaggagcccagagtcagctctaagaaaccaaagttatcaagcctgtaccttccccaggtttagactaaaaatttatgtcactacttgtctgggaagttcctacctgaagatcacaaagaaagaaatgtacatggtccttacccattcatagtaagataatggcaagctgaggtgctttgtgaccaaaatcgagaatttaacaacacactcaattaagcaggctgtgcacattgggaactctgatactctcctggtgggaatgcaaaatgtagacctcttatagaggcagtttggcaatatgtagtaacattgcttatctgtgcgttgactttgtgacccagaagctttacttctagaaattggtcccacagacacatcttcaaaaatacaaaataacatatacacaaggaaattcattgctataatatttataatagcaacagattcaaaataacccagttgtgccacagtgggatatttgttgtcaattatagtatatccatcagagtggaatactgtgcagctgtagaaagggatgagaaagatctctattgatatggagcgattcccagaacatactgttaaatgaaaaagcaagatgcagaataatgtatttaacatattactttttatgtaagaaaagggggaacatgtgcaattatatgagtatatgattgctaataattgcaagaagaaacaattgaaagacaaatcaaaaatttacccaaaaaagttacctctaaaaaggagggaacaggatagaggagacaggggtggaagcaagccttctgtgattatacctagttatatagttttgactctagaatcaaatgaatgtattacataatcaaaaataaaattagatctgaaaaaaggaaaaaagcagtccttgaaatttaaaaacaaacagaaacaaatgaatctaattatatattaaattgttgacattcacattgagcaaataattatttcagctaactttataatacagatttttctctgtacatctcagtaggataaactccaagtaaaagaacaaaaatgcgaagttttttttagtggtctcactctctcccaggctggagcgcaggggcacagtcaccactcactgcagcctcaacctcccaggctcaatcgatcctcccacctcagcctcccaagtagctgggactgcgggcacatgccaccgtgtctggctagtttttgtattttttgtagagatggggtttcaccatgttgcccaggctggtctcaaactcctgggctcaagtgatcctccctcctcagcctcccaaagtgctggaattgtagacgtgagccaccgtgcccagcccaaatagattttagagttcatcctgaaggcatattgatagtaattgtattggttttgaattttaaaagcattatattgttagagaaaacaaataacaagtaattatgttattgttaggaaccaaaatttttcagcataagagaaaaaaatataaagtataaaatcaaagtagtttagtaaacccagtcttcaagactgagatctgtaatcttaaatctgaatttaaaacattactgttaaccaataattttctcccttttaaaaaaatatttatttcctatctctgactgaaccagactagaagaaatgataaataataaacaccccacagccggattgtggtttcccacttagtctgtgtatggtatgctgctataacaaagtcggtaggtaggtagattataaagaacagaaatttattttttcacagttctggaactgggaagtctaagatcaaggcaccagcaggtttggttgtctggtaagggccgcttttgacttttaagatggtaccttgttgctgtatcctccagagggcagggacgctttgtccttgcacacatctattcatttactcatttgtttatgtaatgagttccctagtaaacttcagtgctgacaaatgagtttattttcttttctcctacttttttttttttttttttttttttttttttgttgaaacaaggtctcactctgtcaaccaggctggagagcaatggtgcgatcatgacccaaggcagccttgaccttctgggctcaagcaatcctcccacctcagcctccaaagtacctgggactacacacaggcatgtgacatcatgcccagcaatttttttttatttttttgtagatacagggtctggttatgttgcccaggctggtctcaaacttataggctcaagcagtcctcccacctcagcattccaaagtgctgggattacacgtgtgagccatcacgcctgccctctcttaatattttttaagagcaaaagcattatttacttacatggctgcacattggcttattttatatacctttattgagatatgattcacatcccatgcaatttacccgtttaaaatatgccattccatattgtttagtaaatcacagaaatgtgtaaccatcactacaataccctattttttaaagtatctttttctagtattatttcagtgtcatcgctttttatatattaaatacattttcacaaattgaaagcattattgattttgctgctcaaattgttaaatgtagccattgtccctttcccccaggcctggcaaccactgatctactttctctatatatagatttgcctattctggagatttcatataagtgaaataatatactatgttgccttttgcaggacttctttaacttggcatcatgttttcaaggttcattgatacttgtagcatgtatcagtacttcattcctttttatggctaatagctcattatatggatatgccagattttatgtatccattcataagttgttggatatttgggttgttcctcttttttgactataataaataatgatgccgtgaacatttgtgggtgcttttttgcatggaaacacgttttcagttatcttgagtatatacctaggattggaattgctaagtcatatggtaattgtatgtttgccattttaaggaactaccaaaatgttttgcaaagagaccttaccactctacaatcccaccagcaatatatgaccgtccctacacattctcaccaacacttgttattgacttttaatagccaccctggtggatgtgatgtggtatctcattatggggttttgtttgttttgttttatattgtattgcttctccgttgttcctgtagatcactgtggctttgatacgcatttccctattggtgttgcacatcttttcttgtgcttactgcctatttgtgaatcttctttgttgattgaaaagattcaaatcccttgctcatttttaattggggtatttgtatttttattattgagttgtaagagttctagacacaagtcctttatcatatatatgatttataaatatgttctcccatcctgtcgttctcttttcactttcttgttgatactgtttacagcataaaattttataaattttgatgtgctccgatttatttttttttcttttgccgctttcgctctttgggtatattatccaagaaatcactgcctaacccaggcctcaaagatttactcttatgttttgttctaagagttttatagttttagctcttccatttagctctttggcccattttgagtttattcttttatatgttctgagactgagacttaatgagtttgacatcattttctttgcatgtctatttctatttgtcccacaccatgggatgaaaagagtattctttctccattagattgtcttggtacccttactggaaatcagttgaccataaaaaaatgatgatttgtttctggactctcaattttgtttcattgatttctttgtccatctttatgctgataacacactgtaggtaaacctactatttactgtaggatctgaaatcagaaagtatgagtcttcctaactttattcttctcattcaatattgttttggctatttttgtatttttttttttttttttttttttttttttttttttttgtgacggagtcttgctctatcgcccaggctggagtgcagtggcgtgatctgggctcactgcaagctccacctcccgggttcacgccattctcctgcctcagcctcccgagtagctgggactacagacgcccaccgctgcgcccggctaattttttgtatttttagtagagacggggtttcacgtgttagccaggatggtctccatctcctgaccttgtgatccgcccgtctcagccttccaaagtgctgggattacaggcgtgagccaccgcgcccagccctatttttgtattttttaaaacaccatgtgaatttacagttctctcaaaaattgaagaagcagtaatagaagtagcactaatagtagcagtagtcatagtagtagaagaagaaatgctgtagcaaataaaggggagggaggataaaggaagcaggtagagcagtagaatcgtttctgaaggaggacatggatgtatgggttttttctgttctttcctctggtgtatgtttggaaattctccatataaaatataattattttagttttaaaaggagaacaggctctgaagctagactgtttgtattagagctctagccctgtgacttattcatcatatgaatgtcgctaagttatttaggctctctgtacctcaataaaattgacatgcaaattgtaccaacttcatattgttgctatgaggattaaattacctaaagctctcagaatacttggcacttagtaagtattcagtaaatgttggcttggaaattgactatttttgaagggagggcggtaaaaaaaaaaaaaaaaaagagtatttttaaaagtacacgtagatttaccaaataatcaataaatctagttattcaattaaaaacttagtggcaagttaacgtatatgaaaggagaattaatgaacttgaagattctgccgaaattatccaaaatgcagtgcagaaggataaaacaaaattgaaaatatcaaagagagattaggagacatggaaaacagactgagaaggtacattcatctgataggagttttgagaaagaccataggggaaattcagaaggaccaatattgcaaaataggaaagtatacatttaaaaaactggaaattacagattttgcaaattagaaaataaggaaattgcaaatattgtaaaaaagagaaattgcaaaatatttagaacagggaaaaacactttatatcaaaatttgtgagatgctgctaaagcagttcttggaggaaaatttatactcttaacacatatataaaattgaaaatgaaaaggctgggcacggtggctcacgccgtaatcccagcactttgggaggccaaggcaggtggatcacttgaggtcaggagttcaaaaccagcctggccaacatgatgaaaccccgtctctactaaaaatacaaaagttagctgggcatggtggcgggcatctgtaatctcagctactcaggaggctgagaaaggagaatcgcttgaacccggaggttgtagtgagccgagatcacaccactgcactccagcctgggtgacagagagagagactgtctcaaaaaaaagaaagagaaagaaaaaaagaaagaacagtaatgagctaagcatccaaatcaagaaatagaaaaagaatatctgtgtaacccccaacacacacacacacacacacacacacacacaaaagaacaaagaaaataaaaacaaattaaatgaaatagaaaacaagctgtaagagaagatcagtgaaactaaaagctagctcttagagaggatttaatgacttaattagatgtgaaatacatagtgagacagattgttcatgaagaaaagaccagatattataataattttaacagtgacttaatctgatgtcccttcagacttctattactaaagaattaattagtctgcttttattctggttaatagaacctgcaactgaactctcagattttttttatcaatactaaaacacaaatctaattagaatttaaactttttcttttaatagctgcgtttggataacctatcctgtctcttagcttatgtattcttctatgaaatgtagtttctgtaacaagttattttaacattttggacattgacatttttgtcgtagaagaaaaaattaacagaatagacaactaactcctttttcctctgggagggtatgtatacctggagatatacattgatagcaaagaagtctatttcagcaagtttcttccttcttcccttcttccttttttttcccccttccttccttcagacaacgttattctttatgtcgttgggaccaggggtttcatctccctgcacatgcacctggcacggttcaagaggaaaaacatttggatataaaatatctttcatgtcagtaaaacatgaaggaattactccttttgctttttggtcttatcttgagaagagcatactatgagagccccttaagagcacagagtcatttatatgatctgtgtaacatctaatgctctgtgagctgtcagatatttagtgctcaacatcataactatgcagggaacagacttcacaccaagtttcttcatactagacctaggaacactaaactttgatcatcttcgtgtctttttggaaatggagaagtaagttcttacaactgtttttttcattctctgacgtggatcaaataaggaatctttggtcttatctgtccacttggatcagtttttttcaggcaggcatacgtactcactcctaagaagtactttaaatgcgttctgccttgaaaatggatttgtgtgtactttattaggatttctttttaagtttttaaacttatgctagatatcagatattaaagattgtctcatgttctaagaaaataactagccaagtctactttcacccacattcctgttaaagtcaacatggaaaggtttcttaaccaattgaatgacatgatacagatgtttcgctcactttctgtatatgcctctttcctttcttctattttccttttttctgagagctgctttgcagaagactttgtcatgaaataccacatgccataagaaaaattagcctacatcttttcaagattgtcttagtccattcagactgctataacaaaataactcagactgagtaatttataaacaatagaaatttattgctcaccattttggagaccagaagtgcaagatcaaggcagcagcagattcggtgtctgatgagggcttgctctcggcttcgtagataatgctgcttcactgcatcttcacactgcagaagggcaaacgggctccctcgggcctttttccaagtataatggatacatttatttatttactcatccatttatttattcattcatttatttactcatccatttacttattcattcatttgcaataatcctttgaacaactactgtttgcaaaaaaaaaaaaaagtatgttatttgccaccagtttgataatggagataacagttctatatgaaaaaatcgatagttggtctcacaagcaaagtgtgctgggagagcaaaaacagaagaaaaacattattttcatattttctcttttgagtgagacactgtcctctttaggagttcagtttcctaccagtgatagaactagatatttacatctcccaaatcaaagtacaaactttggccatagaaccttgttcctcgttattttctttttattttcaacttttattttagattcgggggatgcatacacaggtttgttccctgggtatattgcatagtaccctcaggccttttttacagggatgctaatctcattcatgagggttccaccctctgacctaatcatctccaaaaggcccatttcataataccaccaaatcaaaggttaagtttcaacatctaaatgtggggagagccgggcgcagtggctcatgcctgtaatcccagcactttgggaggctgaggcaggctgatcacttggggtcaggagtttgagaccagccaggccagcatagcaaaaccctgtctctactaaaaatacaaaaaaaatagccagcgtggtggtgtgtgcctctaatccgagctacttgggagtctgaggcaagagaattgcttgagcccaggaggcaaaagttgcagcgagctgagatctcgccactgcattccagcctgggcaagagaacgagactccggctcaaaaaatataaataaataaataaataaataaataaataaatataaataaaataatataaaattggggggaacacaaacattcagaccatagcaaaggtctctgggggtcctcccagaaaagagaaatttgattcacagataatttattaatcggttttttttttttctatcgttatgtactggagggaggaattgactttaaaatgtgcttacattattaggtgaaaatgtaaagaacctaaatcttcaacagtatgggactcactaaatatccattcaggggaccaggcacagttgctcacgcctgtaatcccagcactttgggaggccaaagcaggcggattatatgaggtcaggagttcgagaccagcaaggccaacatagtgaaacccatctctgttaaaaatacaaaaaatagccgggcgtggtggcaggcgcctgtaatcccagctactcgggaggctgaggcaggagaatcacttgaacccaggaggcagaggttgcagtgagccaggatcacgccattgcactccagtctgggtgacagagcaagactccatctcaaaaaaattaaataaatggatatctattcagccaaatgctgtgtagccagttaaaagtagattttgggctggtcaccgtggctcacgcctgtaatcccaactctctgagaagccaagacggggggatcacttaaggccaggagtttaagaccagcctgggcaacatagtgagaccccatttctaaagtttctaaaaaaaatacataaactttctaaaaccaacaaataaatatatatacatatgtatatatacacacatatacacgtatacatatatgtgtaattttttaaaacagtattttagaatactatttaatgacatgaaaaaatggtcatgataatgatgatagctaaaatgtattgggtgtcagttttacgccagacacctttttaagtgctctccttgtgttaattcaacaggttaatcctcacagcagtcttatgtaggagaaaactgttgttatccccattttaaaggtgaggaaactgagactcaacagcatttacatagcttgcctgaagtcagctggtgagagacagagctagagtttaaactcaggcaatttggctcttttaaatcccttgctcagacatattacatatctctgtaaattttttttatgaaactagacaaactatttttaattcatctagaaactaaaatgtgttaaaaataacctgtcaaattttgacagagtagaattggtggacatattctaccaggtatgaaaatatgctataagatatagtaatttttaaaatatcctagtgtagctgaaatagagaaaaagtagaataaatcagaagagcatgccactttttatgttcacagggaggggactaaatggatacacctaaatattaagagtgacaatcactgatagaggaattatagatgatttttctttcttttctcttttttgtttgtactttattttttaaattatctataatgccaggagttcaagaccaccctagacaacatagtgagaccctgtctctacaaaagaaaattttttaattagctgggtgtggtggtgcctacctatagtcccagctactcaggaggctgagttgggaggatcacttgagcccaggagtctgaggttgcagtgagcagtgatgatgccactgtactgtacagcctgggtgacagaatgagactctctctaaaatataacaaagaaaacccaaattatctttagtgagtatttttaaatcatacagtattagcaagtttatttttaatgctttaaaacttcaagttttaacaatattttactagtgtaacatattgctgtttgattttatgcatcatgtaccctggcattttctaagctgcttactctgcagagttaatttttctaaaatgttcaatatattattcatttattcaaggcctaaattaaccactcacacagaatcactaatccagtcttcctttttgataaagatggagaaaagacaatgggattatagtccttttctggcttagggttgaggagaaggatttcagaacttttaacttatttttaagactcgaattgtttattgatggtataaagaaaagctatttatatatatatatatgagagagagagagcacttctgtctgaacacctcactgaactctgtagtaaattgtaatagttgttcaattgatttttttattgagaccctgtctctacaaagaaaattttaaaattaagcatggtggcgtgcacctgtagtcccagctgctcgggaaactgaggccagaggatggcttgaggccaggagcttgagacaagcctgggcaacatagtgagaccctgtctctttattttattttttatttttttaaaaagacagttcatgaagtgcttgatttggggatattgcctcttccccaaaaatttctgtatcaatttaattgccagtcttagcccaagctgccataataaaatgccattaactggatagcttaatcaaacagaaatttattttctcacagtttggagaaatcaaggtagtgtttgattcagttcctagtgaaggttcttcctggcttgcagaggctgcctaattactggatcctcatatgacagagatataaagagaaatccctctatttttctcttcttcttcttacgaagcccagtcctatcagattaaggccccacccttatgacttcatttaaccttaattacctcctgaagaccctgtctctgggtatggtaacgttggggtttaggggttctacatatgaatttgggggaggcacaattcagcccgtagtattggctaaactctttccagtatcctcagaaatcccatatttagtttattttattgcagacaggattagttttatcctttcttatggaactcttaaaatactcgttactttacagtgtgtcatagaaactttacttaaatttaaccttatgaataatttcttcctagacgcaaaatcgaatgaagctaatggccgacaactacgaggatgaccacttcaaatcctcccattccaatcaaacaaatcacaagccctccccagaccaggtaagatggctctggaatgttttattaaaaaacccacacacttaaattttgaaatgtttttgtactagcatgttgcaaattctgagatataagttagaagaataaaaataaatagctaattcagttctgaaaactctactcttttcaaaaaaatcacagattcagtttctttataggaagaactggatattttaagagcagatacttgaaagatttgaacaataaagaatgcttgaattgggttgagaaaaaaattaacctcagagatacacactaataatatgtaatttttaactgtctttactaatttttaactgtcttggttttctttttaaagaaatagtgccttattagaaaaacaagactctttccttacaagcctagtgaggcacagtttggaggttatttctgtttagttgcaaattatgaactctctgctcattacctattaaaagtgaagattgaaacttagttcttcactccctgtccttgtggatccctccagcatgtcatgcttaaggaaaattgttgccttcaacttctcatcaatgcaaaagagatattgatgaatctgaagggaaccatattccattctagtttcttggaagaagggaactctccccaaatcttgaaaatgatggatgggagagaatggtgaacagattacctcatatcccattaccaaaaatcaaattttaacatctctatcacacccagtcttaaaatatgtagctaagggaaaaaaaaaaccagtcaggtaatcacatccatatgactaaagcatcaaggaaaactttcctgctaaacgtctccactaaataacagctatggcgttatcttagcagaagcaggagaaatagtgcagatgaaagcagcaatggtattcaaattgctgttgcttccaagattcggaaggtatagtcctattatgatgacgtttcctaagccagttgaggcaagccttgtattttagaaggaaaacaatgtaaatatttaatgtgggcaaaatggagagctatctgcctggtgtcagcagtctttccctgccaagagatcattttaccttttctgcctgcttcctgatacctggaactgaatttatgccagggtatataagatgcatgtttgattcctcatgaaaacaggtttttgataatagaactggatgcctggagtaggaagagacaaacagagaaaggttgaaggaaaagcaaaacataaagaaaaacctccaacttggtaattttgcccagatccagccctgagatagagatagcatcttggaaagtaggaagaaaagaagtataatgacaaactacagttgttcctgagtatcctcaggggattggtttcaggacaaacccacccacaaatgccaaaatccatggttgctcaagtcccttatataaaatggcatagtatttgcatataagctacacacatcctcccatatactgtgttttgttttgttttgtttttgagatggagtcttgctgcgttgcccaggctggagtgcagtggcatgatctcagctcactgcaacctacacctcctgggttcaagtgattctcctgcctcacccttctgagtagctgggattacaggcacctgccaccatgcctggctaatgtttgtattttagttagagacagggtttcaccgtgttggccaggctggtctcaaactcctgacctcaggtgatctgcccgccttggcctcccgaagtgctaggattacaggtatgagccaccatacctggcccctcccatatactttaaatcatctctagattacttgtaacctaatacaatgtaaatactgtgtaaatagttgttatactgtatttttaaaattttattatcaatgcattgttattttttattgatttatatatatatatgtatgtatatgtatatatttcatccacggttggttgaatccacagatgtggaacctgcagatacagaggaccaacattaactactaattttgatagtttagggaattagaatctgtatgagagagtcaagaaattctcttctgctacattatgcttatgtctttgttttaaatactaaccacctctttttcattccatgctgccctggggcattgcccccttgtcatctctctccctgtaggatgaggaggagggtatatgggcatagccaatcagaggcttagttcagccattttgttcagaacggtgagaaacagctttccttaactatagaaatggtttttgtttgttttcatttttctttttacacagtaactctcacatctcatttctctgtaattcatgaaatccctggtgtgctttctgtttttttattttcacgtgattcttgtgtgtgttgctgtgctgctgacatagtggggtttggattttgtggcttttttttttttttctcgttgtgtgttaatagtcacttctgtaatttctttttatacatttttgggagaacttctaggacgtgtaactaaatttctccagttgtgattttattaattaccctttctagggtgattttacagtgtcctggcaaggtttatagtaattttatatgaaattggcaatagaaaattgatcaagtactttgctcattggcctaagtttgaggtatactttttatgatgattaattataaatacatggtgtttaaaaaaaaaactgtactgtgaactaaaacctccttttgtttgtttctgtagaagaatgagctctcacagtcagcacctcggacacatcccctggggctttggcattaccctcaaactatccctaaaaatattgaggagcaaagtaaaggaaaactttttttagaagtcattctaaaaattcttttccctcccttttcatggattgctgcagtgttcaacagttgccaggacactgtctagattctccttttcaggacaattggctggaaagtatagtccagccgtggcagtatctccctttgatctgatgcccttgaggtttgactaaggaaatccttttcttagaaaaagtaataattatgattaataagttcacacatatttggtggccttgcactccctggattcactgcccatgcctatcagtgatctcactcccctggagtcagttctccctgaaatgtctttgtcttggtgttaaacttcttaaaatgatgaggacatgtgtagatctcttaacgttgagcacaaccaagaaggatggagaggtaagttgtggaaaggggccatgcgctgtgaggtgggaagctgtccagatggctttatcctgagggcatgaatgaagttgaaacgcactgggtcaaccagaaagctcttcaggttaggatgctgcatgtcagagaaagctaaagctgagagcagtcaatgtgctaattatctgcactggacaagggtaggtatttgtcatcatcaagcatgtgagaccgtgcagtagctggatgtagtttactggtctcttagaaatgagcatgcccctaccttgtctattttggcagaacataggagcttcttagcttccttcagctggaagcaccacatatgtggacatgattatatttttgtcgcaaatcctttttctggccaatcagaggaagcctgttggtattctaggaaacaggcctataggtaacttcaccaggagactagaaagtaagcaaatcagtatataaacttgttcctgaaatcttcattttcctttctctaccaaaataggataacttagctttttccaattatcgcactattgagcatattgcactaatatattaactttcattggtttaacaccatgcaattgcaattagccagccataactggcgtttctatgatatggtgtttccaattttataaaatgtgctgtaaacctcattatatcataaggattttacctaaagaaatgcatgagtgacccctaaaacactgcagaagttttgactggctatccactttccttctcctgtttcctcactaattttacagaagatagattttctttagaaattcaaacttttgaaattgacgatttaccttatcaaacttaaaaacgtgtgttttgcatctgaaacattttctaggacaccaatacatactgatcaagtgtgagccttacttgatgtatccatagatgggaagagaatcacagatgtactgagctgaaaaggattctggagttaggccatttcaggagaggtggtaaaacgtaacgcttaagagtgtaggctttggagcgggatgcctatgttcagattctaccaccaccatgtactagcttctgatttggacaaggtacgtcattgcgctgtacttcaatttcttcatctttaggatggaggttgttgtggggagtagataagttgtgagacacgtggactccagagccagactgcacagctttgaatctagacctctccacctgccctgtgaccttgggaaagtcacttaaactccctgagccccagttcctttatccaaaaaatgggtttatgaataatgcctacttcctaggattattggatagattaataagttgatagctgtagaatgctttgagcagtactgtacatgcctttgttatgctgttgccgttgtcatcattaacttagatccgtctccaggaaatagtaagctttcaataaatgttagttcctgttgttactaacatcatcgtctaatccagtgccctcattttataggtcaggatgcaaaacaaagattgaaaagttgtgacttaaggtccccaggcatttctgtggtctggaaggaagaactagtatctgacagtaaaagaggtagtgaagacatattgatggtgatagctgtcttccatcaccacaagtttcatctcctatatgttgaggaattttttcctttgggaaaacaccttgaattttataaagaaattccctattgtatgacatttagtcagtgaaatctttgaaagaattagctgtcaagcagccctcctaagacacacggactgaagcaaggactgcctccactcataaaaaaaaataacagttccttcactctcctcttggcctatagaaaatccatgtgagggccagactcggtggctcaagcctgtaatcccagcactttgggaggccgaggcaggcagattggttgaagccaggagtttgagaccaggctggccagcatgacaaaaccccatctctactaaaaatacaaaaattagctgggtgtcatggcaggcacctgtagtcccagctactcaggaggctgaggcacaagaatcacttgaacctggggggcagaggttgcagtgaaccaagatcgcaccactgcactgcagcctgggtgaaagagcaagacagtctccaaaaaaaagaaaaggtaaaaaaaaagaaaaagaaattggttctctctctcacatgtcattctgctcaggcattcatgttaggtgttctaagttcaataactaagtagaatttgagcatgatttgataagttatgtaactattcagtaaatcacttgaataaatgtctatattgtaatgtgtttaaattgcactgggtccaatagccatgaagtcttatatgactatctcagtcagctcaggctgctattgaaaatatcatagactggatggcttaaaccagcagtccccaacctttctggcaccaggaaccggtttcgtggaagacagtttttccacaacgggggcttggggaagatggcttcacaatgaaactgttcttcctcacatcatcaggcatcagttagattctcatcaggagcgtgcaacctagatccctcccatgcccagttcgcagtagggtttgcgctcccgtgagaatctaatgccgccgctgatccaggaggcggagctcaggctgtaatgctcgcttgcccgccactcctctcctgctgtgctggacagttcccaacaggccacggacaggtgctggttcagggccctggggttggagacccctggcttaaaaaacaaacatttattttttactgttctaggggctgaaagtctgaggtcaggatcccagcgtggtcagatgtttggtgaggaccctcttcctactttgcagatggctggcttctcactgtgtcttcacagggctgagagagagaggaagcaagctgtctcgtggtgtttctttttataaaggcactaattctatcatgagggctccaccctcaggacctaataatcttcccaaagccatccagataccatcattttgcagattagggtttcaacatatgaattttgaggggacacaaacattcgattgatagcaatgacgttgctgactcatagatctcagtggtgcacatgtgacttagtctccgcccaacagggagttccagagcaaagatttcctatgtaagttagtttatccatgccactctctatccgtttactgtaagttttcttcttttttctttctcctttcttcccctcctccccacctccttttaccctccctcctcctcctccctccttactgtagaatgtaggccccatgaggacagggactttaatatatttacttatgtattcccatcatttaaataaatgcccaggatatagtaggtcctcagtaaatatatatgtgtgtgtgtgtctgtgtgtgtgtgtatttatttaactactgaattcacaaaaatccagaaaagtaaaagtaaagtttacattgaaaccaggagcatagaaattggttgttagctttattgtcagcactgctattactagaaagggaagataagaaagatgaatggaaacaaaagaattttagagaaatgttgagaatttaaaggaaaatcataatgaagtcctagagtctgcctcctgaaattttacactgaatataatggagttgaatgtaattctgaaatctttttcatttaccaactgaaaatccttcgggtagaaactttccttccagtaacctgtggttcttagccatcaagaagaacagcatatgctctttctggacttcaccccgtggagcagtttgtgtgaactggtgctaggtcccttcagtaaaggatggacctaccaaggggcttaaaagttggtcttggtataagaacatgccacttactacaatctggaaatggcctgcctattagatcagcactgtagcatctcaaaacaggatttggaccagtatgctagacttttctttttcattagagatgatgtaaatattaacacaaacttttaagacaagtgttgtaaaacaagcatctccttctcttttggcatttcctttttgtccatcttagtggagttgtcagtgtacttatcagttggaaacatcctaaaattattctcattgcaacagtgcaacaatggaagccttaaatttctagagaatacatccatagaagggaggtgttaaattatcttgcagaattaaatggtgcagtgaattgcactgctttcttggtatggagaaaatggtccaaaaaccaatttgggccaatatcaggactgacttttgatatgacagacaaggaagaattcgatcctctattttcagaagtggatcagagattttagcaagaaacttctttcctggaaagcttagaacaaagccaatggaattaaagaagcacaaggatctagctgctgagaaataggagggagaaaatgaacatttattaagcatttactataggtccagcactttcatgtatcttatctcatacagggctcatagacgttaaataattttccaagattacacagctaacaagcggcagatatttaaacccaggacagactccagaccccctgctgtctccattacaccatacccaaagaggagtcttccattttccagtctagttccttggacatagtagacaactccatggaagggtgttgaattgaattgaattcctaactggggaaataacaaaatggtctttgctggtaaggaatatctgtaggttacccaagacagaccctcactgaaaagaaactaagtggtttctgagttcactgataaatgtgactaaccaggaatctagtgaggaatttggaactatagaagggagaaaaaggaggtcttggaggttgagtaaagtttgggaagatgaaacaggaaaagaaaagttttcagataggaactaacttcaaggaggttccaacctaagaatgagaatatgatgtgtaggggctggtgaggaaaccagcccaagtgaaacagagggtgtctgtccttccattggttccatggctatccccacccacacttctgttttaatattggacacccataattcaaagagacaaactacagatgtgaggagctcacaagaacagttacatattaagctttacagagaattaaagtagtaatcagctgcctttggacgttgtctgaatcactgtcttctaagttgattgtccctttatctagttctgttgctttcaggtcctagtcagaaggtgggctttggaaccagattacttggtttcaaactcctgtgtacctcactttcttcatttgtaaaatcaggataataatacacctgcctcagagggctgtttgatgattaaatgaagtaacataaagcccttaaaacagaacaatgcttttacatatcagtagttgctcagttaatgttagctattagctggctttaacctgaaggcacaagctgaccacttatagcattaatacccttcctgcttttatcgttcccctcccttcttcactttctctgtcttcctcttggctctcatttaatgggagtattgaataagagttccttactcttcaactctggattcaaactattcttgcacaacctgaactccagtttaatagtgtttcctctatatgctcagaaatgtctttagtttactgtttgacctcggcacaccacctgttttctgcttttcaggtttctcttcttccctcctctccacaaagaaatttaaaatcttcatttctgcttttcactgttttccagagggttcactccctttacacctcatccttctgtcctggattctcactagctgtctcagaactctgccgtctgctattaaaagccaagctttctgccagccctttttgcataccatactcagcaggtcccttctgtgtgcctctatcttctctaagtcaccatctcatctcatgagcatgtactgaaacacataaacagttttgctactgctgctgctttttttttttttccttctcccaagcaacttgaacctatgtcaaatcaaaaaagattttggaggccgagcgcggtggctcatacctgtaatcccagcactttgggagacccaggcgggcagatcaccctaaggtcaggagtttgagagcagcgtggccaacatggcaaaatcctgtctctactaaaaatataaaaattagctgggtgtggtggcgcgtgcctgtaatcccagctactcggaaggctgaggcaggagaatcactttaacgcaggagacaaaggttgcagtgagccaagattgtgccattgtacttcagcctgggcaacagagcaagactccatctcaaaaaaaaaaaaaaaaaagattttggaaaagagttatttttgacaaaggcattgggaaataaagagtaaatgatggatgatgctagtagttaccatttaaagaatacctactaagtgccaaacactaagttgtaagtttataatcacattgtaagcatgttttcattgaaaccaatataacaatcctaagagatagataccattttcattattttactgctgaggaaactgaaccatggagaagttagctaacttatccaagttcacatacctggtacacagtagaagccagatttgaagccagatatgtctaattatatcaaaacttgacctacctctgaaggatacatagctagaaggattttttaaagacgttattatgcctttgtgttcatgctgattacaagagagaagagagtaaatgatggaattcaggacatgctaccccaaaatatggcacgttggcattggatacaacaacagaagcaggaaggtctctctgaccttctcctcacccttcttgcctgaagcaagctataaagaattttctgacctgcctctaaagtaagtcataaaaccttcattgcagaggtacccaccccatagctgaaggaaaagaatgtccttatctctgaagacagaggaacacaaagaacaacaggccttgttaattcctcccagtttattactgttattagattagacccaattgtcctcaaatcaatttctccatgactgtctcctcttcatcatacacagatttccttcttttctgaagtcttcattttctttctttctttctttctttctctttctttctttctttctttctttctttctttctttctttctttctttctttctctctctctctctctctctttcttttctttctttctttctttctttctttctttctttctttctttctttctttctttctttttggagacaggatctctctctctgtcgctcagactggagtgtagtggcatgatcatagcttaccgtagcctcggactcatgggctcaagggatcctcttgcctcagacacctgagtagcagggactacacgcgtgtaccaccatgccctgctaaattttgtattttttggtagaagcagggtctcactgtgttgcccaggctggtctcaaactcctgggttcaagcaatcctcccacctacgcctcccaaagttctgtgattacaggcctgagccacagagaccggctgaggtcttcgtttctgaaggctcccacattacataaaacttacagtaaataaatgtgtatgtttttctcttgctagtctctgttatagggttctcccccattaacctagcagtggatgaaaaaagaaaatctcttctcccctaagaatattcccataagaatatccaattataaataagactaacaataaactccttttaaaatctgagtagaaaaggaccccatggtagcaatgtatgtatgttggactaatttgtaactattctcctaagtgttgaccttaatctttctggtaatgcattttaggattagtatactacaaatgtactttttctccaaaattatacgtcctggatacatttctttatgtagatatgacatacctttcttgcttcaaatatcaataacatgtagtgtaagaagcctccaagagtgtggtctttttaaagctggaactcacatcctttattctatctagtaagccatctctcaggtctcattcttgagaagaaaaaaaaaagctgacaaaatttctacatttaaatttatttttcccttaatgtttcatatcaaaatggaagccatgtttttcatcatttcattcaagacataaaaccttgtgaaaaaccaaagtaatggaggaaatgaggaattgtcgtttagtggatatagagttttagttttgcaagatgaaaaagttctggagaatggttgcacaacagtgtgaaagtatttagcactcctaaactgtgcacttcaaatggttaagatggtgaattttatgttatgtgtattttgctacaattttaaaactttcctaattaaaaaagaagtaatggtgattttctggcaaaaaaaaaaaaaaaagatacattcaaaacatgcactgaatattattttgaaaatttttcttagtgaaaagaggcaccttcctctttcccaggtaaacatttcaaggttttgaaatggaaaagaactacccttgaggctttggtttagccttttgttctctgcttgggaaccgggcttatttgtttgtttatttaactggttgctttattagcataataaagcatgacactgttcttccttgatttgaactgcttagaagtctttaaaagaatcatttgcataatttattatttttaaatgtgttcacattcagcatttcctttaacaaagatacacacctataccttttacaaagactgaatatttaggcaacttaacagctacaaacttaactttttaatgaattgaagcacttttcattcaatagagatacaaatttggagaccatcttttagaaattggatccagaaaaatactctgaaccagggactgacttaaataatttcccaacatcaattaaatgagatttttcctttaaaaaaaaagttgttttgctttgtgaggttaaacttttttttattttatttatttatttgtttatttattttgagacggagtctcgctctgtcacccaggctgtagtgcagtggcacaatctcggctcgctacaagctctgcctcccgagttcacactgttctcctgccttagcctcccgagtagctgggactacaggcacctgccaccacgcctggctgatgttttgtatttttagtagagatggggcttcaccatgttagccaggatggtcttgatctcttgacctcatgatccacccacctcggccccccaaagtgctgggattacaggcatgagccaccatgcctggccgaggttaaacttttaagcaaaaccctacaggagagttatctggaactctttacaaaatgagtgtatttctttgtgagaagaacagtgtgtggagtgcaagggtgtgcatttattggtttacttccccaagcccagtatttttgtttgtttgtttggttttggtttggggggggggggggttaattataaagcattctattattgtatttaaatcttttcctttattattatttttaaattgacatctaataattttatgtttatagggtacagtgatattttgataaatgtgtataatgtataatactcaaatcagtaattagcatatctgtcacctcagacatcatttctttgtgttgggaacatttaatattcactcttctagctattgaaaaatacataacaaattgttgttaattatagtcaccttatagtgctatggaacattagaacttgttcctcccatctacctgtgcttttactcgctcagcggattcttctcacccactgcacagaaaagccaatacactgagacagcagcattgcagtagagaaagggtttaattatctcaaggcagctgatcagaggacgagagatatttctcaaatcttcctccccaagaactcagaggctagggtcttccaggataatttagcaggctgagggctaaggaacgggtactgctgattggttggggttgcgatcatagaggtgtcaaaagctatcttcatacactaaatcagtttctaggtgggggtcacaagaccggttgagtcagttccttggtatgagtaacaggtccgagtggagtcagttggttgccagaatgcaaaagtctgaaaaatatcttaaagaccaatcttaggttttacaacagtgatgttatctataggagtaattggggaagttacaaattttgtaacctccagctacatgactcttgatgagtaagcaattttagaaaagtaagctagggaacgggctgcgcacagtggctcacgcctgtaatcccaacactttgggaggctgaggcaggtggatcatgaggtcaggagatcgagaccatcctggccaacatggtgaaaccccatctctactaaaaatacaaaaaaaaaaaaaaattagctgggtatggtggtgcgtgcctgtagtcccagctacttgggaagctgaggcaggagaattgcttgaaccagggaggcagaggttgtagtaagccgagatcatgccattgcactccagcctggcaaaataagctagggaacaatggctggttatcatttaactacacctacatcttagcagaattcagtcttttcccataatcctaaccttgtggcctttcatttgtcttacagagatggtttcagtcccccgtgggggtcagcttgcagagggactattatcatttttgcttcaaagttaaactataagctaaattcctcccatagttagcttggcctatgcccaggaatgagcaggggagtgagcttgtgacgttagaagcaagatggagtcaggttagatttttctcacttttataattcttgcaaaagcaattttatattcattaacccacccctggctttccccttccccctacccttcctggcctctagtaatcactattctactctctgtttgtatgagatcaaccttttaagcttccatacatgaatgagaaagtatggtatttatctctctgtgcctgactttttcacttaacatattgtcctcccagctcatctgtgttgctaaaatgacagaatttcattctttttttttttaatcactaaatagcattgcattgtatagatatttgccacatttatccattcgtctgttgatggatacttaggttagttccatatcttggcagttgtaaatagtgctgcactaaacatgggagtacagtgatctctttgattactgatttcctttcctttggatatatacctagtggtatcatagctggattgtatgatagttctattttagtttgctgaaaaccctccatgctgttttctgtaatggctgttctaatttacattgccacaaacactgtgtaagagttcccttttctccacatcctctccagcatttgttattttttgttttttggggtttttaaataatagcgattttgattggtgtgtgatggtatctcatggtttgcatttgcatgcaaatgattagtgatgctcagcattttttcatgtacctatttcaaactcagcgtaattttggttgggaggccgttaggctaaggcagctccaatgccctgagttcctacataaacaaactgaaacccaactctttgtaaacagtcatattctaggccaatcagaaaccaccaactaaccccctacctaggggctttccaatactcaagtttaaccgatcaggaactgcctggccaacctctaaccagggactttccactggaatgatccaaaaaacattactgccccactttaaccaataagagattttctttaccttgcttctgctttcaccttacaaaagtcttctaccagtctcttcatcagaaccccccaccacttatggcctaaggctgcctgattaacgaattgttgtctgctcaaataaactctttaaaattttaacgtgcctttgtttatcttttaacagctgtttaatctcactgtgatcacaaaccatacattgtattgtcttaattattttacatttttgagactgttgttttatggcccaaaacatgatccatcttagtgaacataacttgtgctcttaaaggaatggtattctttaattgtcacatacagtgttctgtaagtatcaactgggtcaggtggttgatagagtctgtcagatcctccctgtcttcactgaatttttgtagagggagaggtctgttaattgcagagaaagaagcattcaaatctccaacaaaaatcggagatttttctgcttgtcctttgaattatttcaggttttacattgtattttgaagctctggctgtgtttgcagactcatttatgattgttatatactcctgataaactggccttcttaccactgtgaaacatcccttttgattttcagaaatatcatttgtcttgaaatctactttatctgtcttaaatcagcaaggggcactacaaagtaacagtaaaggtagatgtaaatattgttaaacaagtaataggtattcaatgaatacttgttgaatattgaattttagtattttctgggtggcagattgccagataatatggtttcgtgtgtgtatgtacgtgtgtgtgtgtgtgtatgtttcttttttaataatctattttctaagtctcagtgtggatgagatgctgtggataaaatagtactcacttcaggaagttagttacctccaaggttgactgagcgttggtcctagccttctaataactaatattgaaggaagaagcagctcataatgacataatgaatgagtaggcaatctaccttaaatctttagagaaaaaactaatgattgaacatacaatgtcaggtgttttcaatagaggggtaatagaagaattagagcaggtcaggaaggacagcttcataaatacgacaccttatgacctttggctacagttttactgctttcctgatatttgcttgaaccaaagctcattctctgtataccaacacaagtacaattctattctgttctttagctgtttaaaacaaagtggtttcttcatatcacgatttaaaaagagtagtctcttatgtctctaaaagaaccattgggaaaaaagcaaaaaagagtagtttttcttaattctaaagatcctcaaggcagtggtgtcttaaccaggaagacaggagagacccaggcagccttaggaagctcactgtcatcctcccttttcctcttgtttcttcatccctagaagtaaacaaactaaaaatggttttgacctttgaaaaagaaataaacactgaagtaattgcctgtgattctctctacccagccgtctgctgaaagtgtgtcttgagaagagcttgagatgatagatagatagatagatagatagatagatagatagatagatagatagatgatagatagatagatagatcgatagatagatagatagatagatagatagatagatagatagatagataatctgtctctactccacaggtcgataatagctcactaacgcatagccagggagatgtcagagtggcttgagacctcaagaagctttttcttaaatccttaaaacctaagaacctttttttttcttttcttattgttcagttgcctgttaattttttgtggggagtaggggttggaatagcatgctactgcttagagtagaacagggttagaattctttgctgccaggagtattatttcctttaaatttgtgtttctgttgtgtaaacaaaactatctgcttcctggaacataaagcacatacataattttagtaggcacttatgctggattgtgcttggtagttggcagtgagagcactttttagtgtgatggcatagccacatctcttgtggggacaggaatattttcctgttagagtggatggtgacctcttctgcattctgctttcttccccttccccacagacttgtagaagctcttgacaaacagagcagagaaacaaacttaagtaccagcattctcaccagcccaaattcctgaatctctgactgtcctaagacatgccagttgtctgtacctgtgcagcctttcctcatagcaaggactggaacagaggaggaactggttacagtaatcatcattcccctgtgaacaaaggtctcacgcagtcatttctcctcagtgtgttttcggcttcacagaatgactgtgagacaatgttgatctgtttacgtcacttagagctttcagcacatccttttaatggccaaacttactttttttctgacagacttagtattaggatcaactatcatttttctggccctaatgcacagagctattaaattcctcaaggttcagatatgtctgtttttctgcgtaacatgaattatccaagaaaaatgtagacacctacttaaagtaatagaaaaagcattgaatcagggtcagagacttcaaagtaatccattaacctcttggtacctcagtttattcatctctgaaatggaagtgatgataactatcctacttttcttgaggcaccgatgtaatgaatgtgaaagtagtttgtaaatccataatttgccatacaattaatagctgttgtttactaacctgtaggtagccaccatgtacttctatatagcttttgcatagtatctgaagtctaacacagggagtttttagattttttttttttttttttgagatggagcttcgctcttattgcccaggctggagtgcaatggtgcgatctctgctcactgcaacctccacctcctgggttcaagtgattctcctgcctcagcctcccaggtagctgggattacaagtgcgtgcaccaccacacccgtctagttttgtattcttagtagagacaggttttcaccgtgttggccaggctggtctcgaactcctgacctcaggtgatccacccgcctcaacctcccaaaatgctggcattacaggtatgagccactttgcccggcctttagaacattctttacaagtaagttagaggaatgtcaataggagcagggtgtagtcgtttactaatattggaagataccagatttctggatttttagggttagtctcttttgttaaacattaatattctctagaactcaattacttttgaataacttgcagaaattcccagaattctaggatctttgctctagactatacagcttttgccaaatttagactacaactatattgtacgttttgtggactacagtagttcgtctagtgtggtatagtaatgcatactattgcagatttgaaagctctgtcaacattatcatatcactggaatgctgcttttatttcttaattctaccccaggttgtcttaccattctgtctttgtacctctaaattcaatgtgtcgttctttttttcttcataatttagagtggtttgtgactgggccacattccatcttccacctttttcgtaaaaaccattttttctccatagaagtatcaaaacctttggaattccttcaaaacagctgtgtctgccctccttctagtggcccactagaacatatatgtctggagagctgcagtgcctgggacactacaggcagatatatatactttattcttaactagaatttctctgataactggacaccagcctagaagtgtctcagacctgctttcatctgctctttgtgttcttaaatcccagacagacccttccagaaccagatgaccatcaagacaaaagcatactcaagcagacaagaaaggagtaggtctcaccatatctcctagatttataatgtgtgctctctacctggcagacactacacatactgtgtaaagcactgctgggggccttctttgtgtgaaacctgggtgcctcgatgcctatcagaacttttacatgaggaagttggattggaggagagatttatagtcaacagtaaccacttaacttggaaaacagaaaagaaaaagaatcgtccataatcccatcaccccgatgcaatctcagtgaatatcacagatcagcattactgtttctcttatgtgctgttgtcataattgtgatacatgacagtagtgcaactataaatttcgtattttcttttttttaatatattgcatcccacctgtaaaactggcaagatatattttcttttgcttcccctacagggcgtttgtattattttgagggccttttaacttggtgataaagagtgtctttgccctaagacctaatttgaatccagcgtggtggtcgtgtaactgcccacaagtcacgtcacttcttctctaagcatcaggtccctcatttgttaaatggcaatcataaaacctatgccaaaggttaaggtgggaattaaatgtaataatgtagtcagtgcactcagccctttgcctgacatataggacgtgctcaataaatggcagtgagggtgacattgaggcagagacctcttaggctacatgagtgcattgtaagtaatttggggtagaaccttttacttaatgtattttaagacatcatttatagtgtttcacaggtagatcctgcttttctgtggtttctgttgagtgatttaaggtggcatttgtcctgggactcacttgatttatttattagactgaaaattatatagcatttgaagcatctctggaacatatgcactcagatccgtgggttcatatcttaatgattatgggcattttactaatgaggaagagctatcttcccctatttgtggtattatttgtgatttagacattcttcctggacaacaaagtatctttgtactttgtacaaaataaaactcttcacgtattacttgtttcccacacagtcatctgaaaatgtgggcacccgacagggctcaacaaatatttatttaaataaaacgtggatgagttttaccctaaagaaaagttgcatgtatgttatttacagttttctgcagtgtagtagctatttttaatcttttggtttctccctgcaccctaataggttatcctataattgggttccgttcatgtgtattagtgtcccaggctgatcttagctccagtaaatacctagtgtgccttctagaatgttatatcatgaagttcgttactcacccccctcagttagcctacgacttgacctttttttaataccagttttggaagacaggcctaacacttgtgtattccatcacatcttgatttcatagagttacgttgtggaggatatggttcaactcacattttatctgaaatattaaacagcagaccctttacgataggaccccgcagtactgctttcattcacttgtcctcagctccgcgctgatttgttcttcaggattactatctgttttgggttaactgttttgcagttcttagacacagaactgcattatcaaccaaaataaaagagctattctccctgatgtgccttccttcttcttcctgatcctaggatgatgaggctaaagtttccagctggatctggctcggcatttctgggataaattaaatgagcacacttgattgaggggtagctgcactgtatccctggcttcctattatgctaggagatcaaagcagagcacaaatagaggcttgctctatacaatattcaaaacagatggcttttttttggtgaaaattcaggttttaaggcaaaacacttgttagcaaaacttcatttcttttcattgatagatagtcactactgaacacatagcactgtttcttcctgtatttcaagactaggatcacaaactttttgcaggaggagggatttggcaagcctagaaaggtattagattgtctgtgtcttcatgtgaatatgaaataagttattaagattttgctgttggtattctagaatcaaatgaaaacatcttacatttggtcacataatcattttgttgttgggtcactatttaaaaatctagtactcatattgttttgtcttctaagaattgaaccaggatgtttatctctgatttcatgttttaactgaaaagtacattctccacactcctttatcatttacatctgaatcctcaagttcatgtagaataattctatgtgatgtgaaacttttattattttggtttaaaactgaaatgagaaataagattaattcaaaaatatttttgggacgtctgccatgtgcctaacactgcattaggtacgtggtaaaaaatacatgtttcaagacattgaaacaactgctaaatgatggattttctccaacagagaaaaattatacaagatgcaatagaaaaacccaggtctccagagagatttaggggttcacaaagaaggtgacacttgagctaactcttgaaggagcagtaggcatttgccaggcagatacaattttagataaggacatttgcaaagatatagaagcataagcagcataacaaatttagtatattcttggcagctcattatacatagtagttcgggtgtatgtcaattatctgttgcagcattacacattaccccaaagtgtggcagcataaaacaacaataaatgattttcatctcagtggtttctatgtgccaggaattcagcagcgtcttagctgggcagttcttacttggggtctctcatgggaccgcaattatctaaaaccttccctggggatagaacagccaattccaggattgctcacccacagtttgtgccacctattggaaggaaccttccgttccttgccatatggaacctctccattgggctcctggatgtggtgacatggagtccagcttcacccaaaatgagtgatccaagagatgagagccagaaggaagccacaatgccttttatgacctagaatcataagttacacaacatcccttcggccacattctgttccttagaagtgagtcactaagaccatcccacactgagtggggtattagggcttaggcaccactttttgaaaggaggaatgctaaataattttcaggctttttttttttttggcagcagagtctcgctctgttgcccaggctggagtgcagtggcttgatctcggctctctgcaacctctgcctcccgggttcaagcgattctcctgcctcagcctcccgagtatctgggattacaggcatgcaccaccacacttggctaatttttttgtatttttagtagagacagggtttcaccatgttggccaggctagtctcaaactcctgacctcaagagattcacctgccttggcctcccaaagtgctggaattacaggcatgagccactgcacccagcctcaggtttattttttcaattactatgggatgtcagagagggaaaaacaagccattaggtggttgcagtcagcagcaggtggatcgtgaagacctcagcatgccattgcaatctgtagaggttggacaggtggagagggaggtatacggggcagagtactggaaacaggacagccagttcagagcttgctactttgtcctggagagtgatgctgaggggctgaaggggtgcagtgatagaagagtttataagtgagaatatgtttattatcaagaagctctggttcttataggaaatgtcccaaatggtttctagtctctcttggttgagaaaatagagaacaccgtctgaatgcccagttataattcagaaagttaacttgcccgtaggaactactcagggaaaagcaatgaaataaagcctgaaagttctataaccgctccggggagaaccacgagctgtgatgcgctgatgccgactgagaacttagctgctggtcatctttacagatcaagtcacccctcaggattttgaatttttcattcagaaagttaggcaggggacaggggcagatatctctaaaattccttccatcttttgtattctgtactcaaaatgagtacaggatgctgttttgaaccaattagtgttttagacttgtctaaccttgaaaacattggacccaatagaaacatttaacctattcacagatatttaattcaggttgtatcagtatcaaggaatttttaactgagcgttttctggagctgaaactaagttaacttagtatcttgatcaatttatacatgtagttgaaaatgttcagatttttaaattatcttatggaatcattttaattagtatcactttttcatatttaaattgcataacgattttatttatcagtttttacatagattttactaattatcacttcctgtaactgtcagttttcattttatgcctattgccaaatccaattttccatttagccaatgttttattttgtgttaatattattcttgatacaagtacttttcattgtgaatggattttttaagatagtaattattattcctttttacaataatctgttggaaaattataagaatttcctctttaatattatatttaccctgttatctgagattggtctgttatggaaattggcaaacattttttaatggtccagatagtaaatagtgtatagttacacttttggtttttgtttgtttttgagacagggagtgcagtggtgcaatcgcagttccctgcagcctcaacctccttcccaggctcaagcagtcctcttacctcagcctcctgagtaactgggactattggcatgcaccaccttaccctgctgactttttaaactttttgtagagttgagtctctgtgttttgcccaggttggtctcgaactcctgagctcaagcagtcctcccacctcgacctcccaaagtgctgggatagcatatacttaggctttgcaaactgtgtacttcctgccaaaacaatccacctctgctgttgtagtgtgaaagcagccataggcaatatgtgaatgaatgactgtggctatgaactaacaaactttagacactgaaatctcatgttcatataaaaccatttttagctgatgggctgtacgaagaaggcggagctgaatttggttcatggactgtagtgctgtgttgcttatctggttcttgttgtgcttcttgtcattttacatgccttcactagccatccacaggccttggtgaggccaagcatgtggtggcattaaaatgtcctcagggtgaggatgtcaggtagttaccaaggataacttgtctttacatgtaccgtgatcttcacaaggatgggcataattattcccagtttacagatgacaaaacaggttattggaaataatagtagttaataattattgaagaacttaactatgtggcaggcacatagattatcacaaacccattaatacactgttaccaaagcaacttgttccaggtctcctacctagaatgtaacagaccctggaatcaagccgtacagtgtgtctccagagcccatgctcttcaccactgtatcactctgtgtgtaattctgctctgtggcacagaactatcaatacagtgcaaagatgtcatagcacataagtgatacacatctgtctctagtgagcgtagcctctgggttaaaaaacaaaaaccaaaaaaaacttttttcaccacagtctctgaaactgaatacccagtcattaacgtgatgtcaccagccaaccgcctgcatcctcctggctgtgcggtgtttgaatggccatagccacgggagctacattgcctgccctggtactaaaggatggactactgtgtctgcatccagtgtagtactgtaaggtgctgtgatgccacagcagccgttgccaaagaaatgtttaggtagatgcaattcttagttaagattataagatgcagaggatcgcctaaattaatttaattccaggctaattaaaaaatttcctgagggaagtaactgacgtgagagcagataagggcaagcatgcaggcacacagcatgctttcctggaaggtataagttgtaattgctccaagagatggcagaggtaggagtcctagttcagaggagcctggctccagccaatcagacatttcatagctctatgcacgtgtatgttttaagtagcgtgttaacctgatgctttcttctggtgtacagaaatatatgatcattgagacagaatgcgctaatgaagtcggggagctgaaaaccttcacatacatagaatgtagagcactgaactcacaggttgtcggaggcacacacacctgccttagaatggctttgcagtattccttgaaatgctgcatctgggaaatgatgtgtggatggtttgctagctggaggctggtttgttaattagaagtgtatctgaccaatggcatgagatcttattgcttaaacgaacaagatggcggagactttactccctttgaatggtccagcaaaggctatttcctgtcagcagtagcatctcatgcaagaagattacagttgctgaagcccacaaggcaactgagtatggagaattcctcaaaattgtatgttgtgtatatttgggcagactggttaaagcatgaagagagctattgctactgttaaagtatgtgtctgtgctatcaaaagtatactccctgaggctgaggctgcaatgcagtgagctgtgatcacaccactgcactccagcctaggcgacagagtgagaccctgtctcaaaaaaaaaaaaaaaaaaaaaaggtgtactccctggtaggagaaccagggaaaagcagctacaaacaagagcagattaacatggtgcagaaaaggcatgttctgcttcctcttgtcccttttctttgcttgatttctagagttagattttatcatttcactctttaatctgtttcttattttctaaacacccgtaatatattagattctctgattatatcaaaaacgtggtctccatcctctggatttcctcactaaaactggacgtggcttcctttgtgcagtagcttttttgtgagtactaaaaggtggcactggtatgagagcctgggagattaaaaaatagatatatgaagattctatataagcttaactttttcctttctcttttttactatcagtcactttacagctaaactaggagcctacttactctttattgactcgtgtagttacctgtgcttcagtctagatgtgtacaccatgtaccccttggaacttccttctgtggccgcttgctggcgctctgctgttcccccatgagtatcagtccgttctgtcaaatgctagggtttgttctttgcgctcattccatttcccacttcccagtggggctgcccccctttgccactacccttcagaattgatctccagtccctgcttaatgatcctgtgttcggagcagagggaaacagagcacgtgggtccttcttccagagatgggtgttacatacacccaaagggtcgtctgactggagatccttaggctagtcatggtccaggttgtgtaatcttgaaacatcagccaccatttgtagtatctctggtgtttaccatgctgagcctctttcgtcatagtcaattgtatattttcaaataataaagctttgcttaagcgtccacaactatgaatattgaagtggtgatgaccgtcagagtttgtgttgtgctacacggcttaacgtttcgagagagagagaataattcaatcactgcatgggaggttttattctcaaataaaggaagttggtagagaaagccgtcttcctcatgtttgtttttcccaaatctttttttccacccaaagtctggattactcccaaggtgagagggttgatgtctggaaattgttaatccatgggatctattcatggtatataaaattttcagaaagaatttgccttttaaatatgatttcctgattgactatagcaaacataaatccaggaagtacaactctgtcagagcagccaggatccttcttagcttctcagatgtatgagattttttagtgcgtgtgtggagtggaagtaaagattcttcccgtgggcaggtcagaaggagagaggggagttaggagaagaaaggaagagaataataggacatagaaacaaaccaaagctgctagggtcggggaggcaggtatatacccctggctttcctggaattagctgctgtccccctgaaaaaccagctttattttagtttatagtactgagaggaagaagctagggaggcacccttttagtgccttctgtcctggtactgttttcattcttgaagtgctcttttatgatatacagaaacatttcctcatcctcttggtgatacaaagttcttgggccactattttcagagaaaactaagctgtactaagctggaaatattggctgagggccattttgctcagatctctcctcccatctggacttcgtgcccccgtgcattcttaaacaccaaatcacaaccatttctcacctgctgaagtgagaaacagttttctggctgtttccgatgttagcattaaagatcagatttctgtatgtgacttgcctttctccaatggaaaggtgcccatttctgatatttacacacagctacagatatatttatagtttctcttggatttcgggtaatagctaactcttcttccctgccacctgtaccctctcaggccatgttcttattaagcactctaatgagaagctacgtctaccacaggctctagacacatgatgagaccctcagtggctatagcctagctgtgagcactcagcagtagacttatatctgcatagtctgttgtgtttggtttgacgctagagttcaaataataaggtgactaactgcaaactgcctctgcctgctcccccagcccttccatgtacagacagacggacacacacacacacacacacacacacgtgcacgcacgccctcttatcctgaccttgaaatagctaccactcacagaagagtctcctccagagactggcctgtctttgggagcctttgtacagataaactatcaaatctcatagtgactagacagtcatacttggctcttttttgtagtcctatggactgagaaggagccggtaaatgtgttcctcttcagttcaggtcacatctttgacatgttcacatctttattatgttgttccttgtttgttgagatgctatcaaggtcaggaggtcccttttgttgaccctgggtaactccgcttgcctttcccctccactcccaatgccataggtgagaaaggagaagataaaatgtgattatgaggttattatactcttttgccccctaggcaacaagcgtattgttgtttttcagatccatccgtctagcagacatgtgataatgccaaaaggtggtgtcgtgcttgactgcagcagttacagcacgtgaggcaccaggcctcagagggtcagaagagagtgtgagttatcaatttcaatgtttatgtgttcacacgggcatgcagggagttaaaagccaccatttttccctgtgaccaactgcccgcctagcttttcctttgaaatccagcgtcagtccttgtagggctggcctgctcaaaaagtatgactgtctcttctccctcttttgcctcatgtttcttccacatgcctagatttttgcccctaatgtctcattcataaatctgtagccctggaactgtactgtacagtagggaagccattcagatatatatatatatatgtacttatacttaactcttccatttttcactaaaacacaatgagtgatttgtgtggggagccaagcctcaagccaagaactgaattcaaagtgttttctcgtctttgttaactcttaacagcaagaaagaattttggaacacatttctgctcctggaatttctgagtgcagcagtaagtggctttctgagtggctttcttgacttcttgattctggttatctcatcgactttcagcagccatcctttcagggcgcatactgtatgtacccttgattggctggcctgtaataatagcttctgtgcctcctagtagcattctcttcacttttcaccccatttctatgtgctgtcctcatctgtatatacatgttcacccacctggtggtgaatgacctggttttaatgtatcttacaaatttccgagtactaaagcaagtatagagatgcctacagtcttgacatccttttgtagcacatggagagacacatagatatgctcagccagagatgtccttcccttactagtaggcaagcccctaacagtctgttccctatgcactcccttagatttcgtttgagtagcattttttataatgcataaggtaaaagagatgttaactgaatgaagattgaataggcagaatgcagttagcagctctgtagttgagatttcaagatttattttattctgaacgctgttccatatctccttacagctttgaggacataatgttttctcttcatacctgaatccagaaataaaggatgttttgttttgttttgtttgctagagtggtaatgcatccttaaagaaaaattggcaacagatttgtgagctgtaaaactaagaagaaatgatcatttgttattttcaaaaatgattctcatgtttctttgcatttcaaaacctatagtcttttgtggttttcataggcacatttacactttgacagaccataaaaccctttcaatctgaaacctttggagagagtttctacttttagaaccagatatttctattagtagtgagatttctgattaacgtttattcatctcagtgactagtggtccctggacctgaactcctagtggtaactgaattatatgattttgtgaactccattctttcacaaaatagctgtgtttaaataagaacataacacattgctccaaacctttgtgacaaggcttgacacactatccttcattttcctgaccctgaagtacattattgactaagaagatatcttagttattgagggtaaagactttgaggcagaattaatgaattttattttctcgcatcttttacttttcagagtttagctctccgctggggcctctggataagaatgccattctaagatgataatatttatggaaagttaatctgttattctgggattttcttaatgtagtctatgttgagagacagcagtacaatgacagtccaataagaaatcaaaactaccactaacatttatgcagttaatatatggacagttgaacctgcctctgaagacttcagcaggtaaaaagaacaaaaagattttgtagccacttcagggctctgagctagccacagaagaatcgtagtagatataaaaataatttgccaggaagacaataagtcatcaataaatgttagctttaaaaaaatggcatctttcgggctgggtgcagtggctcaggcctgttatcctagcactttgggaagctgagacaggaggatcacatgagcccaggagttaaagaccagcctaggcaatattgtgagaccctttctctacaataaatttaaaaaattagccgggtatggtggtgcatgcctatagtcccagctactttgggggctaaggtaggagaatcgctgagcccaggtggctgaggcttcagtgagctgtgattgcatcactgcactccagtctgggtgacaaagcgagaccttgtctcaatttaaaaaaaaatatatatatatatataaaaaatgacatctttcaacggacaaaagattagtaccccatgagaaaataccttaagccccaaataatattcagtacctgttcatctaggctttatgaggaggctgtgttatgcctctcggaatggttcttagagtaactatctggcacagaggcagtagagtgggaagagaagagcctactggacagacgcttcactctgcacatttcttccaggtattgaagtcacatggcccaagaaagtgtgtttggatctcatagatgagtgagttgcagaagtggaatgctgtagaatcttctgttactatttgtattgaatgatacaggaacaacttacctgtcttcctaaagaccatcagttatccaacctcactgaagtggaaactaggttaaaacaaacacctttggaagattactggtcttgtcactatgccatgaaatgctggcctctgaagcctgtttgagaatctaatacataaacaaataaattcttacaagaagaaacaaagctcttagtacttaaccaaaaatgtctcatccctttttataatttaaatttcctcaacaattttgtaaatgtagcattggggccataatgacgttttggcatcatatttggtacaagcaaatatcatgacgagttcattttttaacttcttttttcctagtgcagaaaagtatatttaagtacagttcattatagctgtacaaccaatttggcctgaccacatatctgatgatttttagtaggaccccttgccaatgtattgaggtcgcatgtggaaaaaagttataacttacgggtcctgtaaggcattctctttctacttggcaaatgtccctcttccctcttgagattaggcagtggcagttctaccttgtgggaaacacagtttcttttctaagtggactgctcaaattagatagggagaaaagggaagagataagggcatttcccacatgattgacatggttcatgtgttccgagaggcttaagtagtttttttacagatagatttggggactatactagttgggcagtttcatatgctttcacaatgatacatattttgggagtatttgtggtattttgatacctctatacaatgtaaatgatcaaatcagagtaatccatcacttcaaacatttatcttttctttgtaaaatgagtttttatcccggataaacaatttagaatttcattcttttttaagttttctttctttctctttttttttttttttttttccttgagacagagtcttgctctgtcgcccaggctggagtgcagtggtgccatctcggctcactgcaagctccgcctcctgggttcacgccattctcctgcctcagcctcccgagtagctgggactacagacgcccgccaccacgcccggctaattttttttgtatttttagtagagacggggtttcaccgtgttagccaggatggtctcgatctcctgacctcgtgatctgccctccttggcctcccaaagtgctgcgattacaggtgtgagccaccgcgcccggccttttttttttttttttaatagagacagagtcttgctatgttgctcaggctggtctcaaactcctggccttaagcaatccccctgcctcagccttttgtgtgtgtgtgtgtgtgtgtgtgtgtgtgtgtgtgtgtgtgtgtgtgtgtgtgtgtgtgtgtgtgtgatggagtctcactctgtcgcccaggctggagtgcagtggtgtgatctcagctcactgcaacctccacctcccaggttcaagcaattcttaatgcctcagcctactgagtagctgagactacaggtgcgcaccacacccagctacttttcatatttttagtagagacaaggtttcactgtgttggccagactgctctcgaactcctgtccccaagtgatccacccaccttgccctcccaaagtgctggaattacaggcatgagccaccacacctgacctcagccttattttttaagttttcgattggactctgaaatttttcagaataccagatgccatcatgtttatttaatcaattagccatcagcataaaatgcatttaaatctgtttgaaaattttttttttttttgagacagatcttgctgcaatgcccagcctggagtgcaatggtgcgatctcggctcactgcaacctccccttttcaggttcaagcaattctcctgccccagcctcccaagtagctgggattacaggcatgcgccaccatgcctggctgatttttgtatttttttagtagagatggggtttcaccgtattggccaggctggtctcgaactcctgaccttaagtgatctacccgcctcagcctcccaaagtgctgggattacaggcatgagccaccgtgcccggctgaaattgattgtttattaagaataaggatctaaaaagtcagcatccgcagtcatagtggttgtaggagtgagctaataatatctttttaaattctgttttactataaggaatttgaccttctcaatatgaccatttatcacattgccccctttcttcgtggtcatacttttttctgccagttttgtcagtcaaaagtaattacctaagataagcagctctttcagcctttgcagcccagatgtggcatttgtgatggcagctctatacccacaaacatgcgcgtgtgcaccaaaagaatgggaataaattgcacaaatccagtgaaaatcccaaaggtgatttttttaaatcaatgtattcatgaaagaagatagagaaaaccaagcttttaaaaaatgaggaatgaaatagggatatgttacttggcatcatgggggtgtagtaacagaaccgtgatgagacggtttcgtcattggcgcacagagtgtgcttgcatttaaagtaattttacctttgaagactgcacctggaatcctttgtaaattttccacaatgagtatactttttgttgttgttgttgttttgagacagagtctcactctgtcgccctggctggagtgcagtggtgtgatctctgctcactgcagcctccgcttcccgggttcaagcgattctccggcctcagcctcccacatagctgggattacaggcgcacgccaccatgcccgactaatttttgtatttttagtagagacagggtttcaccatgttggccaggctgctctcaaaatcctgacctcacgtcatctgcccaccttggcctcccaaagtgctgagtttacaggcatgatccaccatgcccgaccacaagtatacatgtatgcccagaaataaaatacaatatttttgaaaagttggtattgtttgcaaaaaactatccagctcccccactctaaattctctacttgattgaaacactgtcttccttctgtgactggctgtgttgacatgcctgtcataggtaggaaattccagcccagaactggtaccgtaaacctgctgattaggagtctcttacagagcccagcagccttccacagcagaactttggtgtttatcgtttatccttagagagagagagagaattttaaaaacaaaagtaatgctaaattgattaattttctctggtttgtctagccaggctccagcttctgtgtaatatactgtataggcctaaactgaactctgatctttttagcaagctgaagattgttttagccactaagcccttgctctttattctcttttaattatttcctggaaatagtattagaaacaaaggaaatgtgctatatgtattatgcagccatgaaaaacatagtttcggtcatatataatgtagtgaacagtactgacaatataatgttaaatagataatgtatcaagcaaaatgtgaggtgtgatactgttagaagctgatttatataaatttattaaaagacttggcaggaaaatttccaaaatgttacaaatgattacttcttttttatttttttttatttttttgagacagtctcgctctatcgctcaggctggagtgcagtggtgtgatctcggctcactgcaagctccacctcccgggttcacaccattctcctgcctctgcctcccgagtagctgggactacaggcacccgcccagttaattttttgtatttttagtggaaacggggtttcaccatgttagccaggatggtctcgatctcctgatctcatgatctgccctcctcagcctcccaaagtgctggtattacaggcgtgagccaccacacccggccaaataattacttcttgatggaagtgtatgcaaaagtcttatttcctttatatttttcttttttcccccaattttttggagtaaaatatatattgttttcataataaaaacataaaactttatttcttaaaaaaactcttgttgaaaaagaaataaaggaacgtggcaggagcagtcctctgagggggtccaaggaggaatcagtgttactgtggaaagtaataccaggccttgcttctgttgacttgaagattattgagctcccaattcattagttaggccagaggtgtcctgttcatgaaaattgccaggccggtgacatgcaacaggtgcagacctgctgtgtgagccctgggaacacactgagatctgccagcgttttggcggtgcttcgcagtgctcacagctgctgtgtgtcaagcaggggctgctctaatgcttcagtgttctgtgatggtgaggtctggccccactctcttcctcagcactccaggctttgaccagctaccaaatacctggccagactattgtcacgagagctgccaaatgaaatcctggggcaggagtcatcagtcatttagtgtgcttccagaaggaatcaaaggagtagctgttcaagcaggggaaaggaatgagaaaagaaaaaacgtagagcaagtctgttacttaagaaaaacacagaaccaatgttacaactaagaatttcagagtccttggctgtgagtcaggtgtttggtgttatatagggatttatcagtcactggttcagaagaatatcggataacctctgtgaaataaatgagaagagcataagccaggatgagacagaattcgtaatgagttccctcatcacatctcttggccaagaaaaacatgcactttctccagaggcagaatttttcttccattctaggaggtggaggaacacttggagtatatgtagtccaggctttcagatgagcagtttcactagcagttttttgtaatctactcataaataagtgaaaagagaaactgtgaggtaactggagtctttctgtatcaggaatagcatctctgtaaaaacaagttagtcctgtgcttaattcctgcctcgatacagagctgtccgtctggtgtgaatatatgaagccagcgttctcttcctgtctcccagaagggcggctgcgtgtgacagcgtaaatgtgtgacagtatgtgaaaatgtttctgtaatcctgaagatttcagtagtgattagaagagctttagtctttggtcaattttctttgacttggaaagcataaagaatatttgaacctctcatttcagactgaccttgactttcctcattttattttattttattttatttttttgccttagatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcaggtgagcctctcactcaaactttgaaaagagcctgtgaaaatccagttgctgtgtaggttgatgcagtgggggctaccttggggaatccagttgccgtgtagttgatgcagtgggggctaccttggggaatcccgttgctgtgtaggttcatgcagtgggagctaccttggggaattccatgtttagattcaagatttggggggtggggaggggtttccagatataatttttaaactgatttttaattgattttttactgttttatttttttaattcaccaattaaaaatgtatgtttctcatgtacaacatgtaattttgaaatatgtatacattgtggaatggctaaatagagctaacatatacattccctcacatactttccatttttgtgtgtgtgtggtgaaaacactttaaaatctactctcagcaatacattattattaagtatagtcagcatgttgtacagtagatttttttttttttttttttttttttgagatgaagtcttgctctgttgcccaggctggagtgcaatggtatgatctcagctcactgcaacttccacctcccaggttcaagccattctcctgcctcagccttccgggtagctgggactacaggcgcgtgccaacatgcccggctagttttttgtgttttcagtagagatggggtttcaccaagctggcgaggctggtctcgaactcctgacctcaagtgatcctcccaccttggcctcccaaggtgctgggattacaggcgtgattcaccgcgcccggccagttgtacgctagatctcctgaaggtaatcctcctgtctagttgatattttgtaactttcagcaacatctttccagcccctggtaaccaccattttcctcttcgattcaagtttcttggcaatgaatagtcttgaacagatatttggaattaccttttgaaggaagtacgattcttggctcagtgtaacttactcaagtatccgaaagggctgatttataagggagaaggctaaggacgatctgttaacattgccatcggttattccatgaagcggtagccactgaaggaaagtctgagtagtttaggttaatcccatgtcttagaccattcaggtagctaaaacaaagtaacacagacagggtggcttataagcagcagacatttattgctttctgttctggaggctggaagtcccagatcagggccccagcatggttggtttctggttccttgtgtcctgtcgcatgctgctgacctcatgacctaatcacctcccaaaggcccacctcctaataccatcacgttgggggttgggatttcaccatatgaattgaggggaggagggtaaacattccatctatagtactccctagacgacattttctgtttactgtcacttgtaaaaatccagtgattctcttttttacatgttgtgatttttaatgcagtaaaagacagggtaaggctagcctggagacaaaaaatcaggaataaaagaaacagaagacaggatgagaacaggcatacagtacagacatggaaagtgaaggaaagaaaaagtgaataaacattgagacatagaaacagaaaaagagaaaaataggtcagtttttgaaatattaacttaaagctccttttgctcctagtttactgatagaagtcagtgatattccttaccccctatagattcaatcataccaacagaaggctaaagaaaggcacaggtggtgtaaacttactaaaactcttcatcagaactttgaagctacttactatttctagctaaatactttctatttcttaaatattgtttgtttactcgtgtgtgaaggtaaattgtatttaatacagaacttcctgtggtgtgatattaaagatgacagtgaaaacccgcaagtcaagaaatgcaaactggtgagccttagagctgtacttactttcccgtgatgtggatgttgcctaataatacacggacatatttcacagcctaactagttacccatcatttatttgatgtgtgaagacaaggccaacttctcaaatttagcgtgttgacataggaattttaatctctttctttcttgaaagaggaaaaaaatgtaacgaacagtattaaattcagcgaggtgctgtggctcacacctgtagtcccagctactcaggaggctgaggcaggaggattgcttgagcccaggagttcaaggttacagtaagctatgattgtgccactgtgctccagcctgggtggtgacaaagtgagaccctgtctctaaaacgaaaaaaaaaaaaaggacagtattaaattcaattcctaatagctctttttgatattgataaccatatactaaaaatgtaatggaaataaatacatacacaactacagtgcaaccaaaagcccattggaaacaaggcacatggctattcattttagagacttttgcttcagaattttgcagaaaaacgatgcttcttaaaagcagtgctactgggcacagtggctcccacctgtaatcccggcattttgggaggctgaggtgggagaatcccttgagcccaggagttcaaaaccagcctgggcaacatagagagacctcgtctttaaaaataattaaaattatccagacatggtgtcacacgcctgtagtcccagctgctcaggtagttaaggtgggaggatggcttgatcccgggcagtcgtggctacaatgagctgagatcgtgccactgtactccagcctgggtggcagagtgagaccccgtctcaaaaacaaacaaacagcaacaacaacaacaaaaaaaaaaaaacccagtgcttattaatgtattaaagtttaactggcattaaattattcctttgtaaaacagtttgtctttgttttgtttttgtttttgtttttgtttttgtttttgttttggagacagagtctcgctctgtcacccaggctggagtgcagtggcacgatctcagctcactgcaagctccacctctcaggttcaagcaattctcgtgcctcagcctcccgaacagttggaactacaggcgcgcgccaccgtgcccagctgattttttgtattttagtagagatggggtttcaccatgttgcccagtctggtctcgaactcctgagctcaggcagacggcctgccttggcctcccaaagtgctaggattacaggaatgagtgaccatgcctgcccagcttgtctttgaaatggaaaagatatttttgctcagtcctgtattttcaatatgcctagatggacttaactcagtcttaccaaggggaaaaaaaaatcttcagagtgataccaagatagaaaatttcaaactgatttttcagcaagttttgagtgaatgaaacctgattaatagacttcccattgcagattgtgttacagtcaagctactgcactcatccaaacaattgtgctcacacacatgacttccgttaatattgtcatgtttccctttaattgagaatgtacttcagttactgaagttactgtttgaggtgtgtgaaattgtattctccccaacagtccctgcgaaacgagagacctgggtcatctacagaggaatacagtaactaacaacccctactataagcttcttcatagcttctaaaggttggtggagaaaccaacccatttcgtgcttccttaccccaagtaagaatttaaggaagtaatgtaggctgtctaacaatacaaaatgacttgcctatgaaagtattgtgatcagagtttgacttcagctttaacggccaagaaacagaagatgtgagtcactgccaaatatgcatattggtttattttgtgtgcgtgttttgtttatagttttgtagttttgtttttgtgatgcagagccttctgctcctgacatttgcatttttcacctcatatctccaatgcatttcactgccaccatgctgccaccaacaccaccgccatgaggacaggacaagaactttgtctttttcaatgctagggcagtgcagaagggaaatgcagggtcagagcccctacacagtccccactggggcactgcctagtggagctctgagaagaaggccaccatcctccagaccccagaacagtagatccaccgctggtttgcaccttgcgccgggaaaagctgtaggcactcagttgtcagcccatgaaagcagctggaaggggcctgtgccctgcagagccacaggggcagagctgcccacggccctgagagcccacctcttgcatcagcgtgacctggatgtgagacgtggagttaaaggagatcattctggaactttaaggtttaatgactgccctattggatttcagacttgcctggggcctgtagtctcttcgttttggccaatttctcccatttggagtaggtgtatttacccaatgcctgtaccctcattgtatctaggaagtaactaacttgcttttgattttacaggcttataggcagaagggacttgcctcgccttatatgagactttggacttggacttttgggttaatgctgggggcctgttgggaaggcatgattgtgttttgaaatgtgaggacatgagatttgggaggggccggggcagaatggtatggtttggctgtgtccccacccaaatctcatcttaaattgtagttcccatcatccccacgtgtcatgggaggcacccagtgggaggtaatagaatcatggaggttgttacccaccatgctgttctcatgatagtgggtggcttctcatgagatttgatggctttataagggtcctttccgcctttgcctggcacttctgtctcctgccaccatgattgtaagtttcctgaggcctccccagccatgcagaagtgtgagtcaattaaacctctttaataattacccagtctcgggtatttcttcatagcagcgtgagaatgggctgacacactatgtctttctatttaaggtgggtttcttgtagagaacatatatcaaatcagtaattgtcttctgattgaagtgtttagaatatttgcacctgatataattattgacacagtaaagttaaacctatcatctttatatttatttgtttcatctatttttttcctctgtttttgttttcttttaaagtaatttttttttgttattttattttatttccactagtggcttaaagctcaactccccaccccttttaagtgattactctgtggtttacagtgtacagttttaccttatcatagtcaaattttgaaaatatagtataccacttcaggtatagtattggaatctgccaatagtatacttctatttcctttgtctcaaactttatgctatcattggcatacattttattcctccatatattataaaagccatagtacattgttactgtttttgctttaaatcagttatctttttttattgtttattgtgctaaaacatacacaacataaattttaccatcttaaaaatttttacgtgcacagttcagtgttatattcataacgtaaactatcaccaccatctatctctgtagctcttttcatcttgcagaactgaaacgccatacctgttaaacagtaactccccattctcccttgccccatattccatctgccttctgattttactcctgtaagggtttcgtataaatggaatcaggcagtatttgtcgttttgtgactgacgtatttcatgtagcaaggttcgtctgtgttgcaccttgtttaaggaaatgctgtgtcagaatttcgttcctttttaaggctactgttttatataccacattttccttattcattcctccattgatgaacactcgggttgcttccacattttagctctcatgaatagtgctaccgtgaacacgggtgtataaataccttttcgagactgtgctttccgttcttttggtataaaatcaaaagaagagaaattgctggactatgagttaaccctattttcaattttttgaggaaccaccgtactgttttccacagcggctgtaccaactgacattcccaccagcggtacacaagcgttccagtttctccatatcccggccaacacttgttattttgtagtctttcgtgtgttttttaaatagtagccaccctaatgggtgtaaggtggcatcacatagttttgatttgcatttccctaatgattcatgatgttgagcatctcttcatgtgcttattggccatttctgttttttctttggagaaatatctattcaagttctcagcctatttttaaatcaggttttctgttgttgttgttactgagttttagaagttctctacatagttagatagttatccctaatcagatatacgatttgcaaatattttctcccgttctgtggttatcttctcactgttactgtggtaatagtgtctttcgatgcacacatttttttattttcaggaagtcccatttgtctattttaatcatttatattttatagagattaagattataaaataatatttttctcatatgtttaccattttcaaaaatctttgttttttatctgtgtatgtctgaatttccatctgtcatcatattccttctctctaaagaacttactgaggctgagagcagtggctcatgcctgtaatcccagcacttttggaggccaaagcaggaggattgcttgaggccaggagttcaagactagcctggacaacggtgaagcccttatctctacaaaaatttaaatttaaatttaaaaaatttagctggatacagtggtgtgtgcctgcagtcccacctactcgggaggcccaggtgggaggatcactttagctcagcagttcaagattgcagtgagctatgatcacgccactgcactccaacctgggctgcagaatgagaccctgtctcagaaaattaaaaataaattaaaaataaattttaaaaaagaacttccttttaaatgtcttgtagtacacatctgctggtaattaattctatgttttatttgtatgagggagtgtatttttatcaacttccgttatggccagaattgtgtcccccctcccaaaattcctatgttgaagtcttaaccctcagtacctcaaagtgtgacgactatatttagagataagacctttaaagagataattaagttaaaatgaggccattagggtgaaccctaatccattgtaactgatatccttttaagagacacaccagggtacacacacacaggaaaataccacataagggcaaagcaagaaggtggccatctgtaagccaaggagagagaggcctcagaagaaatgaaacctgctaatactttgatgttggatttctggcttccagaactgtgagaaaattaacttctgttgtttaagccacccagactggtattttgttatggcagccctagaaaactgtacaccttgtttttgagatgttctctgggcacagatttcttggttgacagggattttttttttcctctttcttttaatacttttaagatgtggttccattttcttttggcttgtatagtttctgttgaggtctgctatattcatgtagctttgttttggggtgagtgggttggttggttggttgatataccatgttcttttttctcctgaggctttcaaaatattctctttatctttagttttcaaccatttgatgataatgtacctagttgtgtttttctgtatatctatcttgtttggaattctctgagcccctgctctggatctgtgttttgttgtctttcattaattttggaaaattcttggccattatctcttcagatatatcttctgcccacttctctcttctcctttgtaactaccattatgtatttgttagatcatttgatattgtcccatatctcttggatttctgttttgttttgttttctatattttcttattatacttgaagttttctgttattagtttggataatttatattgatctatacttaagttcactttctttttgtgtgtgtgtcataattttttattaaatgttaaatagtctaagtaaaaagaacagtggaaaccaaggtaaataaaacttatgtctggaaatatactttcctcttcttctgtcaggccattagcattggggactgaatcaaataactcactaattgagctgggtttgggcttctttccactctagttaccttcatggtgccacaggccttgagcttttcagtggtggattgccactttcatacgtttaatgtgagctctgtggtgccgatgtttctgtttcatgcttctctctcagctttcagcatgtccttcatgcctgcaccgcagagggcctctctccatgctcttgttcttctctaagcagtagactgttcttgttactcagtgaagactcagggtcgggcaggagtggcttcttcattttcctgctccagtcttggtcttggtacttctgtcccacccccagtgacagacaacatctcccccctactcagcacaggtctagactgtcggctgatttcctaccccttccccagtagcagcagacttctagtttgaatccattcataatttggggtcctactggactccctgtctccttcctggcaacagtttgcttttgcctaatgtcagcacaagaggtagggtagattttgtaccaattctctagcctaggaatagaggccatgaaggttgctgccctacccccagaagcacacagcttttcccttgttctaaaatgttgagcatggaaaatttggccttatgtcttctcacttccgggctttcttgatgtcaagctccctgtcattctgtgtccatgttgtgattgaagaaagcaatcttaaacatgcatattttaggagtcacaaaaaattatttgcagaggattccagaagaaagtttcctctgtgaaaaccttctcttaccattttttacattatatataatttctatttttgtccccaggcttttttctttattgtgtgtgattgtatcaaattaattttaatgaaatatttcaaacatttggaaaaatatggagattaatataacattacctttatacccagaattaacaaatattactttgtcttatcttcttcagatcctttttaatgctaaatatagtatgatattgtgatataataagaaatacacatttggtctcggtccctagttccttatacacagctcctgaaactcttggaatcccctgagtgatgcgtgtttgtttttttaatgctaatagatgactggtggctgggagctctggatggagactggttaccaagggaaccaaccctgtgatagatggttgggactctccagcccacaccccagcctctagagagaggaggggagctgcaggttgagttgattgcccgtggccaatgatgtaattaatcatgcctacttaatgaatcttccgtaacactctaaaggatagtgtccagatgggttccagatagccagccgaacacacggaggtgctggaggtgcccagagaggtcacggaagctccacacccctctccatgtgccttgccctgtgcatctcttcatctgccggttcatttgtgttatcctttgaaatatcctttgtaataaatgggtaaacatgagtaaagtgtttccccaagtcccataagccattctatcaaattaacctaatccgaggaagagatcctgagaactccggtttatagctggtcagtcagaagcacaggtcacaacctgtgattggcatctgaagctggagggtggatactgtgggactgagcccttaatctgtgaagtccgacactgtctccaggtaactagtgtcagaattaaattctaggacacccggttggcgtctgctggagaatctgggtcaggagagttgtgccgactctgtgagattaggaaaaacactttgttttttcctgcctctaataataattaaagtcttctttgtatctcttctcagctgtatttttcttttttcaactacagtggcacagccaccatcctaaattggtgtgcatttttacagtccatatttttagcgttttaatacatatatgtttccataaacaatgtacaatactgttgagtgtgatataaatttaaaatatatcgtctcatactacttaggctgtcagttcattattacttactgaactcaggccctctagtcatttgataatagaagaaaacatattcttgacatttttcagagagggtgattcttagaccatttttttaggggcctaagccctaaagaagccttctttaaaggaaatagattgaggtaatgtcaaggtggaacacaattatggtacgaagtgtcttgacccagcactaagaaaaaggttttattaaattcaggagttttttaaattgctgcgcaatagaaatacttatttttggagtgtggataatttgatacattcatatgctgtgtaaatataaataagaataattgggatatctgtcaccctaaatactttcctttcttaatgctaggaaccttgaaattctcttctaatcttcatacaatgtacaacagattaacattaactgtagtcaccctattgatctgtggaacactaggtcttacttctatctaactatattttaacccactaatcagcctctcttcagcacgccccaacccccttcctggcctctcaagttcagttttagatttcagcatcttctctgtttactttaggatgctcccgtatctgaccactgttacttagctttcagaatcgccgatcactgaaattccaggtccaggggttctgcactgcgcttagaatttctcctcatgtataagatgtgctggttgcaccgccaagccctgttgccgtctgtgggacaggaagccttgttagtgcctccatgaatccagcactgacattagctcacgtagaactaacatctactcagggagttgcgttagtggctcttaagaaactccatgaaaattgtgagaaaacttcaatgagaacgtttttgacaagtcgcctttcccttgtatataaatgcgaaccgtttttcattttcaaaatttcaaactttttcatagaactcaaggatttgagtcctgcttcctttgagaggggtaacagtgagttttacataaacactgtgtatgattttaaaaggcagtactgaacatgtgctacacattaattccttagtttcgaaagatgcgacggagtgggaaagttcgatatccacaggtgcagatattggaaagaccacactcaggtgtatgatctttctcatagctgcaagtgactgtgttcagctttccaatgaggtgaggaaacatttatgggcctcctatggctctcttattcattcaccactgtgctgtgtaacacaatttccctgcaacaataaacttcaactttgcaatttgtcaccagtgcaatggctcatgtagttataaagtgaacgtggtgaccaatttggggcgtaatattgttctgcagtcaaagtatcctaatttgaagaaattttatgtatcgtgattttacaccaactggccaaagtcagatagtctgattaaatagatttggttttggctaactatatgtagttaattctacacactttaaatattttggtttgcaggtattttttgaaggcttaagtatttggtttctgtttctttgggtttcctgtctgtagattctaccaagcgtatgttgttgaaataatgaattcagggccaccttacccctagctgcaatcttgtcaagttccagcagctgagtaaacttgggtcaggtcagatttgagacaccctatgaccaagaagatattatttctaaatatcttgtatacattgaagaacagccattattttatctcttcaaggtaattttcttatctagttcatgttatgttttttacttcttttgaattatataaaattggaagttatatttataatattgttgtaatgtgaggccaagggggagcacacatcagaagatggaataagcaagcagaagctcggatctgagtctcacagtactccagatgcagtgagtggttctggagctgtacttctcaaagagggtggcagctctcagagagggtggggccctcagaatcaccagaagaactgtgttctcttgcattcccatccccataattctaataatctagagaaaatgaagagagaaaaaataaggtgaagccaggagtgagctcgcaggcattgtcagagatttaattattgtcatgtgctacataacaatatttcagtcgatgacggaccccatgttccacagtgctcccgtaagatgataagaccatatttttactgtaccttgtctatgtttagatatgtttggatccagaaataccactgtgttccagttgcctacagtacgtagtacagtcacatgctgtacaggtttgtagcctaggagcaataggctgtaccagacaccctcggtgtgtagcagctataccacctaggtctgtgtaagtcagtctgtgatgttcccacaacaagacctcctgacgatgcatttctcagaatgtatccccaccattaagtgacatgtctgtagtatgcagtttatagtaccccacgatattaaaacagaaacagaaaaagaaattcctccctcatgggtcctcataaagaatctgatcgtaagcaacatcttcagcatccttccatatgtacagccgtgaggttcagaagacttctttttttaagaaacatctcagcaatataataaggccaaagttcatctcataaaaaccgttttctaggagaccgtaaatattgctactcaaatatctaatatattatttaatattgggaataaattttcaagtctttggaaagatttaggcagtactctctaaatattagttgtctcaaccatttttttatacattaagcagcaatatgtttaggatctagtctttgacagataccagaatgcagctattcagtgttcaagtatagagtcatacactttaaaagttaatcgaaaaaggaaaaaaaaaattagccaagtatggtggtgcatgcctgtggtcctagctacttgggtggctgaagtgggagggtcacttgagcccagcaggttgaggctgcagtgagccaagatagcaccactgccctccagcctgagccacagagcgagaccctgtctcaaaaaaagaaaaagaaaaagaaaaaaaagttagtcaatctgccccttccccttaatggtggctgaggaatcagctggcatggtcagtgaggctggtgccaagtgttcaactgatatagccaaaatgactggcaggacaaaggcactgggtttgaccagcatggttggcatatttggtagtggagctggtcctcaggatcatgccctgggcatttggcaggaccatggattctgctagcatagctggtgtgtttgtcatgctgagaccaagaagccagcccacatggccaacatttttgggaggcgagggctgaggattcagctagcatgagtggaaatagcaggccagggccaagaaagtggcccacatggttgagagactggttacataccaggagatcaagcaaatgagtaaatatattggagctaatatattgaggatagtgtgtttgttattataggagataagagtaccagatatagaaagagtaaagacaaatcctatcgtattggattgtttttagaggtattgatatgaattcatggtttttaacagataaatagatttagatttctctgtgtgtatgtgtgtttatatatgtgtatatgtgtatgtatacacatatacacatgtatgtattttcttttttttttttttttgagatggagtttcgctcttgttgcccaggctgaagtgcaatggcacgatcttggctcaccacaacctccacctcccaggttcaagtgattctcctgcctcagcctcccgagtaactgaatcggattacaggcatgcgccaccatgcccggctaattttgtatttttagtagagacagggttcctccatgttggtcaggctggtcttgagctcctgacctcaggtgacccacccaccttggcttcccaaagcatgtatgtattttctaaccttatctgctgaagggacctggaagcagtgacacccagtaacagagagctcacttactactcaaatgttggtctagatgccttttcccaccagaaggaaccagagctctttggggaaatgactgagtctagggctgtgtgtgggaaagcacgtgataatcccagaacagttttataccagaaagtaaggaagcattccaagagtggtggggatgtatcaaaacaacatggggaaaatcttgaggaattcgagcatcaaaataagtaaagatagtaacagattataacaactaatatagagagagtattgcctaaatctttccaaagacttgaaaatttatttcctatatcaaataatacattaggtttctgagtacttgggcagcaatatttaatttagggtctcctagaaaatggtttctatgaaatgaactttgacattatgatattgctgagattttttttaaaaaagaaatctctgaacctcatggctatatatatgaaaggatgctgaagatgttgcttacaattagactttttatgaggacccagggggagaaatttctttcagatctctggactagaaataatcaatattctattgaataaaatagaaatctttgagtctgtgatggtataaagaagtgaatgaatgaatgaatgaatgaatgaacaagtaaatgggggagaaaggaaaactccaccctgtggttgaatgccagcataatgtagacggaattatggaattagagaatctgcatttggcaccattatagtagtgactgatttaggcaggtatcatcaatgaatgtgaaaacaccaggtgaaggttgactaagaacagactatttgcatagactgaaagtatctcgtcaaacacacaaaaatgtatgtcagttaattagcacaaagtatttatagttaatttacattggaaaaatctgacacataccatctaaaccaagtgattaaggttagcatctccagtagtgggacacgtcaatgtgtgcctcttcatcataggcacagagaagaacacaggtggtactcttgccaaacaatcacctgaatttaacaccaggaaacatacatagagtgatatagatagagatacagataacgatacagatagagacagatgtgtatacacatgtatatttatcaagatagagaattaattaatgaatgatatgacaaatgtaaaatgttagcagttaaggaatccaggtgaaatttataccagaatagacttaaagatttctgttttattcagtgagttataatattttataatcatttatttcaatgctcaaattctccaagatgtttcccgcatccttctaatatatgcccactactcttggaaaacttccttactttctggtataagatgttcttttgaaattattttaaaataaaaagtttttaaaaacttaaatcagtaaactaggattaagattttaatcctcttgtgaaaattgagaggcacaggagtattgaaaatacaagtattagcctaaatagccaaccccaaggtaacacccacaggcagccgcaaaatggtgccgtggcaggtggagctttgtgtgggctgagtcggtgttaccccatgagcagtgctgccagttacaccaagctccacccatcgctgcaccattacaagaggtaaatacgtttgaatgcgacatccatttcattaccattacagtgtttaattgtaaacattacaagaaggcaggtttaagtttaacagaaagtgaaacttcctagatctctccacaaaaagaatgggcagccatatttgaaataagtccttttgactggagagaagctactcagttgggttataaaaaggattcaggattgcaagatgatttgagtcagcttgtttctaaggtggtggtggtggtgtttttctaaccctgattgtctattatctagtataacagggatgtataatagccccctcctcccagttttaggacagtatttgaatgtgacatcctaacttgaactccataaaaaataaattaggtaaaatagttgaaaaggggaagaaaggaggaatgaaaaatgaacaattgttttgaaaaggcagttttcataggataaagacttgcctaaacgatgaggaggccctttttttttttttttttttttttcatttttctagttccacttaggatagaccaagataatatattaaattacaaaagaaatattttagttaaacatagggaacagctgtctgactataaaactaagcaacatggaaaaaattcaaaagaatgttgtagaatttccttctggagagttttaaaaactaaggttgactccccatcacttagtgcccatcccaacctcaccatacttgtcaatattgtacccatttgatacagatcatctcatacaattagccatatggattatatatgaatatgagacatgtataacctgtatgttgaatgattgaatatttttgaaagtgcagctttcgtttttaaaacctttgtcgcccaggaattttagataaagccaacgtttttggctctaaaattgaactttgagccgggcacagtggctcacacttgtaatcccagcactttgggaggctgaggcaggcagatcacctgaggtcaggatttcgagaccagcctggccaatgtgggaaaatcctgtctctactaaaagtacaaaaattaacctggcgtggtggtgggcacctgtaatctcagctacttgggaggctgaggcaggagaatagcttgaacccaggaggcagaggttgcgtgagctgagattgcaccattgcactccagcctgggagacaagagcgaaactctgtctcaaaaaataataataataataaaataaaactgagcctttgtagcaatgggtggttgttttaagccttaataaagaaatgtgttttaattccagatattaaccaaaaggcacctaacatatattgctaaaactacccccaattcagcaggcatagagacataaaacactaaacttaagagaacaaaatggtaaataggactttatcaaactttaaacttctattcatcaacactgggaaaaaatattcactaaatacatacatacacacacaaaaacacatacacacatgacaaagtacttgtattgagaagatattttaaaagtcagtaacaaaagatatttaatagatatttagtatctattagatacttaaaacaacataagtttttaaatgggcagaagacttgaacagactctccaaatatacaaagtaagcacatgaataagtgtttatgcaaatgaaagccacaaagagatagtactacagtatcactaaaatagctaaaattaacaaaactgacagtaccaaatgctcgtgaagatatggagcaactggaactctgatacactgtgatgagagggtaaaatggcataatattttagaaaactgagaagcagtttcttatagatgtacatctatcctgtaacccagggatcctattcttactcaaaagaaatgaaagcatatgtccacaaaaagacttgtacaagagtgttcatagcagctttactggaaaaagtccaaaagtggaaacaacccaaatgtccattaacaggagaataggtatttttaaatgatcatatatcattaatggaatactactcagcaatagaaaagaatgaactactaatacaaacaactgaatcttcagaaacactgtgttaagcaaaagaagccagacacacacaaaaaattatgtactaaatgtattattccatttatatgacattcaggaacagaataaattatggtggtaaaaattagaacagtgattacttataggaattgactgaaagaggataaaacagaaccttctggggtaatgaaaatgtcctatattttgactggggagatggccatgtgggtagataaattcatcaaaattcattcagttgtacacctaaagatctgtacattttgttatatggcaacgtttaaaaaaaatactccgcctccagtctccttttgaactgtttgaagtagtacaactgataggcagattctgctaaaaagctaaaaatataatttttctctagagtacaaatttcttttttttttccaccgtaaatgccagcctcccatcagaggctgaaccacagtggaatcaactttcatcagccagcccctctgtggctcactgagctttggattccaggtccctttcccagcacttagtcccatttttaattttcaggaagtattgttccaaaacttggctcagacttatcctctccttggattcctttctccatttgttttctcggttttgctcacttactctttaacttgcacccctctttttccaaggtggtggattagggggtgttaatgctggggcagtgttaggcacagaacctaggagtcatctccctcactccgggaccgcatcaatcatcagtcacagacatgacagttcatttttccctcctgaacgcgcctgcacagatgggtgtatcgctcaagtagccaaatggatgtagctgttgggggacagggcctgaggggcagcagggagagaaaagaacaaagaaagaaagaagaatggttctttgtggggcagcaaactttcttctggttcccagcctgaatgtttctgatctggttttcttctttttgtgatgtttgaacttgtttcctcaactcagatgctgaactcttgtccaaaaaacctaagggcagcatagtgtgagagactgtgggaggcaagtccagcaatccagcaaaaagaattgcagaactgtgaagataaatgtgtgtccgtatcaggactgcgctggagaacgggaagagaggggttggggtgctaagactgtgtgtgtgtgtgtgtgtgtgtgtgtgtgtgtgtcttgacaaactgatgagaaacactattgagtagttttctcctctctgctctcacacacagtctggcactttcttcttctgtgacagctgccattaactttttaatgcgaagacaagggtatcttgccaattggatgttgaaatctctggcaaggaaaagcttgctttaaaaaaaaaagaggcagggaatatggggaaggttgggcagacataccaaaggtccgggggaagacagggtactaagttggaccttacaatgcagaatggctgccctgcttctgataaaatcccctcaaatgaagttgggaaaagaaagaggaaatgggagtgtgagtgtaagggagataaggaactcttttacgcagttgcaatgacacagatattaagtattatttgcaattcactcccgatggatgtgagaactcctcatggagttttggtgtatatgtgggaccttgtgctaaatgtagaataatcttgtttgtgcagaaagagaaggaaagagaaaatattaggagacctctgtagaccaaaacattatgatacaaaagattgttccagtcatttccttccatagcttatctcagagaaggggagttctggtgttcgtggctcgcctatcaggtcttcccctcacctctaaactacggcagctcttgatccttattactggtacctaccccaaactcaccaggtctaaataaaactgaacataaaaacatcctgttgtgaattcagttctcatgtaccttcagctttgcagcaaagaatgcaaaagccttttttttttttttttttttttttttgagacagagtttcgctccgttgcccaggctggagttcagtggagcgatctcagctcactgcaacctccccctcccgagttcaagcaattctcctgccctcaccctcccgagtagctgggactacaggtgtgcaccatgacgcccagctaatttttgtatttttagtaagagacagggtttcaccgtgttagccagggtggtctcgatctcttgacctcacgatctgcccacctcagcctcccaaagtgctgggattacaggcgtgagccacggtgcatggccacaaaagccttttttaatctagtttttattagcttggcctcacactggactctttaaaaaagagtcctaaaatatgaatatggaatattatatgaaatattttataaaaatattttataaaaagctcagcatttatggagatcttagtgtattttagctgccctaattgcttttttcctttgtgttgaacgtattcccatgggagaagaaagttcaccctcctgagtccctgagctcctgcaggaagaattatttaccatcctggaattttaatgagtcttgacaattactgtaatccaggtcattgaacgcgggtctgtcatcgccagtgtcatcttccagagatgatgctcccccaactaagctgagaagaaaatgagtccttgtgaatgccaaagagacatgaatgtgacctgcaccaatgctgcaaacctaaagccagtgggactagaaactgtggaaatgacagtcttccggtccggtcagagcatctgaaataaattgcccacagttttcttccaaacttttaaattgtttacaaaaggtttggtggtaccaatcttactgagacggcctagaaatacaagtaacgtaaatttcttacagagtgtctacaatgctgcatgccagaggcactcagcacacctgaaggatgtgaagctcctgtaggaacagtagctctgtacaacagtaatctctagacaaccaacgtaaatttaaacaaaaaggtgtgagaccacacacccttcttccagtggggcataactgcccaggtgtaaaatcagacaggaaccctgaaatatgaaccatctccagtttgcagacagacattgctgccattctccacttgactcccctgtgcccatgcctgaaagccccgcttcccctagagaggtgggggcagtgtggccacagcctctctccccgcagtaccacctggtcccaaaagtcccagccctccacggcagcactagtgaggcctccttgctgttgctgctgttactccctgagccttctagagaatctcctgcatgccctgtgagaatgtgctgatgctggggccactgccacagtcgcgggttttctcccagacccccttctggtgccaagtaggaaagatgggaccaggctaattctgttgccactgagacaagtgaagacatatcctgatgtctggagttggatctcagaaggcgccttccagtgtataaactgatatgaaatggtggttaggtcctgtggcactgcacaccaacactgtattaccttgctcgggacaccgtaacaaaataccacagaccgcgtggcttaagcaacgtaaattgatttcctcacagttctggaggctggaagtccgagatcaaggggtcggcagggttggtttctcctgaggccccctctccttggtgtatacatggctgcctgctcgctgtgtcctcacgtggtctatcctctctccctgtgctccccagtgtctttctgtatgtccagatttcctcctgttacaaagataccagtcatactggatttggaaccaccctgcctgcctcattttaacttaatcgcctctttaaaggccctgtctccaaatgcagtcacatcattctgaggttctggtgatttaggcttccacctatgaatttggtggggacacagctcagcccaccacagacattatgggtaaaataggctcatggcaacaacttccgaacctaactactgcttgggtaattgttaagggtttcaaaataactgactgtcaaacaagctctggaaactgcattccaaataaactgtggggctctgcctgttaaaaggtaggaggtcctggcgaatctgttatgtccagtaattactgaatactcccttaggggccattcagggtctgctggttacttcaataaagaatgctgtaagaaaagcactgagtctctggccctttctaaaagagttgtgtaagagacataaagccataaaatatgaagtaggtgcttgtttagcgactgaatgaaatcaggaattttccggagataagattatggtattcttctacactgtataaatgctatcttcctgctttgtttacctctttttatacaaaagaccacctaggcacaaaaggaagtgcccctacctagcatagtctgaacgagtgaaagagagtctttaattttaacactaaagataacagatcttgctgtaaagtgcaatgatgcttaatagccctaaagatcaggttgtgattgatgggatttctcatggtgttcttgttaaagataaatagtagtttttaatgttatcagactggaaacatcttactcttttctaatgtaagctctaaagcaaacttcggacactaacatcttattgccaacttaacagaaaagtgtgatgggatattggataaggctccgacctgcgtgcctgaaatttcagtggttcggtttgttcctttgaatgaggcatctctctgaggcactgcctttctaagtgcaagttttctaggaagggcagtgtgttgtcagtttctccttagcgtgcccagtgtatctaggatgatacaaacaggaagagactgggaaaaggagggttcaaaaaagggagggacccaatggccagattaaaaaccagcttaacctcttcattgtatcccaggcctgatgattgagcatctttattcttaggattctccaactttaggctacctgatacatctagagcagcggtccccaacgttttcggcaccggggactggtttcacagaaggcagtttttccacagacaggggagtggcagggaagggatggtttcaggataattgaagcacattacatttattgtgcactttatttctgttattattccattgtaatatataatgaaataattatacaattcaccataatgtagaatccatgggagcccagagcttgttttcctgcaactagactgtcccatttgggagtgatgggagacagtgatagattatcaggcattagattctcataaggagcacgcggcctagatccctcgcgtgcgtggttcacaatagggtttgcgctcatatgagaatctaatgcctcagctgatctgacaagagacggaactcaggcagtaatgcacgcaatggagagcggctgtaaatatagatgaagctttgcttcctggctagcccttcacctcctgctgtgtggcccagttcctaacagggcctggaccagtacacggacccagtactgggagttggagactcccgatctacagtatgtgagaaatcacatcaaccttttacaaggattgagcctaaatttgaaccaaaaaatacttacttctaaaagtaagtaagccacagatagatgtcagaatacaactagcaagaaggtaaagactcatggaaaagatggagtaatgagttttcttagcactgtatgatacgacagaaaagctgcagggggaaggcttcacgaaagcaaaaaactccaactagaaatagcctgcaggggccaggtgcagcgactcacgcctgtaatcccagcactttgggaggccaaggtgggtggatcacttgaggtcaggagttcaaggtcagcctggccaacatggtgaaacccatctctactaaaaatacaaaaattagcccagcattgtgttgcacacctgtagtcccagctacttggaaggctgaggcaggagaatcgctagaacccgggaggtggaggttgcagtgagctgagatcatgccactgcactccagcctgggcaacagagcaagaccccatcaaaaaagaaagacagaaaaagagagagagaggaaaggaaaggaggaagaaagaaaggagaaaagaaaggaaagaaagagcctgcaggctctcagggatcactgttctactgttattttataaggcaaaccagggatgagctgtatttagccacagattattaaatctggaaagaatttagaaatcatctaatctcccctttatacacataatgaagctgaggacagagaggctcaagatggtaaagctaagtggcagagttagaactagacatttcttccatttcagaccttttcccactacttccctgtgcaaccttgggaagaaagtcctcttagcctgtcagaggcatctctgtctgtaactgttctccctcacgaatgttaactcctctgcaggatgccacagggacatttgccttctagtgcaagcagagtgtttcaggaatgcataacagcagatagatacatgtctgtgctaggtgttgtgcactaaccaagcactatggatttcttgcagggagaaaaaggaagagtagataactaacaatatcttattaagagtctcctgcagggctgtgactccacgcagctctcttctccctgtcctgctggtgggagccttgagcccagctcttgagcactgtctggtgtggcaccctgcaggctgccagcagctgtcatacgggcattgggatcgttggaaagtgctgcaacatgggagtagctggggcagctgttgattgggagcagcctccacgggctgtgttcagtgggtgattccatgcctttggtctgtgtggagctcactctctcccttggctccttcggaggggtgggcccaccgccctctccagctgttttctcagaaagagaggcaaagaagaaggacctggcggtccttccagagtgcttgctgtggtgtgggcttcgcctcccctccgtgtgggaataaactgtgtgaagccatgtgggtcctggagctccgtggcttcacccacactttctgggggaactgcactcacaagtatggagagccttaagcattcgttgagccagactggactggaaacgtcccgggagtccctcattctcacccttcttcacctaagtaaacacacaacaaaattctctgagctttagggggctgtgggaatatttttctttcaaccccaaccttccccaagagctttcaaatcacataaagtactgttttccctttagcaatccaaaactagtaacatgcaactccaggccccaccccaccccacccccatcctcctcaatgccagccaagtcagacacaacttgccatgtccctgtggtgtgccatgaactgggcaggtatgccccggggtcactcagagcagcccacgggaccctagagctctggcagtcgtggaaccccttccatggcccttgtgagttacggggccaggagtttgtatcacatcaaagggtcatttcgtcatctcacaagggagtcaggagataccacccagagaatgtatcagatttatactaaaaaaaaaaaaaatccagcaagatccatagctctctgtgggagccattccagtttctccctgtcacagtggccctagaatcagataccacgcactggaaatagcagagtgcaaccctggacgtagagggtgcattgagcacgtgccactgtggctggggggaaacttccttctctcttcctgcctggcctgagagattgcctggacgtggatcaggctttgtgctggtttagcacttaaatcttaactgcaacaaagccttgttcttaccaccctgacagtttcagcattaggtttcttattagttgtttgggtttggggttttttttgttttttttttttcttcatcttctcccttttgacacttttcatttctgagagccaaaccaaatacgctaggcggactagctaacctggctgtgtctgcgattcccagagccctgctgctgctctgatgggtccctttggtaaggagggaaatttttctccatttttataacgacgagcccttaatttgaacgtctctgttcacttcagttaatagatttgtaagaaataatgtgagatattaccaaatcagcttagacaaccagattaaaaatctgcctcactgggaaatctgcttctttgtttagaatactccacactttctcaagcctgcatctgcaaatctttggcctgataaagacttccagagtccatccgtccatctcttgcttcaggactgtacttcgtccaagcattccacacagaagggtaactggcttgttctttgagtgggataccacgtcacagttcctttggtgttccagggacatttctatacaagagatggtcccctgttttcttagtgtatagaggctcatcagaccaatgtaaatctcctgttgagttttatttttttaattcccatttttgtcttttatagtcatgttttctgttctcttgccaaactcccgtgctattcagctcccttcccagcttgttcagaaaaggtataacacccacatcaagataaaacctgctgagcatggtggcacacacccgtagtcccagctgctcaggaggctgaggcaggaggatcgtttaaggccaagagttcaagacccacctgagcaacacagcgagaccctttctctaaaaaattagagaggtataacttttcaggaaagaggataatctggaaagttgctgtaggcacagactatcacgtagaaaaaactgaaattatctcagctagggaagaatgctttaggcaggaagacagccagaattttagaagtgtctagacataagtaagttagaaattaagatatgagtatgttggtgacatctgcgaatacaaaatataatcatcagaaagcaaacatttgttctggattttgtccagataacggtttaaaactgaagtgttgtatctattgtagtgcgtggttccagctcctgctgtacatgaggaggttaatttggagtgacaggtgttagcaacacgtgtttcttggtcctgtagattgccactgacccaattcatttgtccacctttgctggggttacttggtctctcagttgttgactttcacaaaataatggttgactctaaccttgcaaagaataataaacaactgtgagtggtgacagctggaagaggtctgacagctagcaagaccagattccttgtaaagctttcctctcaggtaggggagacttcctctttttctccatggagagcttgtgcacctggatgcagtagagcctgatccactaaccactggccaggcgtgatagatacatattaagttttcctacaacagatagatctatcagtctaacctgtgtacctggccctgtacctcttgagacctcagctgtcttacttgtaaggttagagaatgggactagtagttcctgtagctcccttccgggctgatgagtctaaatttcagaattggcctgttttgggtgtagcatttgtaggtctcgttgttccattgttgggtatttgcctgagctgcaggtcggggataggggacagggtagaaaactaaatgataatttatgtttttatatagattcactagaaatcttaactgttttatttcttttagggctgggggctgccagtgcagttgcagagttttcagtgccatagctgggaagcagagaagctcttgatttgtttttgttttgtttttaacctttgaaaatgaatggcagaaatatgtgatgacctaacattaaaaaatctaggccaagcacagtggctccccactataatcccagcactttgggaagccaaggtgggaggattgcttgaggccaggagttcaagaccagtctgggcaacatagtgagacctcctctctacaaaaaaaatttaaaattagtggggtgtgctggcatttcgctgtagtcccagccactcgggaagctgaggtgagagaatcacttcagcccaagaggtagagattgcagtgagccgtgatcacaccactgcactccagcctgggcaacagagtgtaaccctgtctcaaaagaaaaaaaaaaagagaagagaaaaggaaggaagggagaaagaaaaggaaaaaaggaaggaagggaaggagggaggaaggaagataaatctagctaccctaaggcatatggctagcattcactcagtaaatacttaatgaacacttattacatgccaggcataaagtgttgttgataatacaagaaagtaattacatacttgagtttccctcccatccagggaatctcatcttctatcatgagggaaagaaaggaggaagtccctttatatcaccacttgaatctggaggagatgactgtgaactatcaaattgttaagcagtggaattttgactttggatagacagacccgaatggagccaaactcttgttgttttttgtttgtttttctgagaaggagtctcactctgttgcccaggctggagtgcagtggtgcgatctcagctcactgcaacctccgcctcctgggttcaagcagttctcctgcctcagcttcctgagtagctaggattacaggcacgcaccaccatgcccagctaatttttgtatttttttaagtagagacagggtttcaccatgttgatcaggctggtcttgaactcctgacctcgtgatccacccaccttggcctcccaaagtgctgggattacaggtgtgagccactgcgcccggcccaaactctcgtttttattatgccattttgttcaaagttagttatgggagagcagtaacatcttatttacttttggtctaagcaacagcctttccttcctgtaaaaacaaattcatacattgcctggcaagggagttcatcacaaagtaggaaggggagctgggtgtgatggtgcgcacccgtagtcccggctactcagcggtctaaggcaggaagatcacttgagcccaggagttccaggctgcagtgagctgtgatctcgccaccgcactccagcctgggggacagagtgagactctatctcaaaaaaaaaaaaaaaaaaaaggacagggagggagaaggagaagtccccacagcagcctcacagccattaccacttccggcccacttgcacagtctctgcaagtgcagacttgaaaggaaagaggactttggagttaactttaatgagtgggaaataaacataggataaattcttcaagagcaattttagttttccctggtactaagtgctaaagggattctgtagagtcaagaagtgaccagatgcctgtagaaaaatagatccctgggcaaaaaagattgaggtttagagggattgtagagggttagagggattccagatccctctgactgtgtaagttttatgtcttattcaatagatgctcttacggcaaaatacatttccatttattccagttgtgtgaaattccaaactaggaagttattttatgtcttcgtatctcctaagaagcctgcagattcaagttaggggcttgtgggccagacctggccaggacgagcaccatttccacttgatctgtcagctccaaaaggctccgaacatcatgccagattacagctcagacctcatggcctgtgacacatcctgggacttagctgttagaacctcaagtttagattcttgtctgcttaaaccaaactaggcatttctgaataatttcctgccctccaccaaaccatctgcagaaaggaattaatctgagtcactgccaaccacagaggaattcattcactgacccctcttgtaaccgtcccttctttatacccatcaatacatcctccctttcacctcatgctttgtgactatgaatagagttgtttaccttgaaatcaggccaagtccacagaacttttaactgtattttctcttttacaaatttatttcacggagttctggtagctctctctaacatctttactagagagaaaatgttgtttctgttctaaaatcatgacttgtgctgagcggtaaatgtttggggcagtctccctgaatcaagcagcccgcccctcagctctgcttctctttctccattcagccccctcgcattccttattctttagactgtcagcttgttctctggcagttatcctaacactcaaagagggaagggggcctgagtggttttccctgtagccagtcgtaaccatgcttttgtctgccatatgcttggagagcctcatctctgaaatgttcccgctctgctgagcttcctccgttcgtttcttccctgcacagtggtagggtgaggcattctccccttccctctgctgcatacgcttccagcctgtgttgctttgagcattcagattgagttgctcttgcatttgtgattcttggctcaagtccctctagaaatcatattactactctgagttcagggagggctggaacagctactaagaacagaatgcattttaataacattcaacacacaaaaaagccagagaatttctgccagaggccaccttcgtatcctatacttgtcccgtattccatcccttaagaactttaaacacagtggagtgctacactgtatggtttatgtgccctgctgtctaccaaagggcctgtatcatcagattgttttggtttggacatgcttcaaatttgaacttaaatagctctttagaacattatcgaggcctttccccagaattaatatctattcctttatttcattcaccattttcagattgtctgctacgtgcaggccttttgttacgaggcaatattggtatacaaaaaagaattcaccaaggagcttgaagaacagttggggaattaaacataaaaccaactattgaaaggggacaaaatgaatactgtagcagtttacacttctaaccagggatggcattacagagaaaaggggctcaaccgtgaaggataagaaagatagagaagaaagatgtgtaggaagtaagattgtccacattctagaatgagaggaaaggaaaagcaaagacagggaatggcaggtatgtaccaggagatgaaattgaagcagtagctcccatgccaaaaagcttagtcttttattttgtaggaaggaaatcatttaagatgttggaagaggaggagggaactgttccagcctattttagaaagattactcttacaccagggttgaagtagttatgaagctattgcaagatggtagaacatgagagcttgaattaggattgttaacaaggatatcggaaatgaaaaaactaggctagatgtggtggctcacacctgtaatttcaacattatgggaggctgaagtgggaggattgcttaaggccaggagttgaagagcagcctgggcaacatagtgagatgtcatctctttaaaaaaaaaaaaaaggctgggcaaggtgactcatgcctgtaatcccagcactttgggaggccgaggtgggtggatcacacggtcaggagatcgagaccatcctggctaacacagtgaaaccccgtctctactaaaaatattttaaaaattagcctggggccacctgtggtcccagctactcaggaggctgaggcaggagaatggcatgaacccgggaggcagagattgcaatgagctgagatcacgccactacactccagccagggcgacggagcaagactccatctcaaaaaaaaaaaaaaacttagccaggcgtggtggcactctcctgtagccctagctactcgggaagctgatgcaggaggatcacttgaggccaggagttagaggttacagtgagctatgatcactccactgaactccagcctgggcaacagagcaagactctttctcttcaaaagaaaaaaaagaaagaaaaaactaaattagaagaaacatgatctggaaagagcattaataggaaactcacagaagaagtggccaataaatatatattttttaatgttttaccccagtttttggcttcactacagatgggaagaactacgaatgaaaacagtgctgtcatactgggaaggttgggattggttggtttgttggagtccccagtatgttcagagagtgggaaaatggcacccttatttcttgcttatgggctgaatatcagtacagctattctagaatggtctggttacttgtcaaaagctttacacaggtctataccctttgactcgggaattttaagtagaaaatcatagacatgcaaagatttatgtatgggaaaatgtaatacattaatatttatagtaatgaaaacgagaacaaactaaatgtctattggagttaaataaattacaatatattaataaaatggattacaatgcagcccattataaattattttagaagaatattttatcacatgaaaagctgtttaattattgggtgaaaagaacaattcagtaaatagtatgaacagtatgatttgatgtgtaaagggaacattcaccaagagatgtttatcaggcactggaaagatgtgagtctgaaactcagtagaaaaagaagctagagttataattgtgtagatccaccttcataatggttatgtttagatgagggacatagaagagttattatgctagttattatacatgtgatattttctgtgattaaaaaaaaatttaaagaacacctacctcaaaagaaataaatttgaaagaaagtggattaaatgtgttaatcactaaagcacttagaataatacttggcccataataaatgcccagtaagttagttgctgttattatcaccctccccccttttaaagctaaaggtaaacacatttcgctaagcagaggatctaagagagaacagtggacagtctccttagacctcaggaaacccctgcacgtgtgagactgagcagaaagaagaacaacaccaggacagggaagaaatgttggggcaggcagaggagagccagaaacatgtgggtgttgggggcctctagggcagacagcctagcaggtgttttcagggtcagattggatcgtacagttagataatccttgggggtccttgatgggtttttttctgaagttttgaaattataacttgcatacagaaaagtaaacaaatcctatgtatatagctgaattacacactcatatagcaaattcttggaacaagcagcagaatgttaccagtgccgaagccccttgtcatcctccttccagtcactcctcatcctccaaggataacctgacctcaaacaccacagattagttctgcctgtttttaaactttctatgcctggaatcataccatactctattgtgtctggattctgtcattcaacatcatgtttacgaattgtatctgttttgttatacatatagttcattcattctcattgctctatgatattccattgtatgaatgtgccacaaattgtttatcgtctgtttatcattcagtatggacatttgggttgttcccaggttttaatactcttatcagtgtcttcaggtgaatttacatgtacctacaagtccacttgttcagcttggcattcaactttagtagatactgccagatgtttttctaaagtggttatggccatttacactcccaccgggagtgtaggagaggccaagtggttccacgtccttgtcagcacttgatactgtctgtctttttaaattttagccattctggtggtcatttagtggtatctccttgtgattttaacttgtattttcctgatgactaatgagttatccacctttttatatgtctgttaaccatttcagtatactcttgtggtcattcaagtgtcttgcctatttttcattattaactgttgttactgctttataggagttctttatatattatggatatgcatacatcagatatgtatcttctcctgtggactgccctttcactctcttaatggtgtcttttaagagacagaaatccggccgggcgcggtggctcacgcctgtaatcccagcactttgggaggccgaggcgggtggatcacgaggtcaggagatcgagaccatcctggctaacacggtgaaaccccgtctctactaaaaatacaaaaaactagccgggcgtggtggcgagcgcctgtagtcccagctacttggctgaggcaggaggatggtgtgaacccgggatgtggagcttgcagtgagccaagatcgcaccactgcactccagcctgagcgacagagtgagactctgtctcaataaaaaaaagagagagagagagagagacagaaatccttaattttaatgtagatccagtttatcaattttttctctttgtgattattgctttttgtgttctgtttaagaaatctttacattccctaaagatggtctcttacattttcttgtaaatgctttattgttttacccttcacatttatatatgtattcatcatgaattgatttttgttaatggcatgaggtagaaatccaaatgtgttttgcatatagccccaccatttatcagaaagaccatcttttcccagtgcacagtcaagtggccatatacgtgtagggtttttccgtgttctcttttcgtcccattggtctgtgtgtctgctctcgtgccagtgctatgtgtgtgcattgctgccgccttgcagtgacagccttcttccagagaggagcatttgtatagctttgttcttggtggccgtcttggctgttctgggctctctgcatttccacttactctttggaatcagctcgtctattcacatacacacctgccagttttgatatggcttgcatcgactgtatagattagttgaggcagaattcacacctttacagaaatgaggcttccaatccttaatcatgtttattcctccatttaagacattttaacttctccaaatattttatggtttcaatatagaggcttctgtaatctttcgagagggcaatttcagtgaaatagcagaaactaaattctcagttattaaggagagaactcagaaatgcaggtaacacatgtagactattcttttgagaaatttggttacaggaagagaaaagttgctactagcttgtgagatgcagattccaaaagtcttttcaggacgggcaggattcagtgccctcagaagccatagtgaaaaaccaagggaggggttggaaacagagttcactgaagggacagagacatggagagttagctcaggagtgtgggtgctcctgaggcgtgtggaaccctgctcgcctggagaagccaggtggggtcactctgaggcaggacggatccagactccccgggtgcccacgtagtcaacagcacggagctgtcgtgagccgtgccctttgcactgagagcagcagcaagccctgctgccctcacgcctgtcctcatccacacctctaagcccctggaatacagcacatgttattttaacaaagcatgttccattttctctaccgaaggtgtatacttgtacatgtgtcattccaacagtcctttcctccagagtatcttggttaaagtaaggtttggtggaaaggggctttttttttttttttaaataaaatcttgcagtgcccaggaggcttgaggaatattttgtagtagaaatactatatatggaggaaactaaggtgctgagatatgagacttcgtgcttaagttatagaaagggctggcagaattcatgggagcaaacttgttttgcagtttagtgaaaatcggtttactctggaagtgtttttcgatgttttgttattgtttgtttttagatacaaggttttcagcacacgcacagaagatggcatctgcacatctagggagctgattgggtaaacttcagtgctgcccgtaattatggtgtttctaagaaagtaaccaagaagccagtatttttcactgtaatagttgcagtggtgggattacttgccagtattagaaaatggagaatgggaaatggaaaatctcattggattactcctccttacattactgcgtttggatttgtagtcttaacaaggcaataaatggaaggggaaagaaggaatcaattcatggtaactagaatgtaatgagcactttcattaagtcacaatttaatttgtattctttcggaaattcttttctggttttaagcctaaaggggcctgccttgaggaggtgaggaagataagcaggtgtgggagggggtgtgggtagtgggcagggggttgaagagagcaagaatatctcgagtaataccttttaggggaagtttcagacactaaaatacatctttcccaacttatccacagaatccgttgcatcccaaagccatggaaaaactgccttttttcatgtgatgctcatggtaaggaaatgcagacgcccccagacgtcccccttactctgggcagtctgttgcaagctccccagtggatgctgaaactgtggatggtactgaagcctatagatgctgttttcttctatacatatatacctgagataaagtctagtttataaattaggcacagtaagagattaataataaaataggacagttataacaatactcggaacagcatgcactgtaaaacttatgaattgtttatttctggaattttccatttaatatttccagatcgcagttgactgagggtaattgaaaccgtggaaagggaaaccatggacaagggggcgccgccgtattttagtataaggaggttgtgaataatccatttcaggttgtgctttcgcacctgtgctgtataacacattgatctaagtttttagtttgctttcttcacatcgcctctctttcctaagcaatctaaaagttttaacaacacatgcctgtactcctttgacttcagaatgactaaagctttacaatcaaagtcaacaaaataaaagtcgcattttaaaagtaatcacggttacacaagagaagttgatccttgagattctttcaagccaagaaaaaatagaatggatcaagcgccaatgaaatctgtccctgctcagctgtgcccacatgtaatactgctttcagataaaatttgaaccatgcctaatccctggagaacagagaaaggcctcccagatggaaagcaactccagctagtgaaggaacacttccttctctaaacttttcgattctgtgattccctctatttttaaacaccttttcccaggcatagcatacgttagaccctggaaaagcgtagccttgtagtctgcctctggtttttttttctccttaatcttattccaccatttcttgttatacttcctcctccagcgctaaatcactgtcccccttcttgtttacaccctcctggcatgtgtaggtaataatcacatttccctgccctttgtttttacttagttcgggtctccatgtttaggttttctaatcctgcccataaaatgattctttcagcttcttagtcatgctgccatttttctttgaacttactccagtttgtctcaatttttctggtaatgaggtgtctgaaacggaacacagtgcccttaggtgtggcctcgctgaaactgtgtaatggaatggcggtctgctgaggagtgatgcccatgtctggccagcccgggggcctttgtctctcttgaagagctggaatcgcttccatcaagatccggcgattcctgtgctccagaattgcagtgagcagcccagtgcctttcctcctttgtgcctcacctcatactgtgtttccatttgaactgaccattttctgtcccctgctgtcaagaaaatacccacccccccaaccctgccttcctttctgtccagactactgaaggcagtagcattttatctctacctatttgtggcagttactacacagtgttttgcatagagcactcagtcaattttttaaagagtttttttgtttgtgttttttttgtttgtttgagatggagtttcgctcttgtctcccaggctggagtgcactggcgcgatctcggctcactgcaacacccacctcttgggtccaagtgattctcctgcctcagcctcctgagtagctgggattacaggcacctgccaccacgcccggctaatttttttgtatttttgatagacggggtttcaccatgttgggtaggctggtctcgaactcctgatctcaagtgatccacctgcctcggcctcccaaagttctgggattacaggcgtgagccactgcacctggccaatttttttatagttttactgagatataatttacatacatacaactcacccattgcaagtacataattcagtagatttagtgtgttctcagagttgtgcagccatcaccatagtcaatttttgaacatttttgtcaccccaaagggaagcccccacctattagcagtcactgccaatcaccccatcctaccccagccccaagcagctgccactcttacttcccaactctggatttggctactctggaatttcatcaagaatggaatcaggctgggcatggtggctcacgcctgtaatcccagcactttgggagaccaaggtgggcagatcgcttgagcccaggagttcgagaccagcctgggcaacatggcaaaaccccatctctacaaaaaaatacaaaaattagccaggtgtagtggcatgtgcatatagtcccagctacttgggaggctaaggcaggaggatcacttgagtctgggaggtggaggttgcagtgagctgagatcctgacactgcactccagcctgagcaacagaatgagaccctgtctcaaaaataaaaaaagaatagaatcatacaagacgtggtctgttgagaccggcttctttcatttaatgtaatgtttttatatactttacatagtgtagctttacataatgtcacgtgtcagaacttcgttcctttttattggccagttggttaatactttttgagtggatattttatacacttcaatttttcccttcttaaggtcgtagagtatcagaattatgcctttaaaagtatatacagttttaaaaggtatttatgttatatattttggtatatttcttattgcaaaattgatgttgcttgtgctataaacagtacagaagtatgtaaagtaaaagtaaaatcaaaactccttccagccactgagagcttttttttttttttttttttttttttttttttttttttggagacagagtcttgctctgtcacccaggctggagtgcagtggcgcgatctcgccttactgcaacctccgcctctggggttcaagcttttcttgtgccttagcctcccgagtacctgggaactacaggcactcaccaccacatgtgaccgattttttttgtatgtttagtagagacggggtttcaccattttggccaggctggcctcaaactcctgacctcacgtgatccacctgcctcggcctccctgagtgctgggattataggcgtgagccgctgcgcccagcttcaatgaggtctttaaaaaatctttgttccagccgggcgtggtggctcacgcctgtaatcccagcactttgggaggctgaggcgggcggatcacgaggtcaggagatcaagaccttcctggctaacatggtgaaaccccatctctactaaaaatacaaaaaattagccgagcgtggtagcgggcacctgtagtcccagctactcgggaggctgaggcaggaggatggtgtgaacctgggatgtggagcttgcagtgagccgagatcgcaccactgcactccagcctggtgacagagcgagactccgtctcaaaaaaaaaaaaaattctttgttcctacaaattgccttagtaaacatacttgtacatacgttcttaaatttcttactggtgtttctgttgaacatactctaaaagtagaattatttggtcaaaggacatatacaattaaatttggctgatgagaccaaattgctcacctccctacaattgtcccacaggtcgttgctctgctgttcccacttcccatgccctagccaactctgtagtttatatttcttgttcgtttgtttgttttgagtttttcttttccttttttttttttttgagatggagtcttgctctcgcccaggctggagtgcagtggcgtgatctcggctcactgtaagctccgcctcccgggctcaagcaattctcctgcctcagcctcctgagtagctgggactacaggtgcacgccaccatgcccggctaattttttgtattttttttagtagagatggggtttcaccatgctagtcaggctggtctcgaactcttgacctcgtgatgcgcctgccacctcagcctcccaaagtgctgggattacaggcgtgagccaccgtgctgggtcttgtttttctttttttgagacagggtctcgctgtgttgcgcaggctagagtgcagcaatacaatcacatagctcattgcagcctcaacctcctgggctcaagagttcctcccaccttagcttccagagcggctagaactagaggcacgcacaaccacacctgactaatttttttgttttagttttttgtagagatggggtctcgctgtgttgcgcaggctggtcttgaactcctaggctcaagtgatctgcctgcctcagcctcccaaagtgctgggattacaggtgtgagtccccaaacctggtcaagtttatatttctttttttttttttttttttttgagacagagtctcgctctgtcacccaggctggagtgcagtggcgtgatcttagcccactgcaacctccacctcctggattcaagcaattcttctgcctcagccacccaagtagctgggattataggcgcccgccaccacgcctggctagtttttgtatttttagtagagacagagtttcaccacattggccaggctggtcttgaactcctgaccttgtgatctgcccaccttggcctcctaaagtgctgggattacaggcgtgagccactgcatctggccatatttaattattaatgaaattgggtattatttttgtgtttgttagccatttgtatttcttctgtgagttttttgttcatattctctgcctgtttttctattaggttataggtttttaggcttatggtaccacttcataatacagtaatgtcaatcctttgtctttttgttttgtgtttattatgtctttcaagccgtcatttgtacttcaattaaatgtatagctcttctgtctctatacagacattttaaatttctaaatagcccaacttacccttttattcctttatgacttctgaatttaaaagcacttaccctcctctccaaaataaagctaaaaatacttttctgtctcccatcccaagattataaaaaatatgctcttaaatttactttcagtgttttcacagcataggttttaaatatacatctttaaccagtttggaatttatgttgctgtatggtataagcaagaatacaaccataaatgggcctagttgaccccgtacagttcattgacttcatatgcttcctggtcatatcctaaatcccagtcatttaatggtatcaacccaacactcttctaattattgtacttttatggcatgttttgtttggtaaagcaagtcttaacatcactcttctttctttaaaatattttcttgactcttctctatatttatacttcagtataaatgttagactccattatcaaattccaaaaagaacctttaggatttgtttggaaatgtgttatacacacaaatacacacatacataaagcctcaagtaatgcatgataaaatatatagcagtggttatctctagatgatggtaatattctaggtgatttttttcttgtttttttttctttattttcgaaagtttttacaatatttgtgaagcactttttactttattttattttattttatttttgagataagagtcttgctctgtcacccaggctggagtacagtggcacgatctcggctcactgcaacctccgcctcccagtttcatgcagttctcatgcctcagcctcccgagtagctgggactacaggcacgtgccagcatgcccagctattttttgtatttttagtagagacggggttttgccgtgttggccaggctggttttgaactcctggcctcaagggatccgcccacctcggcctcccaaagtgctgggtttacaggcgtgagccaccgcacccggctgtgaaatcactcccggctgtgaagcactttttaaattgcggaaaactcctgaaaaaaatgttcttaaactaaattatatccttcagtaacttcatgattatctacttaacataacagaagcccaattagaataaagactatttcatgggaaataaataagtgacttgtagagactgaagaagagttacctggctcagaatataaactagaattgtctggaatattcctgggaaggatccagctggaatcaagatactgaagcaacaccaccccataaccttttctgtagcttggttgatgtcagttctgctgagactttagggtctgtagccttttcacttagcagcattcctgggttgttttctctgcagctgtatttacaaggtacccagcctcctagctttccccgttgaagagattcttactcatgtgacacagccagagtttggggtgcaccaaggccgcgtggtctaaatcgggcccctcagtgtcctggtcttttagtcagcatttagcagaaggaagattgctaggtctattcttaactctttgatatatttaagaagcactgtgctcattcttgactcagagcatctagattctttcttttctttttcttgccctgtcttatggtgccaagcatctagattttttttttttttttttttttttttttgcctgttttaagatggaatctcagctgggtgtggtggctcacacctgtaatctcaacattttaggaggccgaggcaggaggatcccttgaggccaggagttcaagaccagcctgggcaacatagttagaccgcacctctaaaaaagaaaaagaaaagagaaatacaaaaattagccaggcatggtggtacacatctgtaatcccagctacttaagaggctgcagcaggaagatcacatgaggtcaggaggtcgaggccacagtgagcctgatcaaaccattgcactccccccagacaatagagggagaccctgtctcaaattaatagaaagagagagagaggagaagggtaggaggcaaggagggagggagggagggaggaaggaagaaaagaaggaaagaaaagaaacgagagagagagagagaaagaaaagaaaagaaaggaaagagagaaaaaggccaggcgcggtgactcaggcctgtaatcccaacactttgggaggccgaggcgggcggatcacaaggtcaggagatctagaccattctggctaacacggtgaagccctgtctctactaaaaatataaaaaattagctgggcgtggtagcaggcgcctgtagtcccaggtactcggaaggctgaggcaggagaatggcacgaacctgggaggcggaggttgcagtgagctgagatcgcgccactgcactccagcctgggtgacagagcgagactcacgtctcagaaaaaaaaaaaaaaaaaaaaaagatagatggggtctcactaccttgcccaggctggactcaaactcctgggctcaagcgattcccccaccctcagcctcccaagtagctgggattacaggcatgcaccactgtacgcagctccctttttgctttttaatctgtatgctcttgctgggtgatcttacccatttagtaacagttagaacacctaatatttgtcaagcactttatatgactatctcattaaatccttaaaacagccctataaggtagggcacaggagctcacgactgtaagcactttgggaggccgaggcagaggcgggattacttgagcctgggcgttcaagacaagcgtaggcaatatagactcccatctctccaaaaaattaaaatttaaaacattggcctgacatggttattattgcctcattttacagatgaggaaactgagactcagacaagtcaaggtcagatgaactgatcggcagaactgaccttgaaacccaggcagcctaactccagagcctatgttcttaactagactttatattccatttttaattttcctcctttctttcctaaaacctgctgtctccttcgttcttggtcttatttgtccaatatccccagctagaattgtcagaaatgattctccagttctccctcacttgacacctcctccttttagtcctgccttttgaagaggctcagacctgtgtgttcctttccacgtccctggccctcccttgcatcagccttgcctaacccccacctgggctgcgagcaggagctgcccttggtggactcttccttctgctcagtctgagaaagtggcgatgctcatgtcactgtaccatttaaaactgcgtggactccttttttgtggttgtggtttggtttctaggcagatcacgctggaacgtcctcacttcacgtgctcagtctggccctcgcgtgtgttttcagctccatttcctgtcattctccacccactccctgtgccttacattcctgccatcctgaggcttcccttttcgcaagatctgggccaggcctgtcccagccccacgcatcagcctttgttcttctgcgctaagcctcctttgtctttggtctcccagacggactctagtcagctctgaagatccagaccccacgcctctttagtagcatttcctcagactcctcagggtgagcagacactcttagggctgccacagcacatgctcaagcctcagctgcggcctcactctgctgggtggtcgtttatctgtttacatgcttgtctccattaacctaaatgtgtcttcaggacaaggaccaaatcccatcagctttcaccacccagcacagagtagcgctcaataaaggttggttaaaatgcttgaaggaatgtgaaagaggctgttaaaaacaacaggaagttagaaatatacttacttctaagcaaagggattatcttgtgtttctcaaagtaatctcttcagctaaattagcaggcctcaggtgggtaggctaatgtaccggatgaaagcgatacacggcaaatggagaagtcctttaaattctaagttcccttagggcgagggtcgctccacaaggttaggatcctctctgagatcaccatgcccctctctcctgctctcatgcacgttcatgagcctgtgacttggtggagagaacattctgtttacagtgagaggccaggactgaagtcacagctctgcaaaaatgatcagctttcggcctagaaccagtgactaactttttgggcctcactttcatgaagacgcatttgatatttgcttttacacttttcttatggttaattttgatgcagagagacttcacatacagagtgcctttgtcatttattgatgaaaaataattcttagctcagtgcaaatgggattgttgtatctgaaatccatctctcctttccctttcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccgtttctacatctgccatcttactctgcctttctgctttggatgtggtctctacactaaccttcttgatgtccagggtagataaagggtcgaatctctctgaagaactgccacctggtcatcagcagtggagaactgtgggagctggtggctctgccctgacagagagccatggagcagaggagcctctcacctcctgtcctctgacatgagaatgaaaccaggaatggacttggagttcaacaggctgagaggatgcctccaatggaccagagagctgagtgttctaatatcacaataggtgctttctcctaaaagggcaaaaaacaatctcaaaaagattagaaaaagagaaggggggaagggaagagaaaatcgactcttctttttactgtctcttctgcttactttccacatgagatgctttgtaccggggagctgtgagcaggcctcacgatggcttgggagcactcgttctcccaaggtctgagtcttcatccagccctgcctgtctgtcgcagccttcctcactctgttcctcggccagttaacaagaagatggtgtgaggtgttctccaccagtctctcctgtttgagactgttgacgttatcatactgaggtgttagatcaaatatctctaattgaagaacatgtgaggttgaaagagcaccagccagggcaacatagcgtgaccctgtctctacaaaaaattaaaaagagaacatacaaagttgacatatgagaccctgttgtccccgcctgcagctttgccccagtaacagatgcccgttgctcttgggctggtttcccctgaacacctccaagaggctgcctgccttgccagcacccgtgtcctgagctcctgcagcccagtggctgctgaagttgtgatccctcactcaccctgctagctttgcccttgactcgtcttctctgaacctcagcctcgtgcattgcctggaaccttcttctagcataaatgaaggtttttcctcctacacacattccttcctcggttatttcattcagagaatatttatgaaatgcctactgtgtgcaagtcatccatccttgaaaaggccacttctcagtgagggagagatgtagtggattctgtgagacatacctgctggagttgaagcagtaaatagcatgtccttcccctccccgatcttaaggtgtgttttctagaaaagttccctaatggaattcatgagtttgggggtctcagtcacccgcttgcctgtaggattccatttgatgattctggatttttgctgtttgttattgcccttagaggggctctgagtatctacttgtgggtggccatttcctgacatctgcatgtacctcgtggaattcagccagcttcatgttgcaaatcagaaagctgaccccaagactgcaaatcaatgaaggtattggcattgttaaggacgtagcgtagacaacagcagtcataaataattaggcaggaacttaacccaaatctagttctttgaccacctctaccaccagaacccagcagacactcacatctcctgataagagttgctggactcgatgtttttgttttgcattttctcctctccttccccacttactcagagaatttaaagtctgtagagtcagcacagccccatcagtccaggaacttcccaccaccagcccttgactgtcccattaactgacatggtcagatttccagctccccctactccctgctgtgaaacaatccctctccctgtgagaggaaactgtggagcgtttcttatcgaaggttaaatggactctgctcataaacctcttactgagatgcttcctgatagccaggctggccagagaggggtgcaggggttagatagtaagtggtggtcgtttgtggtcagttacctcaattctgttcattgcagtgcccgtaaaccatgtagaaagctcccagcactgaaaggcaggagtgttagcatctcgctttatccaccataacgtaaagaactgcggtgtgataacagccttcacggggccacggtggaaccaagacagcaggcgaggccatgcctaaacaagtggtctggcacgggcactggccagctgctctctccaagcaggtggcccagatcccacccacgtggactttctcatcaggtgcagcgcctgccactctcagccactgggtgtgtcactctcctcttcatctcagcattctccatcacttcccctccagaaaaacggatggaaggaagccctctgtgacactgcttctgagaagaagcatttccgggaccgatatcatctgtctggtctctgtgaacagcaaggaatcttcttgaccgttcttgggcactggaggctggctaggagttcagtaataaacgtggccttcgtgctgtagggcagagtggatgcagtttgtagctttcagagtgtctcattgagtctagatcattgaaccaacacttaaccaaatgtcccactcccatcacactaggacttgtcattccatgcccctctcctagtggtcatggtttcatatgggcatacaactgctactgaagttatatagccttgaaaactcagtgcaggttgcccttaattttccccaaacccctccatcggcaagtctagttgccctttagcacctaaagatctgcaccccaaaccaatgtcaccataaagagggcacgaagaagagtgggtgtgatcccaacggggttttgtaactgaagaagcccagtgtgagcttctcatcttttcatatacctctaacccccggtactcattgaatcattgatgaggtatctcaattgagatttgcaaggactttgataccatttgaaatggaaaaattttgaacgggctttaacatgtttaagaaatatggatggggccggccacagtggctcacgcctgtaatcccagaactctggaaggctgaggcaggcggatcacctgagatcaggagttcgaggccagcctggccaagatggcaaaaaccccgactctactaaaaatacaaaattagccaggcgtggtggcgtacgcctgtaatcccagctactcaggaggcaggagaatcgcttgagcctgggaggcagaggctgcggtgagccgagatcgtgtcactgcactccagcctgggtgacagagactccattt

SEQ ID NO: 38095 - DNA, 7746 bp, Homo sapiens
agaaaagggagccgcgcagcgcctacgggagtccggcggcagcagccggtaccggcaaccacgggcagctctcagggaatctccgtcgtgaggccagaggctccagtccccgcggtgcgtatcgtcatgcatggcttttggttcgccctctccggttagtcgagcagggccggcacaacctcctcctccgaggccgaagcagagatttaaccggcctgacgcgtgctgggctgcgggcgagccagtgatattccggcccgctccggcgcatctagaagggagcgggaggccccctgggcgctgcggagaagctggattgacctctgcgagagtggggagggtctgccttccctaggggcctgccccggaggagctgccattctgaaaagataaattgcctgtgtacagcgctttacagtgtgcttttccatcccttaccacctgtgagctcctcaacactcagagcaggaatggttatccgctttttgcacccggggtaaggtgggaaggttgtgacttaactcactcataatcagaaccagggggaggaaagaaaggcttctggaagagatagacttaagctgcatcttacaaagtgaatatactaacagtgaagaggcattgcaaatgttgggaactgaggcttgataacgggaagatgaagctggtttagagaaccgagcctttcaagtcaggtgcaggtcattagtgaaattgttgaggaatatgactaaacactcacctaggccaggcttactatacacaacttgaactggtgtcaaggaaagcttgctaccattacagggacctgggactaccgaaaagtaaaaactaatgtctgtctcacaaaaaatttttttgttaaatttgtatttgcaaatcctccagtcatcaagtgaaccagcactgtgctaggtaaataagttacatgtgcagcccctgccctagtgaggctcatagactgattgcggggacagatatgagaacaggcaaatagatataaacaaagcttcctggagggagtggtgtctgcactgttctaaaggactacaaagcagtgtccagagaagttggaagaacacaataaaatagaagcctgcaggaggttgagagattatctgctgagaggactgttttcttcttcttaggtgatctcttggcagtacttggcactatcagtgcaattactccttggcagtacttggctttcttctaaaactctttctccaccacttcgggttttgcctcctcctttgtaggggtctcctcatctgcccctttggtgaccctgggcgtcttctgatcgcacacattgtgccttgctggttgcaccttctcctgtggcatgaagaacttgctgtatgctgacgaccaaatccctgcagctcagatttctcactgagacttagacccatgttcccccagctgctttccttctcttatttctgggtctttgctactgactctacctggaatgttccctcaataagtgcagctcacccagctggtccatctttgtctggaagcctccctgctgcatcgggctccaggtcctggttatatacccctcccttatgcccctggtcttaactctcctcctatcatggttatagtgtgctcctttgcccctgtctcccaggaacttgtaaactccgtgaggtcaaagacattcacacttgggcgcctgcataccatagcgtctgacggtacctagcatatgttagatgttcaatacatgttagatgagtcagtaaaagaaggaatgcttaccagtgttggatgttgccgagcagacaattaaaataagcactgaaaaatattggcattagccacaaggaagtcattggttaatgctacgggatcagtttcagctgagattgaggacatcgaacaagtgggaggtgaaagtaggaacagccagtgttcatgagaccttgaaaagtgtaactgtgaagtggcaaatggagcagttaggtggaatgggtgaggttttgtgtttctgtgttttgttaatgctaggaagtacccaagcacatccaaagtttcatgggaaggaggttgctaagagttagaagctgaagacacagaaaagagaggggagcactgatgacctgcggtccaagaggaagcagaaggagatgggatttgacccagagcacaatgaaagacaaggagattgtaacattatctggaagagaagccgaggacattataggcagaaggaacagctgaggcagagggtggatagtggaagtgcaagcactagccattatatgttgggatgaaggagctggaccggtaggtcaagtccagtctgggaaagaccttgaaagccccagttagaaatttaggtccagtttgggtgtggtgcgggcgcctgtaatctcactactcaggaggctgaggcaggagaatcgcttgaacccaggaggaggaggttgcagtgagctgagatcgtgccactgcactccagcttgtcaacagagcgagactctgtctcaaaaaataataagaagaaaagaaatttaggtccagttgcaaaggcagtggagagtgccccctgggcctttcctttctgtggatcacagccttggccagtattgctaggattaggatcaccagtgacatccaagagcaggagcagttccacagctcccagccttctgtgagaggtgcagatggccatttgcacccttgtcacccagtttgtgctcaaggtgtggccaggccagttacttccctggctttccccatctgggatcgagttgtgttcagcatcctgctgcctctttccccctctgagctgtgggcagccataagtgatagctccattccttctcccagagtccagatgcctgtccagcctccaagcaaagacacagaagagatggaagcagagggtgattctgctgctgagatgaatggggaggaggaagagagtgaggaggagcggagcggcagccagacagagtcagaagaggagagctccggtgagcccctacacacacagacacacacacacacacacagagcccctacacacacacatgcacacacacagcccctacacacaagcatgcacgcacatgcacatacagcgcctacacacaagcacatacacagaccctgcacacaagcgcacacacgcacacacagcccctacacacaagcacgcacacacagcccctacacacaagcacgtatgcacacacacagccccttcacacaagtacacgtgcacacagccccttcacacaagcacgcacgcatatgcacacacagcccctacacacaagcacacacgcacacacacagccccttcacacaagcatgtacgcgcacacacacacaggccctacacacaggcatgcatgcacacacacacatgcaggacgcacatgcacacatgcgggtacccaccactcctccccagagctagcccttactggcctcttgtcccagagatggatgatgaggactatgagcgacgccgcagcgagtgtgtcagtgagatgctggacctagagaagcagttctcggagctaaaggagaagtgagcgtggggacaccttgggctgggtctgcgaggatctgggatgaggaggtggtgggcctggtactgggcaggcgtggttggtgcccaggaagtgcgcgcctaacaccgggcttgctgtggaatgggtgctgggtatgtgtttgcccaagagcgatgggtgagcaaatgggtgcacggctgcctttttaccacgcaggttgttcagggaacgactgagtcagctgcggttgcggctggaggaagtgggggctgagagagcccctgaatacacggagccccttggggggctgcagcggagcctcaagattcgcattcaggtggcaggtctgtgggtggttctgtaccctcttcccctcccagaacccgtggcaccctgtccccttcctctctcgttcctgcccggccttgccctttgctctcagccctcctatgtgggcaccgggctccccagccaagcagggaccctcctccctttctctgcagggatctacaagggcttctgtctggatgtgatcaggaataagtacgaatgtgagctgcagggagccaaacagcacctggaggtgggcctgattgggcacactgggggtgaggcagggcacaaagcctgaagtggcctcaccccatccgtcctgctgagctattgccccctcttccagagtgagaagctgctgctctatgacacgctgcagggggagctgcaggagcggatccagaggctggaggaggaccgccagagcctggacctcagctctggtaagcgcgagagcctgggcaccccggaactgggccccgctcagtccacgcccacccctctttgggcttcagatgtcctgaagtcaaggggacagccagaggacctgcctgttggggtcagtgtgagggctgaaggagaccaggcctggaaagggcctggcacataatgggggctcaagcagagtgggtctccctgcctcttctgcccctgctctttccaaaacaggtatcagtgtgacatgcagtcacatgcaatagctctagtcccctccatgttcatagtacctgtgttcacgtggagtcctggggtggcaggaattgtcgtcatcccactctccactaaacagatgaggctcacagaagtgcagtgacctcttcccagggttgtgcagctgtgcaggcaggacctgaacagccctaaggggcttctaccccaagcccagggtggtgatgggacaggggagatgaggccaggccggcccatggtggaggcagaggctacagaaaagggagtatcctgtgggccagcaccccaattctaactctgggtctcggggcagaatggtgggatgacaaactgcacgccagaggcagctccaggtcttgggactccctgccgcccagcaagaggaagaaggcacctctggtttctggtatcctttcacccaaggtggcctaaaagtgggcaggatgtaagggtcaactccagacccaggggagggggttggaggggacatggaggacagtcacactagatgcactcgtggttgcttggtgtcatgtgaatatgtccaggcaaatccagctgtcagcagtttcttacggggtcctgggtctctctgggctatgtgaaccctaggaaaacagaaacgggctgggctccgtggctcacatctacagtcccagcactttgggaggccaaggcgggtagattgctcgggcccaggagttcttttcgagaccagcttgggcaacatggtgaaacccatctctagaaaaaataacaaaaattagccaggcgtggtggtgtgcacctatagtcccagctactctgaaggctgaggtaagaggattgcttgagcctgagagatcaaggctgcagtgagccgtgatggtgccactgcacttgagcctgagtgaggtttggcctttgaggcctttccatctcccggggttgtccgagcgggtccccagctttccctggggagcctttgctcatatcccaccctcctcttggaagtcctgcctgtcccgactgtccagggctcatctcaaacgttacctcctctgtgaggcctcttctggtcttaccctggtgcctatggcttcactttcctgtgtgcttctgtgccctaccatggggtacccacatcccagagggcactggctgcctccaccccttcctaggcagggctagcttaagcttagtccagggcctgctgtgctttcatctgtcctggcagagctgagtcctcctgcacccctgagggtattcctgcagcagccagtcttagtcattatggcaacctggtgctggagagcaggcccaggcagggagggaggaatctggaaggccatgacttgagtgaatggaaggtgaaggcatggagacatcaagtagggagcactgggggagggagagttgtctctgaagggataagccctgcgtctgtctttggatcagggaaggggccaggttagggccagtgctgcagagtgagatgggatgggcctcagccagctgacctaagacgaggtgagggtgagcaagggacagggaacaacatttggtgtcctccatagacttggttccaggacgacccctggaaccagggggttaagaggtaggaggtggaacctgacctcggacccaggtcctcagctcccactccatgctgtccgctgtacccccactcctgaatgtcaggtgggtggccctgccctcgtcacctgccacctccactaggcttccttgacccccaccacaggcccatacatcgtgtacatgcttcaagagatcgacatcctggaggactggacagccatcaaaaaggtgggggccgctgctgcccacgtgacctgccccacctcagggccccccaccctggcagcagctctgccatctgcaggcctgggagttctctgctcaccaaggcttccccatcttcagcccagagtccctggatcgcagttggctcacaagtcctcttgctcaaggcggccctgggaaaagggatttctagtctgtgtcagccccttcccgttctggggcaggttttgatggggtgggagggtggcggggaggcgggagagccgctgagctggccagcagtcaggagcatgggagctctgcctgggtggggcctatgctcccggtcctgggggcacagcactgaggcaacagcccacaagccacagaggtggggggtggggcagggattgccaagctggaggtgggctctcaggggagcttttcttctcacccacccaggctagggcagctgtgtcccctcagaagagaaaatcggatggtaagaaccatggctgttgcatggccttccctgcccccttgccatcacctttcctcagctcagcttccaggaaggagcccagagaaaggctgtgactgtgtcagaatcagtggctcaagaaagttaggatggtctagatttgaggggcttgtgggagtttgaggagcaggaaccaggatggggctggggaagctctgggttgatggagctcccactcaggaggggtcagggagggctgtggagctgcccaggaggcctgttctgggccagcccaaagccactcagtaagtggctgcctccttcctttcagcttcctaactggtgacagttttcttcttcccacatatgcacaggaccttgaccctgctgttcacagccagggggaccctcagagcagctggcactgcacccaggattctcgtcttcctcctgcagacaggcggacccacaggcccctcagggtctgcccagccaggctcctgtggtgctgctgggccctcccactccatctggcactggcctggactcctcctctgccctcctcgaggcctgcacagctgtggccgtggagctgacctgaccaggcaaggctgctgtctccatccctgagccgcctgccacctcccactcctgaagatccatctcttggggctcccctgacagagaagacagccgaagtcaaagccacatcctcttgctgatgttggatgcaggctgtccggcctcagggccagggagccagtttccactgtgcgggaactctgagtcagacgtgattatctgggggtctgtccaccctggctggatctggaggcaagatgccaggccccccaggtgttctcagggcagttcttggtgtctgcttctcagattccaaggactggaattaaaacctttcctggg

SEQ ID NO: 38096 - DNA, 232512 bp, Homo sapiens; identical to SEQ ID NO: 37531

SEQ ID NO: 38097 - DNA, 3878 bp, Homo sapiens; identical to SEQ ID NO: 35933

SEQ ID NO: 38098 - DNA, 9807 bp, Homo sapiens; identical to SEQ ID NO: 35676

SEQ ID NO: 38099 - DNA, 15165 bp, Homo sapiens; identical to SEQ ID NO: 35827

SEQ ID NO: 38100 - DNA, 16959 bp, Homo sapiens
aaaattgcgtttgagtttgccgcgagccgggccaatcggttttgccaacgcatgcccacgtgctggcgaacaaatgtaaacacggagatcgtgtgccgggcacttggtttcgtggtgggcaactgtgctgctgtttcttttggccgcggacaaggtcggcagaggtggacccctgcttgggagagctcttctcgctgtgctgacacccgcccctaacagtcacccaccccggggaaataatggggctcggaggcctcctcccagccagtgtccagcctaagcacatcggctcccgcagttcagaaaggtcccgaggcccgagtcaccatttccggctcagacctcgaccctgaacgtggctgcccactgccacgcccactacgccccagtggctcgccccaggggacgaggggcaagaagcggcctccgagggcagcggccgaaggccattcggtccctggctcttcccagctcgcagagacccggaggcgctgcccggccgcctgcccctcttcagatcccccagcaccggaggagcagcgaggggggtgcgtccaggccggctttcgggtcggcttaggcgaatccagctctcttttgcccctcccagaaggcccagccccgtccgggcggtgttcgggcggcgccgggccgggccccccgccgccccaggctcgctcataggcccggaacaccacagcccgcccagacttggctggcgccgagccgggggtggagccagcgggttcccgccaaaatcgcgtagctggtccttcccccgcgggctacgtcgcgccctcctttttttttcaaacccggagctgcactgggattggtggactgggcactcacgtggttaacggtcgcgggaagccgcggagcccgaacctgagactggacctgaggagacctcagcctcggtgctcgggccgccccgcctctgccggaaagtccgcgccgccgctgccgccaccgtccgcagcccgagcgccccggagccgcaggccgccgccgcgcagagacgccgcggctgcgactaggcgcgcccagccgcacgtggcggacccgcccccaggcccgcagtgtcctggaccccgcaggcctccgctctcctgtcctcggccccgtccccagggccgcgatgagcttcctgagccgacagcagccgccgccaccccgccgcgccggggcggcctgcaccttgcggcagaagctgatcttctcgccctgcagcgactgtgaggaggaggaagaagaggaggaggaggagggcagcggccacagcaccggggaggactcggcctttcaagagcccgactcgccgctgccgcccgcgcggagccccacggagcccgggcccgagcgccgccgctcgcccgggccggcccccggcagccccggcgagctggaggaggacctgttgctgcccggcgcctgcccgggcgcggacgaggcgggcggtggggcggagggcgactcgtgggaggaggagggcttcggctcctcgtcgccggtcaagtcgccggcggccccctacttcctgggtagctctttctcgccggtgcgctgcggcggcccaggagatgcgtcgccgcggggttgcggggcgcgccgggcgggcgaaggccgccgctcgccgcggccggaccacccgggcaccccgccacacaagaccttccgcaagctgcgactcttcgacaccccgcacacgcccaaggtgagagcggcgggcgcgggcacccggcggccggggccgcggcgccggaggggccagcgccgctgcctgggttcggttacagaagcggccggccgctcccccctcgctttcctgcgccgccccccaaagttggcagcccttgtgtttggccctgccccgaggttgtccgttgagattatgtaactgaacaatgggcctcgtctggaacttcatcttacaaaggggccgatcggcccgtccgggtggccaaggatttgccgcccgttgagtccgggccgccccgagcgtgtcagccccgagtgcggcaccgataacgcggttcgcgaggatgctggagggtgccggcccggccacctgacactcccgagccataggatgccttttaaacgcggcgatcgggcctgtaatttgggcggcgcgggcagaaggagtttaaagaaaaataattgtcccgccctgatcgtgtcgtgtcgtgtggcgtggatgggggaaaggtctggggcatgcagggagactacgcttggacttgggagtaaaggctggccttccaagcatttacagtcctacagactcatcctaagtccaggcagtactgaggcctgtttctggacaaggtcttggcccagcatttgtttttatcgtgggtttgcggtgcccagagtttggccggcctccgtgtgattaggaacatcctaccgtagataaggtatcttaaagaaggaggtgttcagcacctgtgttttgaaaggccttcgagtactgcgcagatgaccacttttaaaactgcagattttaaagctgatacttccagagattaagacaagcctcgcatttgtaaggttaacagggaagatgcaccttttaaagtgagtttgttttgttttcaatgtactgtttgtcatcagcctaggcaatctgtgtgctttcgagctgtactgtttattggccgacttgctcaaggcaaaatccctctggaagtgaggggaggagtccagcggaggtggctatggaagccctatctagatgggggaggggagattttatggggctctcggactgctttctatttttggatgggttgaaagaatttgttaacttttagccactagaatgaacttagttttaggcagcatttatattctttttagggttagaggcagattttacttggctatttttttcaagaaaagatagttaatatccagcttcagtcttcctaaattagccacaatttattttgcttgaactctaacaaaggcttgtgtgttgctttcacctacgcattcagccctatgaaaggctcgttgaaggttaggttgagaaggctgactataggacttggatcctaaaaattgtatttgtatttttctttccctagagtttgctctccaaagctcggggaattgattccagctctgttaaactccggggtagttctctcttcatggatacagaaaaatcaggaaaaagggaatttgatgtgcgacagactcctcaagtgaatattaatccttttactccggattctttgttgcttcattcctcaggacagtgtcgtcgtagaaagagaacgtattggaatgagtaagtcgtttatttaacagtttggttctccaaataacctaagattggtttggtatacttatcaaaatttagttcctatttaatggcatggatgtatctgtcagatatattgatagaaaaataacattttttttagttcctgtggtgaagacatggaagccagtgattatgagcttgaagatgaaacaagacctgctaaggtaaatagctttttatttttatttttttgaaatttacttttctgccacttaaagcatgctatgaatatgttaataagcattaacacataaggtagaatggtttttaaatttcacacatagccctatcaccatagcaagaaataactgttttcgtatatttgtattacatatatggaaacactttttattacagagaattacaattactgaaagcaatatgaagtcccggtatacaacagaatttcatgagctagagaaaatcggctctggagaatttggttctgtatttaagtgtgtgaagaggctggatggatgcatttatgccattaagcgatcaaaaaagccattggcgggctctgttgatgagtatgtattaaacattttgtcttttgctcttttgtcccctatggtgttactaacattaaggtttcagctggtcaaacactgaattccatctctaacttttgagaagctgtaatgatttaatcaggtccttttcacttaataccatcagttcttattggacttgttgaataatatgagtctgattttggaacctaacttaaatttcttatttctagtcagcatccatgaattcacagtaaaatggagtttattcttacctgagtcctagggcaagcaacatttcttctttctgataaatctttaatggaatctgcctttggaaaaatctcttacaagtctaaaccccttctctcttaagcaagttgctttttagcataacaatagataccaaaaatttattgtatgaagtttcagataaattaattcagtttaagcttgagtgaaaattatttaccattctattaatctcaaatttcttctaggcagaacgctttgagagaagtatatgctcatgcagtgcttggacagcattctcatgtagttcgatatttctctgcgtgggcagaagatgatcatatgcttatacagaatgaatattgtaatggtgagtgatgtaatggttttcttgtgagcttgagaaaatgaacatcgaggaaatatttatggttatctaaaatcttgctctatttctgtcacttttatcttttataaatttaaagatcagagacctaacataaatttcaagtacaaggttaaaaaccttgtcctttctgaagcaccttgtacatatctcagtagtagaacttcgcatactatttatgtgcttgtcgctccaactgagctttttgacaagactatggcctcgacacatatattttggtgtccgtagtacctagcgtagtgtgtgaagcatatagtattatgaagtgttaagttgaatagattcttcctgtgtctggtctttgatttccatttcatgtgaggtgctgctaaaactgatgtttgttagtcactgagtctctgttgatctaaattcagctgtttctttaagcattctgtagtccggccctactcccacgtatccaacctagtctaccctagaatccactaacgctttattatgttacattcttttagttctctagcttgtcgtctctccctcctctcccctaaggatgaaacaaaacaggcatgtatagattcaagtttggatgtcttgtatagctttcagtttcggtaagtccttcaagggccgacttatgtctctccttttctattaaaaacctttaccaaagtcttggtcagaattctggttcttatggacgtctgtcattattatataccaaatcttttatggattatttctcaacacttttgtagtttataagtgtgatgattgggttttcatactcaagtgtgaaatgtgcctccctcaaaccttgttacgacatcagcacattaccagtctgaaatgaaaaatatctgtagtttgtttctatttctgtatatcttctgtgaatatagacaatttagagtttagtgaacacttgagaggagataacaaaatttatttttgttgattcttattattccttaaataaacaagaccagttatctcataacttgtaaataaataagtggtgtaggtatggattcaggttccccatatttaaaaacagtgaacaaaacagaagtaaaagatccatttttcaaacctgattcctcattatttaataaagttctccacacttgaaagaacttgagtgtctagtatacagccttgctgctagtttttttcacacagctcttgaaatgtttctattcataccatcaaaatatttatgtaactatcacaaccttatggattattctatttcttaaccttcatttttcaggtattgcatttaacctagaacaacttgaccacaatgtcgtctccatttgatatttgttagacaccatctcttttcagtttccttctttctctttctcaccttcttgatgtgaataattctcttaacagaatagttcattagtagtccaggaatgtcaaatatgtagcaacctaccaatacatggttgtgtaaatcagatgattctgagaaaactcacgtgggcctgggagatagggaactgagtgagtagtcttgctaccctctcagattacaaaaaccttgtcctgtaatgttagattataaaataatctattgaaaataagtttttatttatttatttatttatttatttatttatttatttatttttgagacagagccttgctctgtcgcccaggctggagtgcagtggcgcaatctctgctcactgcaacctttgcctccagggttcaagcgattctcctgcctcagccttttgagtagctgggattacagatgcgcgccaccactcccagctaatttttgtatttttagtagagatggggtttcaccatgttggccaggctggtcttgaaccctgacctcgtgatccacctgcctcggcctcttaaagcaatataaaactcttgaagaaaataaatagtcctgcatgaaacaggactgcctctttgtgtggctatttgtcctacttagataaaagaaaatacgactatctggatgcatttgtgatctcttttgtttcctgtgtccaccgttcctctctccacataaagctttgaatataccaatagggctcatcttcacatcttttccacagtttcactggaaaaggattctgatatttatttgtacatgagtaactgattccctttattgtgatttaatttccttattatcttattcatttgcattataagccttttatcttggtttggtgatagattggaattaacctgtataaacaagtgtagaaaaatattgatggatagggaaagagaacctgaaatgtcagaacctgttttgctctcatcacctttcttgcccttctagcaataagagaagaaatgggcacagctatggttgctggacctgctaaaaaagagaattagccatattctttcttagcacatttgatctaggacttagcctatcttgtctgacagcgttattggtttgctcccttctagagcactctttcccctccctcagttcaagatttgtacaagtaaggagaacatacttaagactaagataccgagatgtataatttattttaaaaacacatttgacgttatgttattttcttatttaaattataggacctccttttctgactaatacatcattgaccttcctaattttagtacccagctctgatttttttattcctaagccttaaacaggagatatttaaaacaattcctcattgcctttgagatgaaatacaaactttaaaagtttgaaaaaatataaacaaattaactgattgatttaactaattctataaaagcaggttatggtctcattcatagtaagagtagtataaattataactatactaaaatactgtctttttacctataacatttatagacttgtcaagggtatggggaaacaggtatgctcatgcattgacaatgggcatatatattggtacagccttctctgtggagaagagtgtgtgtgtgtgtgtgtgtgtgtgtgtaaaacacaccatctccatatattacaaatgtgcataccctttaacccagcaatttggcttctaggtgatatactaaatgtacgtgaaattaccaatgtacaaggttatttattaggccatagtatgtaatagcaaaggcttggaaataattttaaaatgtccatcaaatgagggactgataaatgcatttctttctttctttctttttttttttttttttcgggggactgagtctcactctgccaccaggctggagtgcaatggcccgatatcggctcactgcaacctccgcctcccaggttcaagcaattctcctgccttctgagtagctgggattacaggtgcacgccaccacacccagctaatttttgtatttttagtagaaacggggtttcgccatgttggcctgcatggtctcgaactcctgacctcgtgatctacctgcctcggcctcccatagtgctgggattacaggcgtgagccactgtgcccagccaataaatgcatttctactcaattatacaatggaattctataaagacaagaagaaatgggttgtctttgtatattggtatagagtgatctttaagataatgaacatatgctgttatttatgcaaaaagttgaaaagaatacatagacctgagctgggcgtggtggcagtgcctgtagtcccagctgcttgggagtctgaagcagggaatttgaatttgggtttgggaattctaggctgtagtgccgatctatgttgagcatctatgccgatctatgccgatctaagttgagcatcagtatggtgacctctgtggagtggggcaccaccaggttgcctaaagaggggtaaactggcctaagttggaaacagcacaagtcaaaactcctatgctgataagtagtgggatcaagcctgtgaatagccactggattccagctgggcaacatagatagaccctgtctcttataaattaaaaacaaaaacaaacaaaaaaaaagccaacctgataatactggtttactctgagaaagaaacaggtggattgctgaggtgtatgattgagagagagactttacattttattttgtacccatgcaaatgtattacctattgaaaaaacaataaaattttgatttcacaagcaggttgaagggagaaggtcctataaaataacactttcttggttgagattggttggttgagactcatttggtaaagatggaagaaagaaaatatttcagaaagaagaaaatgctaatattttctatctttgttaggtggaagtttagctgatgctataagtgaaaactacagaatcatgagttactttaaagaagcagagttgaaggatctccttttgcaagttggccgaggcttgaggtatattcattcaatgtctttggttcacatggatataaaacctagtaagtattgcagatcttctgacctgtgttctttggggttatagagaataaattacttcattatgacaacattgaaaaaatatatatcttctgttttctcattgttagttttaaaaggccttagatccacttaccaatattgttttatgatttctattcatctcttcccttgttaatccccaaaatttgagataaacttttttgagacagtgtctcattctgtggcccaggccggaatgcagtggcaccatctccgctcactgcaacttccccatcccgtgctcaagcagtcatcccacctcagtcttccgagtagccgggactataggcatgtgccaccatgcccagataaattcatttttattaaaagccagaaatttttgctgcatcttacaggaactacaggtgggatactaatgagggcactaaaaatctgtgtttaaagccccactcttccactaggccagaccatattaaaatttccccagttgactcaagtccttaatagttgatttgttcaaattagtatctacttaaggatcatgcattgcatctggttatatcagtttttctttttcagaacccatcctctgctttgtaaaaataatatacacttatcttgcaagctatccctttttctggatttgactagttgcttcttgtatcatttagcttgttcctttttctcctatatttcctataaattggaagttataactaaggattatggattcaagttaagcatcttaggctagatgaatttagtgaggttttattaatctttggaaacctgttgatttgtgagaatttcagtcattttgtacaactttatgagttatatgctagaatttcatatgcgtatgttaacaagtcactaaagtttcttctttctttttttctttttttgagatggagtctcgctctgttgcccaggctggagtgcagtggcacagtctcagctctctgtaacctctgcctcccacgttcaagcgattctcctgcctccgcctcccgagtagctgggattacaggcatacaccaccatgcccggctaattttttgtatttttagtagagacgggtttcaccatgttggctaagctggtcttgaactattgaccttgtgatctgcccaccatggcctcccaaagtgctgagattacaggcgtaagccaccgtgcccagcatgttttttattttcaaaagacaaaaatatatttggatttaaggcagtaaatgtgaattcttaaggaatagctgtactcatataaagtgttagacaaatataatagacccttataaggtataaaagttgaaaatattaagggatgtgaagtttaaaaatcttcaaatttagaccaggtgcagtggctgacgcctgtaatcccagcactctggcaggccaaggcaggcagatcacgaggcaggagttcgagaccagcctggccaatatgatgaaaccccgtctctactaaaattacaaaaattagccaggtgtagtggtgcgcacctatagtcctagttactcgggaggctgaggcagaagaattgcttgaacccgggaggcggaggttgcagtgagccgagattgcaccattgcactccatcctaggcaacaaagtgagactccgtctcaaaaaaagaaaaaaaaaattcgccgggcgtggtgcctcacgcctgtaatcccagcactttgggaggctgaggcgggtggattgcctaagcttgggagttcaccaccagcctggacaacacggtgaaacctcgtctctactaaaatacaaaaaattagctgggtgtggtggcaggcacctgtagtcccagctactctggaggctgaggcaggagaattgcttgaacccgggaggaggaagttgaagtgagctgagatcgcaccactgcactccagcctgggcgacagagcgagactgtctcaaaaaaaaaaaaaaaaaaccttccaatttacaaataccatcacaaaataagttgtcctataaagaaagtaaaacgtatagatgactccagtaaatgtaacataaatttaatactaaatatttgtgcgtgtgtgtgcgtgcacgcgcgcgcacacacacacacacacacacacacacacacacacacacacatatatatatatatatatatatatatatatatatatatatatatacttttttttttcttttgagacagggtcttgctctgttgcccaggctggagtgcagtagtgcgatctcggctcactgcaacctctgcctcctgggttcaagcgattctcctgcctcagcctccctagtggctggtattacaggcgtgcaccaccatgcctagttaatttttgtatttttagtagagatggggttttgtcatgctggccatgctggtcttgaacttctgacctcaagtgatccgcccaccttggcctcccaaagtgctgggattacaggtgtgagccaccactcccggccttattttttagagatagtctcactctgttgcccaggctagaatgcagtggtgcaattatagctcactgcagctttgaattcctgggctcaaatgaacctcctgcctcagactcacaagtagctgggactacaggcatgcaccaccattcccagctattttaatttttttctttttctttttgtagagacagggtctcactatcttgcccaggctggtctcgaattccaagtcttaggtaatcctcctacctcagcctttcaaagcactgggattacaggcttgagccaccatacctggccaatactatactgataaaactattaaaatagaatctgccactaaaagctcatgttaattatgatcttacctgaatttgaagaaaaaaggtaatgtgtatacaataggaaatagtgaatcacaaagccatattgcaaggtagatgctatatggtcagccagactcactggctaaatgactcattctgctcacaccagccttatagcgctacattaaaacttgtgctttcacagaatttcacaaattactgatactaccttttttgctgaagggtaatgtgctagaagacaagggcctcatccagtttaaagtgtttaggatcagtgctaggctggaaaatatattcccagaggcccagagtggtggctcatgcctgtaatcccagcactttgggaggctgaagctggaggatcacttgaggccaggagtttgatcagcctggccaacatagtgaaaccccgtctctactaaaaatataaaagttagctagatgtggcatgtgcctgtagtcccagctactcaggaggttgaatgaagcatgagaattgcttgaaccttgttgcagtgagccaagatcatgccactgcactccagcttgggtgacagagcacactgtctcaaaaaaaaacaaaaaaaattcccagcaactataaccctggtttctgtcccctgagatgcttattccatgggtttgggctagaacttgagaatcggcattttaaaaagcattatggatgattctggtatatgatcttgtttatgaactctggttttattattattagtttggcttacataattaactgtttgacaggtaatattttcatatctcgaacctcaatcccaaatgctgcctctgaagaaggagacgaagatgattgggcatccaacaaagttatgtttaaaataggtaagaaaggtaatcagattattaccttcagataaagagaaggctgttttgtttttgctcttcactgtaagtttttcaatacttctaggtgatcttgggcatgtaacaaggatctccagtccacaagttgaagagggcgatagtcgttttcttgcaaatgaagttttacaggaggtaatttttcttctcccttaatcatagtttgctttgtaacacttagcagttgatagaagaatataaattcagatatattaaactttgaagttaactaatagaatggaaataaaatctaaaccgtcatctgagggcatttaataagcaaaaagtcatgaaggcaaagatttataatggagttgtcgtaaaaaatatgttctcatacaccactggtggaactttataatggcatatcctttttggagatcagagtattagtattgcattaatatttaaaaatcatgtacccattgactcataattttcacttctaggagtttttcctatagaactattcatatacaaatacaagttgagaacagtgtaaataagtgtttactaataagagaatgattaagtaaattatggcacatagttattagtatggcctatagtttcaaaagagtgtgacagtatttcttgataaaaattttgaatgaaaatagaataagtagaaaaatataaagtgtaattgtctgatcccattgctctttgtaaatatgtgtatatatatgtttgctttatcacgtatatgtgtatttgtaacttgtcagtgtgtttctacgtgttttgtgtttgcatatgaatgcctagaggtagagggatttcttttgagagttgaattgggctgttgataaagaagaggcatttactcttatctatgtgtttgcatttttcccccaagagtgtgtattactttgtaatttaaaaaataaacatcctcaaatttagcagtttattctctgaataggtcccaaacttaaatgtggtattagacactttgattaagtcctatttttcacctaagtcatctttgaggtgtaatcttgttttattttgaccatgtttacattcctttaaaaaattgttttaattttacagaattatacccatctaccaaaagcagatatttttgcgcttgccctcacagtggtatgtgctgctggtgctgaacctcttccgagaaatggagatcaatggcatgaaatcagacagggtagattacctcggataccacaagtgctttcccaagaatttacagagttgctaaaagtgagcattttatatatgaagccctttattgacatggttctatattttattaaatgcatgtctttaccttcattttacttttctttttaaggttatgattcatccagatccagagagaagaccttcagcaatggcactggtaaagcattcagtattgctgtccgcttctagaaagagtgcagaacaattacgaatagaattgaatgccgaaaagttcaaaaattcacttttacaaaagtaagtgagggttttatgttttctttttgctttttcattcactttaattctcaaattttaatgagagatgatttaagctttctgtcaacaaaggatgtagtggttttttgtgttttttgttttttgagacagggtctcactgtcatcaggctggagtgcactggtgctatcatgactcattgcaacctccacctcctgggctcaagctatcctcccgtgtcagcctcctgagtagctgagccacagatgcatgccacaacacccagctaatttttatattttttgtagagatggggtttttgccatgttgcccaggctggtcttgaactcctgggctcaaaccatccacctgtcttggcctcccaaagtgctgggattataggagtgagccacctcacccggctccagtagttcgatatgttgttatacggtgaaagcttggggacttctgccatgaattagtatttggcctattaaatttgtgttgtttctaaactttcaaattacgaactttaaaaatgttgagactaacatatatttgcaagtggtgatagtccccaagccataaatggtagtaaaagctaagcgagcctataccaatcttttcttcccagactctcaccaaaagttaacgttgtccttgaaacattctgttcttattttatgaaaggatgaaattaatgtcaatttggttaggagatgattctcatatatatgtttttaatttctggctaaatctttatatactgaatgaagattctcatattggacttaatgacttgatattttcaaaaagctggttgcaatggtaaaggttattaaaaagagaatattggagaatattaagttaccacagatcacatttctaattcttttgatttattgcagccattttgcttttaacctaataaaactgacttgaaaaggttatgttaacaattaatattaacatttaatatttaaattataagaattgtatattaagaggtttacttgccactagtttgatatccatcatagttcatacaaataggaaataaagtgttcctttcatctctcttatgtaaggatagattcgcaatataaattggagtttttgaaattattatttatttttaattttttttttattggggataggtttgtctggaaattgtttattattatttatttaaaaagatggggtcttgctctgtcacccaggctggagtgcagtggcactatcatagctcactgcagcctcaaactcctgggcccaagcgatcctccagcctcagcttcccgagtagctgagactacaggtgtgagtcaccacatccagctcaaattattttataagaaccaaagtcattactagcatctttactacttgttttcaagtatgtgtgatactgtaattcaaaaagcataaaataaaataatttcataaatttaagttgttttaatagaagcttcagtttcctgttttatttttcaattacatcttagaataatgatggcatgcaaatatctcccaatcgacaatatagtttgtgttagtttcttagaatctcttcctaggaataataccttgttttctatttttatgtcagagaactcaagaaagcacagatggcaaaagctgcagctgaggaaagagcactcttcactgaccggatggccactaggtccaccacccagagtaatagaacatctcgacttattggaaagaaaatgaaccgctctgtcagccttactatatactgagctactcctttcccacctccccctgaacactgtgacaagaggaagctaggttgaaatcactgatagaatccagtttgcaattactttctcgattggtgtcagtagttttactgattaggacttttattgtgaattacagttgaaagctgtattttgatgattgctatgtcaggctttcatctaatcttaccagtctgtcttctgtaggatgtgtcactgttggatgttacaccagcctttccagggttaaccactgtggtggtgtgctgcttatagtttgctgttgcattgtaataaaaggtgtctttccctgtagtgacctgtaaaaagtactcaagggctttattacagacataccctccctttgaaaagggacatgctaaaagactcattactactcagccttcaatgtacctgtgtgtccatcttatatttcttttttttttaattgtgaattagacttgtatatcccactgggagcactttgtaggcattgcatgaaccatgggatgatgattctgtggaggtattgccttgtgaatttgctgctattttagttttgtctttgctgtaaacttgtagcattaaacaatcattgttgttaataggtcttctttttgaaacaattatgtgaaatgtatagctgcttttgatgaaaagcagctatttgcctttttttttttttcctttgaactttgaagctagtgcattggaaaaatgcaccctttccctcctttggaatgctgtattaatgtagtataataattactggttttgtaacttgttctggtaatgtccttcccggactctttttaaatgtctccccctaagttttatacttgattgtattattagtctgtttttaaatgttttgcccggtttttctcttcaatatttgtgtatataaaccgatcttcgtgatactgtacatagctgtttgaaatgccagaatgacttctgacattccaagtttttcacaaaatatattttatctgtgattagccatttgactaataatactggctaacagatgttgaaaaaaattgtctgtttgttttctcattaattttggtctaaaacatgtttgcacttgtctttgacttgtgttttattaacattgattggcatattaaaagtcactctgagctt

SEQ ID NO: 38101 - DNA, 38694 bp, Homo sapiens; identical to SEQ ID NO: 36951

SEQ ID NO: 38102 - DNA, 445 bp, Homo sapiens; identical to SEQ ID NO: 37407

SEQ ID NO: 38103 - DNA, 2333 bp, Homo sapiens
ttccttcctagtcgcggggagtctgagaaagcgcacctgttccgcgaccgtcacgcacccctcctccgcctgccgcgatgtaccgctacctggccaaagcgctgctgccgtcccgggccgggcccgctgccctgggctccgcggccaaccactcggccgcgttgctgggccggggccgcggacagcccgccgccgcctcgcagccggggctcgcattggccgcccggcgccactacagcgagttggtggccgaccgcgaggacgaccccaacttcttcaagatggtggagggcttcttcgatcgcggcgccagcatcgtggaggacaagttggtgaaggacctgaggacccaggaaagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactataccgaaaatgaattggaaaagatcacaaggaggttcaccatggagctagcaaagaagggctttattggtcctggcgttgatgtgcctgctccagacatgaacacaggtgagcgggagatgtcctggattgctgatacctatgccagcaccatagggcactatgatattaatgcacacgcctgtgttactggtaaacccatcagccaagggggaatccatggacgcatctctgctactggccgtggtgtcttccatgggattgaaaacttcatcaatgaagcttcttacatgagcattttaggaatgacaccagggtttagagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggtcgactgtgacatactgatcccagctgccactgagaagcagttgaccaaatccaacgcacccagagtcaaagccaagatcattgctgaaggtgccaatgggccaacaactccagaagctgataagatcttcctggagagaaacattttggttattccagatctctacttgaatgctggaggagtgacagtatcttactttgagtggctgaagaatctaaatcatgtcagctatggccgtttgaccttcaaatatgaaagggattctaactaccacttgctcctgtctgttcaagagagtttagaaagaaaatttggaaagcatggtggaactattcccattgtacccacggcagagttccaagacagtatatcgggtgcatctgagaaagacattgtgcactctgccttggcatacacaatggagcgttctgccaggcaaattatgcacacagccatgaagtataacctgggattggacctgagaacagctgcctatgtcaatgccattgaaaaagtcttcaaagtgtacagtgaagctggtgtgaccttcacatagatggatcatggctgacttcctcactaacctcttcacgtgtaacttctgcagacctaccacaagtttacatgtaaccacagaaatccctttctctcctgactcattactaatggataccattctcaacaagtcaatccaaatcagcccgttaaggagaaagaaattaatatacaagctgagtgtgaaagtagaaatcacctacaccagagagctattttggtattttgcctttaaataaaaagcctcctccatatggctgtgcagccttgctctgtggcttttcccagcacaatcagtgctagtgctggggaagggacagtcaagagcagtcagttgcttacttattttgctctggatgagtctgggacacgctgtaactttaacacatttaagaagaaggtgtgtggccttttcagaaggtggcatggtcctcaagtgagttcttagtattttatatcagcaaaataactcaattttgcagattgcaaacaaatataaaagctgtttctgtttatgaattttattcttttagaatagaataagtacatgctgctgtaataaaattgcctttaatcactt

SEQ ID NO: 38104 - DNA, 114923 bp, Homo sapiens; identical to SEQ ID NO: 37326

SEQ ID NO: 38105 - DNA, 2312 bp, Homo sapiens
atcgtgtacttcactgctacattcccctacgtggtcctggtcgtgctgcttgtgcttggagtgctgctgcctggcgccctggacagcatcatttactatctcaagcctgactggtcaaagctggggtcccctcaggtgaggtggaggtggggaggctgcagcagggtgttgtgggggagccctgcaggcccctcatgcctgcactctccagccctcctctaggtatggatagatgtggggacccagattttcttttcttatgccattggcctgggggccctcacagccctgggcagctacaaccgcttcaacaacaactgctacaagtaagcactgctgccctgccacccgtgccctgtcccgccctgccctgcccagcagcctaacccatccactctggcccctccacccctccgggacgccatcatcctggctgtcatcaacagtgggaccagcttctttgctggcttcgtggtcttctccatcctgggcttcatggctgcagagcagggcatgcacatctccaaggtggcagagtcaggtagggccctacccccagccccgcctccagagcagcaactgccacccagatgcatgatgtacaagaacacgcaatagaaatgctgaaaagtgatgaggattcaaacagaacttctcagattgtgggcctgtgggggcaggtcctgggatttttcaatgttgacagagacaggacctcccagcccctgctgcatgacccagggttgacagcacctcagaggcaggcgtgggcatgggcgtgagtgttgcaggcagggctcagggtgagcgcagggcacgacatcggctgcaaggtctagagcctgcacctttcccacagggccgggcctggccttcatcgcctacccacaggctgtcacactgatgccagtggccccactctgggctgccctgttcttcttcatgctgttgctgcttggtctcgacaaccagatttgcatggggctctgggacagggagccaggagaggggcggagtgagggctgcgggcaaggaaaggggtggagggtggtgcggggctcggcctgagctagcctggccacagtttgtaggtgtggagggcttcatcaccggcctcctcaacctcctcccagcctcctactacttctgtttccaaagggagatctctgtggccctctgttgtgccctccgctttgtcattgatctctccatggtgactgatgtgagtggggtggggggtctgcctgtgacttctggtggccgtctgccatcctccctgactgggctctgtcccccagggtgggatgtatgtcttccagctgtttgactactactcagccagcggcaccaccctgctctggcaggccttttgggagtgcgtggtggtggcctgggtgtatggtaggtcatggctgagggctgggctggggcatggtggtggggaaggcaggtctccagcttggccctcccgcctcgccttgccacaggagctgaccgcttcacggacgacattgcctgtatgatcgggtaccgaccttgcccctggatgaaatggtgctggtccttcttcaccccgctggtttgcatggtaagggctgggggaggtggggcggggtggggggggcggggggggtgggggccccattaaccacggcattctggtctgtagggcatcttcatcttcaacgttgtgtactacgagccgctggtctacaacaacaccaacgtgtacccgtggtggggtgaggccatgggctgggccttcgtgctgtcctccatgctgtgcatgccactgcacctcctgggctgcctcctcagggccaagggcaccatggctgaggtaaggctccctcccggcctgccctcccctcccctgctatgaacattcaacccagcctgcttcctagccaaggagtggccctgactagggtggcaggcagcaggagctggagagaggcagaggaagtcaccgtggggatgagcaggtgactctgggggcttcaacatgtcctctcctgcagtgctggaagcacctgacccagcccatctggggcctccaccacttggagtaccgagctcaggatgcagatgtcaggggcctgaccaccctgaccccagtgtccgagagcagcaaggtcgtcgtggtggagagtgtcatgggacagctcagctcacatcaccagctcacctctggtagccatagcagcccctgcttcatccccaccccacccctccagggggcctgcctttccctgacgcttttggggtctgcctgggagaggaggggagaaagcaccatgagtgctcactaa

SEQ ID NO: 38106 - DNA, 7667 bp, Homo sapiens
aagtccgggcagcggttggcccctgggcacgcggggtcggggccgcccctggtccaccgctgctgctcggtggctgggccgtccgcctccacccctctcgcagtcatgtgcctggcagggtgaggggcgggggccggcgatgcccgcgaggctgccccccagactcctgggctggaaggagcgattggccgccgaggtgggaaagcaggcctgcgccttggggtctcctcgaggtaaggagccctggctgcccctgcgggtcgggcacacaagcggcacattgtgtgggccccccacgtgtgcacacacacgaacacacacacacacaatgggccactctgttcctctccctgccctcccctcccctcgcagccctcccgctcctcccctctggcccggggctggaacactgggtacctgagccaggcttgggaagcctgtggcctggcccgcctggcgccgccactggaaacactgcatgcacgtcccatgcccgcccgcctgtctgggcccagcttagcaagagcgatgggcacgcgtgtgtcctgtgactacaaaacagcactggggtttctggaagccgaagtgacccagtgatgggtgggaaacagaggtccagagcaaaggcctttgcccaaagttaggagaaggatgctgggacctggagtcaggcaagttgcagccaagctcggcctctgagtagtggagcgagcccagccagggcaagggtaggaggcccagagaggagaagggggtagtggcacccagctctccctgcccttttgccacccccaccccagcctgctggccagggcctgtgccatgccctgcctatctcctgtagagcctgactccctgggcttgctaaggccggcctggcccctcttcccgcacctgtatccctctgtccttgcacgtggccatcccaccagcaggggactgtgacccacccgccctctgccttggacctcacacttgcaggcaagcgtccaagtgcaggacagtcgcgctccctgcctttggatgagcccctcaggcctgatcacccagccttggcgcacatgcacacacgcacatgccctcactgtgctgcctgaaacagggaattgcggcactagggacaggctgcgtgtctgagcgtgcgtgtcctccatggccatcaccccaagtgaccgtgggggtggaagccctgtgggcctagcgcctctctgccacccagggaataggacttcaatggcccaggggctactgtagcacctcttcaacacactgaacccagcccctcaagaccctacgtggggcccgagtcagtggccacccctacactgactcacccagtgggaagttgtgatggggcctttggagtctgggctggcccgctgggcctgggcagcctggctgggggccaccctgagtccaccctgtgcctccacccccaggtgtgttccttattccctgcatcctgatagccctggtcggaggaatccccattttcttcttggagatctcgctgggccagttcatgaaggccggcagcatcaatgtctggaacatctgtcccttgttcaaaggtgagcagcccttggccagcctcagggactgcccccttttcccagctggctcccacttgagaaatcttttcctgtcctgagcaccaggcctggggccacgtgatggcatcccagtctcgaggggggagcctggaggagatgttcaggccgcacagtgaatttggggaagcagggactagagggggcataggcagctccacaaggcaaggacaggccaggcatagccgggctggggatgggacctgcccagcacacttggctctctaggtaggtcctactattactgtccccaaggacgctggggcacagacaggtggagcgacgtactgaggttgcccactacgggggcaactgtctccaacactacctcaggctactagaaactccccccctccccaccaccaccaccaccagctgctgaggactggagctactgggtggccaggtggaggcttggacctcctggaaccgccatggtggcagtgggacccacagaaggggccaggtgtgtaaggctggagactcaacagcacttggtcagatggggacaggaggagaggggctcgctctgccttgggtctagggggcggctggaggagaggagagaggctggggagtcagcccagtgttggggctcacacaagggggagtccaggggagtcaggagcaccacaaacaaggctccagaaggacagacggtgggagcactgccagcctgggtggggagataaaggggtggcaggggaggtggccaggaaagaatctacatggcaaggacttcccggccccaggcctgggctatgcctccatggtgatcgtcttctactgcaacacctactacatcatggtgctggcctggggcttctattacctggtcaagtcctttagcaccacgctgccctgggccacatgtggccacacctggaacactcccgactgtgtggagatcttccgccatgaagactgtgccagtgccagcctggccaacctcacttgtgaccagcttgctgaccgccagtcccctgtcatcgagttctgggagtgagtccagcacctctgggccaagcccatcccatcccccaggtctccctcatgttgcctggctccaggggaatggccctgagaggggaccagggtgtttcttggcagtccctcctggaccctgcctgcccttgtctgccctcggagagtcctggggccagccccaggggctgcgccaggtcagccttgctcctgggttcggcagcctatcactgtcctggtcactcccgcctgatgggggagctggggctgcatgtggggtgggatgggagtggcctcccaaaggccaggggctcgtgggctccaggcccagcccagatggacaagagggcccactgaaccctgggctgtgggagagaagggagccacgactcctgggggtggaccctgtggctccatcctctgctggcacaggcctcatgggacctccctccctcccctaggaacaaagtcttgaggctgtctgggggactggaggtgccaggggccctcaactgggaggtgaccctttgtctgctggcctgctgggtgctggtctacttctgtgtctgaaagggggtcaaatccatgggaaaggtaccactagaggcatgcaggggggagggtggctcagccctgggagctggatgtctgtgccaggcacacccgtagcaacgggaggtgaccagacagagtctagccctaaggaagggggaggtactgaaagccaagcaacactccccaccctgcaaatccagggcccagcagcctttgctcctgtggggagaggccccagcaggcactgtcccttccctgtgcccatcacccccaccggtgccctcctgccagtctctgactcttgtgacagtctgctggacctggtctggccatctgttacctgcctatcttgccttggggacacagagcagagtctggccacatcccttgggggctcctggtcaggctggggagtcacctgaacaaagaagacaatgtccagagctgtgggacatggccagctccctgggggacaaggtccccagagcagcatgtgggaagagggggcagacagtgtggcagccgcatcttgcctgcctctgcctggcccagttccactcttcacctgctcagccccgacctctctccagaagaggaggggggcccggccctgatccaatatcccgctccctgcctgggcctcccatgcgtgcactgcccacacactcacacagctctcactccccacatgctccatgcctcctgtccccactgaggagagctcctagaggctcgcccgctccccactgacatgcatccctgcagacaaacgaggcgcccagagagcttccccactgcacttgccagggctgccggggcccagccttgcccctagcttcctctggcgggagctatggctcggaggagaatggggacctctgaacatacctgcccgcaagggggaccggaggtgctcggagtgggcttgtgagggaggtggtgccgcagtccccgctgagcagcctggccccccagatcgtgtacttcactgctacattcccctacgtggtcctggtcgtgctgcttgtgcttggagtgctgctgcctggcgccctggacagcatcatttactatctcaagcctgactggtcaaagctggggtcccctcaggtgaggtggaggtggggaggctgcagcagggtgttgtgggggagccctgcaggcccctcatgcctgcactctccagccctcctctaggtatggatagatgtggggacccagattttcttttcttatgccattggcctgggggccctcacagccctgggcagctacaaccgcttcaacaacaactgctacaagtaagcactgctgccctgccacccgtgccctgtcccgccctgccctgcccagcagcctaacccatccactctggcccctccacccctccaggacgccatcatcctggctgtcatcaacagtgggaccagcttctttgctggcttcgtggtcttctccatcctgggcttcatggctgcagagcagggcatgcacatctccaaggtggcagagtcaggtagggccctacccccagccccgcctccagagcagcaactgccacccagatgcatgatgtacaagaacacgcaatagaaatgctgaaaagtgatgaggattcaaacagaacttctcagattgtgggcctgtgggggcaggtcctgggatttttcaatgttgacagagacaggacctcccagcccctgctgcatgacccagggttgacagcacctcagaggcaggcgtgggcatgggcgtgagtgttgcaggcagggctcagggtgcgcgcagggcacgacatcggctgcaaggtctagagcctgcacctttcccacagggccgggcctggccttcatcgcctacccacaggctgtcacactgatgccagtggccccactctgggctgccctgttcttcttcatgctgttgctgcttggtctcgacaaccagatttgcatggggctctgggacagggagccaggagaggggcggagtgagggctgcgggcaaggaaaggggtggagggtggtgcggggctcggcctgagctagcctggccacagtttgtaggtgtggagggcttcatcaccggcctcctcaacctcctcccagcctcctactacttctgtttccaaagggagatctctgtggccctctgttgtgccctccgctttgtcattgatctctccatggtgactgatgtgagtggggtggggggtctgcctgtgacctctggtggccgtctgccatcctccctgactgggctctgtcccccagggtgggatgtatgtcttccagctgtttgactactactcagccagtggcaccaccctgctctggcaggccttttgggagtgcgtggtggtggtctgggtgtatggtaggtcatggctgagggctgggctggggcatggtggcggggaaggcaggtctccagcttggccctcccgcctcgccttgccacaggagctgaccgcttcacggacgacattgcctgtatgatcgggtaccgaccttgcccctggatgaaatggtgctggtccttcttcaccccgctggtttgcatggtaagggctgggggaggtggggcggggtggggggggcggggcggggtgggggccccattaaccacggcattctggtctgtagggcatcttcatcttcaacgttgtgtactacaagccgctggtctacaaaaacaccaacgtgtacccgtggtggggtgaggccatgggctgggccttcgtgctgtcctccatgctgtgcatgccactgcacctcctgggctgcctcctcagggccaagggcaccatggctgaggtaaggctccctcccggcctgccctcccctcccctgctatgaacattcaacccagcctgcttcctagccaaggagtggccctgactagggtggcaggcagcaggagctggagagaggcagaggaagtcaccgtggggatgagcaggtgactctgggggcttcaacatgtcctctcctgcagtgctggaagcacctgacccagcccatctggggcctccaccacttggagtaccgagctcaggatgcagatgtcaggggcctgaccaccctgaccccagtgtccgagagcagcaaggtcgtcgtggtggagagtgtcatgggacagctcagctcacatcaccagctcacctctggtagccatagcagcccctgcttcatccccaccccacccctccagggggcctgcctttccctgacgcttttggggtctgcctgggagaggaggggagaaagcaccatgagtgctcactaaaacaactttttccatttttaataaaacgccaaaaatatcacaacccaccaaaaatagatgcctctccccctccagtcctagcccagctggtcctaggccccgcctagtgccccacccccacccacagtgctgcactcctcctgcccctgccacgcccaccccctgcccacctctccaggttctgctctgtagcacacccttgggtgacccctcaccccagaagcagcagtggcagcttgggaaatgtgaggaagggaaggagggagagacgggagggaggagagagaggagaagggaggcaagggaggggcagcagaaccaagacaaatatttcagctgggctatacccctctccccatccctgttatagaagcttagagagccagccagcagtggaaccttctggttcctgcgccaatcaccaccaatatcaattgtgtgagcttgggtgcgagtgcacgcgtgcgtgagcacgtagagtatatatagatctctatctcttagcaaaggtgaataccagatgtaaatggtgcctctgggcaaaggaggcttgtattttgcacattttataacaacttgagagaatgagatttctgcttgtatatttctaaaaagaggaaggagcccaaaccatcctctccttaccactcccattcctgtgagccctaccttacccctctgcccctagcctaggagtgtgaatttatagatctaactttcagaggcaaaacaaaagcttcgagctgttgcatgtgcgagtctgttgtgtggatgtgtgtgtgtggtccccagacccagaatggattggaaaagtgcatggtgggggcctcggggctgtccccacgctgtccctttgcccacaggtctgtggggcaagaggctgcaatattccatcctgggtgtctgggctgctaacctggcctgctcaggcttcccaccctgtgccctgggctgggcacacccccgggaagggaccccggacacggctcccacatccaggctcaaggcggatgcacttcctgcacctccagtcttctgtgtagcggctttaacccacgtatgtctgtcacgtccagtcccgagacggctgagtgaccccaagaaaggcttccctgacacccggacagaggctggagggctggggctgggtgagggtggtgggcctgcggggacattcttactgtgctaaaaagccactgcaaacatagcaataaaaacctgtcattttcc

SEQ ID NO: 38107 - DNA, 24753 bp, Homo sapiens; identical to SEQ ID NO: 36710

SEQ ID NO: 38108 - DNA, 9294 bp, Homo sapiens
atgtctttttctcaatgcagtgagttatagattctctagttttctccctagggatgggaagggggcattgacgcaagcctggagaggagcccggggagcagggtcatgaagttttttcttcagtgaaggaggaatacaatcaagggttttgtattcagaatgttgtgcaatattttggaataggacattggtgtgtttagagattttagtttaaaaacaaaacaaaaagattgatcaaatctgtacagtttctattgttccagattttttaaagtttgtattaaaagcatgatacataataaaaataaataaataaataaaactaaaaagtaaaatgaaattcttcatctatgttaatggatttgccaccttctttgccatagactggaatgacatcagctacctgagaccaaaataaaagtgtgggttgcaaaccctggcacctacctttttagattccgcagcctgcagtagggacttagcctgtctgaacctcagcttccttctttcttcttctttttttttgagacgaagtctcgctctgtcacccaggctggagtgcagtggtgcgatctcagctcactgcaaccctcgcctcccaggttcaagccattctcccgcctcagccttccaagtagctggaagtgcatgccaccatgctcggctaatttttgtatttttagtagagacgggggtttcgccatattggccaggctggtctcgaactcctgacctcaggtgatccacccgcctcggcctccctaagcgctgggatgacaggtgcccggactcaagttccttctttctaagcctgtgggctcggcctcatcccctgagcaagaaaaaagtcccacccctgagttactggaagcgcccaccgccatgcactgaggctgtagtgggcggggctcggggcagcagcccggcgctcctcgggcccccaggggtcagcgccctgcggacctagcgtgtgcagacgcttagccttctgggagttgtagtttcgatgacccaggctttgcaagctttagtcgcggtgccggcgagcgcgcagcgccccctgggagtcgtagttcctaagaaccaggcgggcccgatgcgcaggcgcagtccaccccggcctggtgcgcgggctcctccgcagcagcagaagtcttgaccttagctcgtctaaggaaggaggcaccagggtctgcgttggcccaggaggacccgagactgagtagaagcggagccgactgcaccaggctaggagggggccggccagcgcgttcgaaggtgataccgggaggcgagagcaacggtgtgtagtgtgcgcgtgttcctgcaggtgtgtgaccgcgtgtgagcccgtccccgagtgccattgtgtctgcacctgttcacttagcggtgtcagcccgtataggtgtgtgactgcctgtgagcccgtccctgagtaacacagcgtctgcacctggtcactcgacggtaccagcaggtgcaggtgtgtgactgcctgtgagcctgtcactgcatctgcacctgcttactcggcggtgccagcccgtcactgtgtctgtacctgctcacttggcggtgccaggccgtgcaggtgtgtgactggctgtgagcctgtccctgagtgtcacagcgtctgcacctgctcactcgacggtaccagcaggtgcaggtgtgtgactgcctgtgagcccgtccctgagtgtcacagcgtctgcccctgctcacttggcggtgccagcccatcactgtgtctgtacctgctcactcggcggtgccaggccttgcaggtgtgtgactgcctgtgagcccgtccccgagtgtcactgtgtctgcacctgctcactcagtggtgccagcccaggcaggtgactgcaggtaaaggcatgtaacactttatcggtgtgttatgtgctcgttcatgtgaagcggtgtctgcatatcacagcatgtcacatacacgtgtggctgcctttgggcaagtctgaaagttctcctggatgtgaggtgtgtgaccccacgtgtgcatgtctgggtgtgccgccgtgtaggctggctcggcccgtgtgcctgccagcacaatgatgggtgacctggctgtgcgagcctgtagagtgccgtgctgtctgaagtgtgtgcatctgcacatgatggagacgctgcacatgtgggctttggctatgctggagctctatccaccgagtgtgactgcacatgtgtccagccatcccctgtgggtgtgtcccagtaatggccggcctgtgtggagcaggtggcatgtgtgaccttgtgcgtctctgtgcacctcttcacacagggagctacgtgtggggctgggtgtgtgtgtagctacgtgtgcccgggaccctgtgtgcatgtgtgagtgtggctgcaggtgatggcttcccacctgcctccttgcatgggggttaggagggcgactgtgtgtccctggatatgggtttgggtgtctctgcatgtctgtgtgtgtctgggcaggtatgattgtgtatgaccctgtgtgtgtcagagtgtgatgtaatgcatgtgtcttcctgtgatcttgtgatataataagaaatatatgtttaatctttatccccagctcctggtaccagagcccctaaaacccttggaatttcctgagtgacaggggtagaaggagtgtcttctgcaactcttaataagccccctgcaaccacacctgtgtttatgctaatggaggactcctgataggcccccaagtacatttatgctaatggaggactcctgataggcccccaagtacatttatgctaatggaggactcctgataggcccccaagtacatttatgctaatggaggactcctggtaggcccccaagtacatttatgctaatggaggactcctgataggcccccaagtacatttatgctaatggaggactcctgataggcccccaagtacatttatgctaatggaggactcctgataggcccccaagtacatttatgctaatggaggactcctggtaggcccccaagtacatttatgctaatggaggactcctgataggcccccaagtacatttatgctaatggaggactcctgataggcccccaagtacatttatgctaatggaggactcctggtagacccccaagtacatttatgctaatggaggactcctgataggcccccaagtacatttatgctaatggaggactcctgataggcccccaagtacatttatgctaatggaggactcctggtaggcccccaagtacatttatgctaatggaggactcctgataggcccccaagtacatttatgctaatggaggactcctggtagacccccaagtacatttatgctaatggaggactcctgataggcccctaggatgggctggttgccacgggagctagccctgatgagcattccagccttcagccagcccctacctcctgggaggggagagggctggaagttgagttcatcaccgatggccagtgtcatcacacctatgtcagtcacgcccgtgtcatggaacccccataaccaccctaaacttagggtttgccgagctctggggctgtcgagcacccagagagggcatggtgctctgagctcctccttataccttaccctgtgtgtcttccatctggctgttcctgagttgtatcctttattggaaaccagtaaccgtaaataaagcatgtccctgagttcaatgagctatgtgagcaaatcaccaaacccaaggaggggttgaggcagttttatggttggtagctgcctgtgcctcccagtcagagcagattggagacttggttgttggtgtggagaaagcccacgtgtcagaagtgctgggagtagacagctttcttctactgcccccaagcaagcctgtgtctccccttgggctcctttgtgtgtgcacaacacccaggtttacccaaccccgctgtgaacccacctgccctccccctacacacgaggtgggtacccctgcacactccggggatgccggtggacgtggcacctgagccgacccagcctggcccccaccagcaagttcttaccagcacacgtgacttcctgtgtgagctgacccccaccccactctaccgcatctcccctgccttgcacctcagttgctctgtccagccccaccccctttacctttcctctgccacccttgtcaccatcctgccctgggacctttgcacttgctgtgttctccaccctgaacacaaacatcatcactccctcagggtctcctcttgtcctcttgctgaggcacacgctgcgggaagagcatgtcaggcagaaagaatagcccacacaaaagccctgtcttgaccaggtgtggttggtggtgcctgcctgtgatccaagccctttgggaggctgaggtgagaggatcacttgagccaggattcccaggctgcagcgagctatgattgcaacactgcactccagcctgagcaacagagcaagaccctgtctcaaaaaaaaaaaaaaaaaaagccctattttaggtcctttggggtgtgacggaatgccatactctggtggcttagaaacagcatttattggccgggcacagtggcacatgcctgtaatcccagcactttgggaggccaaggtgggtggatcatctgaggacaggagtttgagaccagcctgactaatatggtgaaacctcatctctactaaatacaaaaaattagctgaacatggtagcgcatgcctgtaatcccagctatgcaggaggctgaggcaggagaatcgcttgaacccggaaggtgaaggttgcagtgagccaacattgtgccactgcactccagcctgggcaccaagagcgaaactcttatctcaaaaacaaaacaaaacaaacaaacaaaaaaacaaaaaaagaaagaaagaaagaaacagcatttatttccacacagttctaggggctggaagtccaaggtcaaggtgccggcaggtttggtgtctggtgagggctgcttcctagttcatagaccgggccctcttgttgtgtcttcatttggaggaaggggcaagggagccttctgggtcctcttttataagggcaggaatccaacgcctgagggctccagcctcatgtcatcatcacctcccagaggccccacctcctagcaccaccacaaagggttaggatctcacacaggaagtggggaggacaagcttcagacgtagcctgtccagcagcagcaggagtgtacccggaggagccaaaggccgagcactctctgctgtatgcacacagcctactagttggttcagggaatgcctgtgtgtgaggggctgagcccacacataacatgaggccaagcttgctgagagacctgccatgtccctcgggagaaggggaggctggagccctgtttagagagagaaaaccaggcagagcctcagagcaggtagccacttacctgcagccacacagcctggaaaggacctcccagcagtgtgagccccctcctctggggctagccccagcacagtggatccacaggcagctgcctccttccctctctcagcaccaggaggtcatttgtccatctgtcttcccattctgttagaactaaagcatcagaagtcagtggtgagtttctcgccagcgtgcaggtccagtgtacaccaggcaattggtataaatccttcagcatcacagccccactagaagtaactatatgtatggcttctgttatggctttctaaaaaacagtgacttcctgggctcatataaaaacagatccctgctttccactgaaaatgtgcaaagcagacagggtaacctgcaatagcttgagatcaccatctctaacgaccctgggcccacgagccagcatgaacctctgagcctgggagaccctgggcagctccttcactgatggagccctgtagaaggggagcatagtgagttgaatagtgtccccataatgtgaaatctgggatcactgttggctgattctgtctggtgagggctctcttcctggtttacagatggccgccttctccctgtgtcctcacacgcagagaggacagagagagcagagagtaagtgagccccctggtgtctcctcttataaggacgctaatcctattaaggaggatgccctcatgacctaatcatcctccaaaggccccacatcaaacgctgtcacactgggaattaaagtttcaactgatttttccccagaaaagaaaactgtctttccagttatcttagctccagcttacaaaaaaaatcacagattaggtggctgaagcaataaacacttatttcttcacagtgctagaggctgggagtctgagatcagagtgccagcatggtcagaccacactgaggactcacttcctggcttgcagacggctgccttcttgccatgtgttcacctgacagacagcgagctctggtgtcgcttcctcttcttatcaaaacattagtcccagccaagcgcggtggctcacgcctgtaatcccagcactttgggaggccaaggtgggtgggtcacctgaggtcaggagtttgagaccagcctggccaatatggtgaaaccccctctctactaaaaatacaaaaattagccgggcatggtggcgtgcacctgtagtcccaactactcaggaggctgaggcagaagaattgcttgaacccgggaggcggaggttgcagtgagccaagactgtgctccagcctgggcaacagagcaagactccatgtcaaaaaaaaaataaaacagtcccattgtgggggccccaccctcatgaccccctctaaagctaatcacctcccaaaggctccatctccacaaagcatcaccttgggagttagggcttccatgtataaattttgagggggcacaattcagttcacagcaccagattacagggccatattttaagagctgacagattcatgctttttttttctttttcagggatcttttaaatttgtttttagttccattaagtcagtgattcccaactgggggcaattttgtccccaggggaggggacacctggcagtgtctggagactttttaaagaaaattcagacagggtctcacactgtcacccaggctagagtgcagtagtgtgatcactactcactgcagcttcaaccttctgagctcagctgatcctcttgcctcagcctcctgagtagctgggaccacgggtgcacaacatcatgcctggctaattttttttttcatttgtagaaatgagatcttgctgtgttgcccaggcagcagacagtttgctggtctcaaactcctgggctcaagcaaccacctgccttggcctcccaaagtgctgggattgcaggcatgagccaccacgtccggcctggagacatttttcattgttacaactcaggggttgaggggtagtgtccctggcagccagtgtggagagaccagggacgctgctcaacatctcacaacacacaggatgggtcccaccacaccaaattattggacccaaaatgtcattggcacagaggtccagggaccccatgctaagttcttaccagttcagctgttagccatttttccagctcaggacaagtggcaacatttaatttttttttctatctttttcttttcagacccagagaaaagatgtgagatcaagacagcagcccagggatcgaggatggagggactcttgagcgtcgccctccagggcgcagagttggaaggaaactggaaacacgagggccaggttgaggacctgcaggaaaaccaggaaagctgtccagagccagaggccgtggcctgcaagggagaccctgctggggacagcatgcaggaacgcgatgaattcagccgaatcccaagaaccatatcgagccctgctgctacccaagccagtgtccccgacgacagcagttcccggaggtgcagcgcgcctggggagagcccgaaggagaggcatcctgacagccgccagcgggagagaggtggaggccccaagaagccgtggaaatgcggggactgcgggaaggccttcagctactgttcagcgttcatcttacaccagagaatccacaccggggagaagccatttgcgtgccccgagtgcggcaaggccttcagccagagcgtgcacctgaccctgcaccagcgcacgcacacgggcgagaagccctacgcctgccacgagtgcggcaaggccttcagccagggctcgtacctggcgtcccactggcgcacgcacacgggcgagaagccgcaccgctgcgccgactgcggcaaggccttcacgcgcgtcacgcacctgacccagcaccggcgcgtgcacacgggcgagcggccctacgcgtgcgcccagtgcgccaaggcgttccgcaaccgctcgtccctgatagagcaccagcgcatccacaccggtgagaagccctacgagtgctccgcgtgcgccaaggccttccgcttctcctcagcgctcatccgccaccagcgcatccacacggaggagaagccctaccgctgcggccagtgcgccaaggccttcgcgcagatcgcgcacctgacccagcaccggcgcgtgcacacgggcgagaagccctacacgtgccaggactgcggcgcgctcttcagccagagcgcctctctggccgagcaccggcgcatccacacaggcgagaagccctacgcgtgcggccagtgcgccaaggccttcacccaggtgtcgcacctgacgcagcaccagcgcacgcacaccggagagcggccttacccctgccacgactgcggcaagcgcttcagcaaccgctcccacctcctccagcaccgcctcgtgcacaccggtgagcggccctacaggtgcctgcaatgcggggccgccttcagccacgtgtcctcgcttatagagcaccagaagatccacaccggagagcggccctacaagtgcggcgagtgcggcaaagctttcagccagggctcctcgctcgccctgcaccagcgcacgcacacgggcgagcggccctacacctgccccgagtgcggcaaggccttcagcaaccgctcctacctgatccagcaccacatcgtgcacaccggggagaagccctacgagtgcagcggctgcgggaaggccttcagcttctcctccgcgctcatccgacaccagaggacgcatgcagacagttcgggacgcctttgcccagctcccacgcctgactcaacacctgggctctcacagggaggagaaacctgtcaacaggggtgccctggcagaaacccgcgtggaccagcagaagattaa

SEQ ID NO: 38109 - DNA, 6093 bp, Homo sapiens
gtacgccgattccatatgggcgccggcgcggagcgccgcggggcagcgcggggtcgccatggctgagctgcagcagctccgggtgcaggaggcggtggagtccatggtgaagagtctggaaagagagaacatccggaagatgcaggtagcggggctggggccgaaccaggacccccttctcagcgggtgggttccgggcccttccctcagccaccacgcgacgccttgcactgcagccgcgtccccgcagaccgggtgtgggcggccctggggtcgccggggcggcctcggacaggacttcggaagctttggcggatcggatgaaatccgtgtgcccttgccgtgcgcgaggctgttttccgccccttccagcccggggcaggagcgtcctcggcggcaggtgggaagcccctggtggcaggcgctcgccccaccaccttcccctcttacgcggccccttccgcaggtgagcggcccgaggcccagcagaggcgctgccaacgtgaaagaccagaaaggcgaggacttccggcctccccgttggccaggtcatgcctgcttctcttgcgcccaacctcgcttcacacagcgcgggtttctacactgttcttctctgagccccgcaatgcctctgtgtgtttcggtcctgcttctctcacggagtatgcgtttcccagatagtgccccttgagtcattgattagtgggtcggctgccctctggtggaatttgtattgctaggttgctgacctctgaaccccatggaagaggctcctggttttcagaatttggcttcgtcagaccaccctaccctcacccactcgggcgaacctctgttcacccaaccatcggtgcaacaggtgccgatgagctagcagcaaggacaccatgaaacactacactagacattgaggataattttccccagtggtggttttaaggtcctggtgtctattctcagggaaggtgaaagcagaaggtggagagagaggtgcaaatatccacgtggccttctaactcctgtagtgctccatagtcatctctgtccccagagactttcctacctaacctctctgccctttctccccagggtctcatgttccggtgcagcgccagctgttgtgaggacagccaggcctccatgaagcaggtgcaccagtgcatcgagcgctgccatgtgcctctggctcaagcccaggctttggtcaccagtgagctggagaagttccaggtgagaaatatcctagacagagcactgtagtccttgatacagacttttgcaggagatgacaagcatttgttcaaaactcttggctttagtgtcttggttctgttaacagttgtgatactgatggccaaccagttttcacagggtttgaaattttggaaaaagtcttggcggtcgagtgccttaagttgaacatcatttcctatagaaatgatgtaggccgagcgcggaggctcatgcctgtaatcccagcactttaggaggctgaggcaggtggatcatgagagcaggagatcaagaccatcctggccaacatggtgaaaccccgtctctactaaaatacaaaaaattagccaggcgtggtggcacgcacctgtagtcccagatactagggaggctgaggcaggggaatctcttgaacccaggaggtgtagttgcagtgagccaagatcgcgccactgcacttcagcctggcaacagagcgagactctgtctcaaaaaaaaagaaatgatgtaatggggagttaccaggggagttcatgaccaagagcccttatgcagtttgttggggaggaggcgtttgtttgttccttttgacataaccaccaaatacagaatgtatactgtgtagtataaagtttcctggctggacgcgtagctcgcgcctgtaatcccaacattttgggaggccgaggcgggtggatcacgaggtcaggagtttgagaccgtcctggccaacatggtgaaaccccatctctactaaaaatacagaaattatctgggcatggtggcaggtgcctgtaatcccagctactcgggaggctgaggcaggagaatcgcttgaaactggaaggcgcaggttgcagtgagccaagatcgcatgccattgcgctccagcctggacaacaagagcgaaactccgtctcaaaaaaaaataaataatgttcaggcacggtggctcacacctgtaatcccagcactttgggaggccgaggcaggcagatcacgaggtcaggagatccagaccatcctggctaacacagtgaaaccccgtctctactaaaaatacaaaaaattggccaggtgtggtggtgggcgcctgtagtcccagctactcgggaagctgaggcaggagaatggcgtgaatccgggaggcagagcttgcagtgagccaagatcacgtcactgcactccagcctgggtgacagagcgagactccgtctcaaaaaataaataaaataaaaataaaaaaataaagtttcctaaaacatatattatttttaaaacagcagaatctctagaaaggtaggatagccttgaaaaggtacagattcgaggaacacccttccaccattttgtggacttatacacccacccaggactgcccctagttgctatacccagagggcagcccctctgtcactaaggagcagtcatttatgtgaatcattattactgttgactcactgattcctggctcacaagcccctctgaggttaccaaaagagctccctgtttccctctctggagcaaagagtatccacaacttcattttactcccatcttctaagtatatttttctggaacctgggggaagcaagcctacttccaagccagcctttcatagcctgaggttccatccacatggaaacttatacataatgtgacacatctttacattcttccattcaaaacgcttcaaagttactgccattatgaaggaataacttcttcaagatcatggaaccccaaagggtttctttgtgttctttttgacagctaattttatagatggggtctttgaaaatgtgattcttggattgctctataacttcccttgcattatctttttagtcctctccaagtggactttcactcttcactgggccagaaccactcctgccactcacccccatggggccgaatccgggggtcatttctcagtcttcatcttactctgtctgcatcattgacacagtggatccctctccttcttaaagcactttattcagttggtcaccaggacatctcactctcctggttttctgcctccttccttggcctcctttgctctctcttccccactccagcctctgagcatcagagtgcctggggctgtccttgtttcttttctcctttctgcctacttctctagtctcctctagcctcatagctgtaaatataatctctatgctgacagctcctgcatttatatctgtaggccagagctcactgataaactccacattcacatatccaactaattcctccacatctccatttactttgtttgtctctttcctctcactggaatgtaagttctgtaagggtaagaactttgttttactcattgctatattccctaacattaaaagagtgcctggcacatagtagatgctcaataaatatttgttgaattgaatgttttcctgtagaaagaacagactttaaagaatcagtggctcacacctataatcccagcactttgggaggctgacgcgggtggatcacctgaggttgggagtttgagaccagcctgaccaacatggagaaaccccgtctctactaaaaatacaaaaaaagttagccaggcatggtggcgcatgcctgtaatcctagctactcaggaggctgaggcaggagaatcacttgaacccgggaggtggaggttgtggtgagccgagattgtgccattgcactccagcttaggcaacaagagcgaaactccgtctcaaaaaaaaaaaaagaatcaagatgtttgtacatcttacaataacctctagggacctctcatttcctggaagaatgttctgcccaatttattctgtcattcacctgctttctagtaatagtttgagccctcctggtgccatcttctgtttgagtcaagacagtcttggaaagccaaacacagtggctcacacctctaatcccaacactttgggaagccaaggagggaggatcacttgagcccaggagttcaagaccagcctgggcaacatagggagatcccatctctacaaaaataatttttaagaaagtattagccaagagtggtggcgtgtgcctgtggtcctagctacttgagagcagaggtggaaagatagcgtgagcctgggacgttgaggctgcagtaagccataattgtgccactgcagcgcagcgctccagcctgggcaacagagtgagactctgctcaaaaaaaaaaaaaaaaaaaaaaacttggccaatcacactaccatgtccctttaattgaccaagataatacatattaaacctgtagcacagggcctaacacataatgagcacgcagtaaatggaggccttactctcagctttttctacgttcttccttcttgccacaggaccgcctggcccggtgcaccatgcattgcaacgacaaagccaaagattcaatagatgctgggagtaaggagcttcaggtgaagcagcagctggacagttgtgtgaccaagtgtgtggatgaccacatgcacctcatcccaactatgaccaagaagatgaaggaggctctcttatcaattggaaaataaaagtatttgccagtggccatcagggctgagggcaagaatatattttttataaggaattgggaattttagtcttttaagcaaagtttacgaatgaagaaatgaaggatggccacaagcgtaaggcatatgtcacttgcctctggacactggttattttatgtttcagtccctaaaaaatgaaatggaaaaaagtggtgctaaatcgagtcagagatattacaggagagttttagagcttattatttcctgtggccagtgcttgtcctggcagtaaggctttcccctgtaacaagccagagccctccaaggtaccagactcttcttactacacaggtactaacaggctggcaggttagagttggtggagtctgaggagagatattttctctttgttgccaacatcctgtttaccaaaagtgtcaccccaccatcttccataagctgtgaaacaaaatcaatgaggtcactaacttagaagggaaagaaagttttctgggtctttgttttcttgatttggggtaatttatacaagggcatacaagttgattttaagatgtggaactgggaggtagactagtttggataagaactttgaaatgttccttgtggatccccatttctggtcatcaagatgtggatgtacatttcttaaaattattacatgctgcatctttcagcctggagactgtgcagaaacatgagaggtgatgacacactaattatgggaagcagaattactggctgatggcccctgaggctgtgtgtaacaaaatgacaggacaatcttgcagtaacactttccccttgaagagaagggggttttgattgtgatatatactagtatctaggaatgaacagtaaaagaggagcagttggctacttgattacaacagagtaaatgaagtactggatttgggaaaacctggttttattagaacatatggaatgaaagcctacacctagcattgcctacttagccccctgaattaacagagcccaattgagacaaacccctggcaacaggaaattcaagggagaaaaagtaagcaacttgggctaggatgagctgactcccttagagcaaaggagagacagcccccattaccaaataccatttttgcctggggcttgtgcagctggcagtgttcctgccccagcatggcaccttattgttttgatagcaacttcgttgaattttcaccaacttattacttgaaattataatatagcctgtccgtttgctgtttccaggctgtgatatattttcctagtggtttgactttaaaaataaataaggtttaattttctcccc

SEQ ID NO: 38110 - DNA, 2445 bp, Homo sapiens
gcccgtcagtgctgggaggggcggtggcgacgcacataccagcatcacctccgccaggccgggccccacgccggccgcggattggctccctccaagggcacgcacgcccggggactcgttggcggcgtggaggggcgccggtggccacgttggtgtcaacctccttcgtgaagctcacacctcccccgccccgggaggggtttgcccgccactgtcgctgaatgattgcatcatcgaaagcagaaaaccacttttgcatccttcggcctctggcgtgcctgccatgacgtcatagctctgcggaggtggaagttggggagctttgaggtaactggattcttgatctgagcgcagacgtccttcctaacctcactgcatttggaggacctggagggagggtgggtgaagggcaaggaaagaggcaggatgagagcttggccgcggtggcgtctgaggggcctgaatgtttcaaggccagagcctggcgatcaggtggctcgcttagtcctaaaccagtcatccttctccaggcctcctctgtagaatggaaactctgtacccctgcttgtcttaggacctcatggatcccagggggaccaagagaggagctgagaagacagaggtagctgagcctcggaacaaactacctcgtccagcaccttctctgcccacagaccctgccctctactctgggccctttcctttctaccggcgcccttcggaactgggctgcttctccctggatgctcaacgccagtaccatggagatgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggtgagcaaagcgtggtaggcagtatatctggagacccgtacctaccctctaaaattaggagagccaaagccggggtgagaatcagtccttagaagaaacaagactattcttcgaggggagcatctcactaatgcttgtgtcagaccttcagcctgtaactcctgcctctcaggggtccaggctggctggcagaggccatagtgacgtggcgggggcacctgacaaaactgctgacgacaccgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcaggtgagttgcccctgcttcatagcccccttccccttcccagaggttgagagccccccacgcctgctgctgcttctctccttgtgcagacaaacctggaagctccccagacccctctggggaggttaacaccaacgtggccttctgctctgtgctacgcagccgcctgggaagccaccctctgctcttctcaggggaggtagactgcacagacccccaagccccatccacacagcccccaacctgctatgtggagctcaagacctccaaggagatgcacagccctggccaatggaggagtttctacaggttcaggatcggggtgggcagggcgagagcttaggcttgaaggctgggaaagggacttggggaggagggtgaaggcagaatggagggtgcacgaggggtcccactgatcccttgcttttcctgtcagacacaagctcctgaaatggtgggctcagtcattcctcccaggggtcccgaatgttgttgctggcttccgtaacccagacggttttgtctcttccctcaagacctttcctaccatgaagatgtttgaatatgtcagggtaagggaacgatgttgcagctcccacccgtatccccaaacaccaagaccacaggtctagcatccagggcaacagcctgccttctctcctcccaccacccccactgcccatcttctgcctcctcctctgcctgctccagaatgaccgtgacggctggaatccctctgtgtgcatgaacttctgtgccgccttccttagctttgcccagagcacggttgtccaggatgaccccaggtgaggcattcagctctgtccctcccctctggatcccaggatccagcctctggccctcaactgatgcctccatctgccccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaagaggtt

SEQ ID NO: 38111 - DNA, 24311 bp, Homo sapiens; identical to SEQ ID NO: 36346

SEQ ID NO: 38112 - DNA, 212143 bp, Homo sapiens; identical to SEQ ID NO: 37374

SEQ ID NO: 38113 - DNA, 177671 bp, Homo sapiens
ctggagccgctgagcccccgctgcggccgggagctgcatgggggagcgccggcagcgcttgggaagatgccccggccggagctgcccctgccggagggctgggaggaggcgcgcgacttcgacggcaaggtctactacatagaccacacgaaccgcaccaccagctggatcgacccgcgggacaggtaggaccctggaaccctcctccgtgcccccacacccccgcctgggcccccacctgcccctggagccgccggccgggactgggagggggcaggggagctctgcgtgcctcttgagctctcttcagttcgccaccccctgctccccccaaccttctggagcgctgctcccgcctcagtgggccaccgagaggaggcgcctgccggggagctggcccaggctgccccaccgccatccccagttggaggacttaggccccagccggcacctgcccggagttttgaccttaagctctagccccgcccgccccctttaggaagagaggtcgggcgggggcgggggttgggggagcgacctagccgggtgaagccgggtcttcccggggaggcttccacccagcgtggggggtgggcggatggggatggggaagtgtccggttagagggggtggtcaagaccccaggattccgtgggagaccactggagagagggcactcggcgcagaggaaggcaacctgaggtgtgctttttgacaggtgccttggaagctgctgagaacagcacaggggcagccagggggccctggaacccgagggtggggaggaagtgaagaagcgggggagggcagatgagggagactggttatccaggaatctggcagcaacttggaagctgttaggatggagatggaggtgagaggcctcccggaaagccttgcccctcgcctctttctcctctctttcttccctgatcggggaagggggcggcgaggctcctcagccctgcaccagcgggacctgaccttggtgggtaccaggccgctgtaggttgagataatgtgcagaggcagatggagcctgagatagctcggtgtggctcttacctctccagactttctcctggttgtttggcatttctttgctcacatgctgcacacacacacatacattcaccctctccatgtatgtcctagagtccccggaccacgatgttgttgacacggtctgtgggcagagtgtcttggggaatgcggactttaaaccttgtctgtgaccttgggggtcaggtccctgtaaagcaaccaaggtgaatttcttggactcttcatcttgtgtggtgggggtggaggtgtcccagaagtgtatgtagcaagatgtgggtcaaaaaaagaatataagcggaaagaaaatgagagttgagattctcggtagtttctgggagcacttactttcattcattcattcattcgttcattcagcgcttcctggatgcctcctctacactcagcaccatgctgaatgtctcatgaatgtaatctggaaggtaaatatttagtgctagagagcatctcttaggcaagctgcttcaacctctgagcctcagtttccctgtttgtcagatgggggagcccaccatttccctgaatttaaaaagtttgcttggaagggaatattgggatgcttaaaacttggaagggacgtacatcagcgcccaactcccatttgaaacataagagaaaatttgaagcccagaggtgtgatttgctcaagtattttgatttttctgccattctgcgtaccagttcttcaccagctctgaagttctaacctgcaaacttgtcaccctgacacactgcttccccacccttactcgggtcagttgccagctctgctactgtgttggtgaacttggcagcaccttttctcttgtccttttctcagaacagacacaagttcaaacatatgtgacctgccccaatttaggtccctgtagtttacggaggcctgtgtgctgttagcaggtggacgtcctgttggagggaaaggaccgcccctgccaacactgataatcatgcatctggggacttctaatacagcaataggaggcccctctcaacagtaattctttacccttggaaaagggtaagtaagtagcttctatgaagaactgattggctggagcacaatctcccaaattttagtgttacatggaccacctccatgatttttttttgctatatccacctgtgctattgcttacttactccttgactttagatcaactcactttaaaaatatgtgtaccattttcacaaatgggaaactagttatatctattgtcatacaggggaaacaaaaaagataggcaaacaaaaaaaacaaaaaaccagggttagtatattttagctaggtactgtggccagcctaaggccacagcacctcacctgcccagcctttgtttttaagcagattggcaagccatggagaggcggcagaaacatagtggcacttaggtgagcagctcaccttcttcatcttgtgtcattggtttttttgtttgcttttggtttttttgtttatttgtttttgttttttggagacagagtctcgctctgtcgcccaggctggagtccagtggtgcgatcttggctcactgcaagtctgcctcctgggttcaagcgattctcctgcctcaacctcccgagtagctgggactacaggtgcacgccaccacatccagccaattttttgtattttagtagagatggggtttcactgtgttgcccaggctagtcttgaactcctgagctcaggcaatccgcccacctcagcctcccaaagtgctaggattacaggcgtgagccaccacgcttggccttgggtcactggtttataaacttcatctctgtacctccttgtcatcccacctggactggggtggtattgggcccctgaacttggggtcctgagggggtctcatgtcaactctgggggtcactattgtggtccagctttgtatgttttggaaaagtgctaattggaggatagccacttgtggttttctggaatttccctccggcataccccatttttgccttttagttctgtctgtgtggccttgggcaaatcacttgacctctctgaggtttgagtgcttgagaagtgggttggttagatggtcttcaagggcctgccagctcttaaatattatttcaaacccttctgccgctcttacctctccagactccatgagaggagaagggggaacagggatgggctatgagaaaaaggaagaagaaatttaacaaagctgaaaagagccaaacttattccggggggtggtgggttggggagaaaaaattctgccaaggtagttatatccctgcaattaattaatgctgtgagacaaaaaattgcactaaaaatttctactccgtgtgtgtgtgtgtgtgtgtgtgtgtgtgtgtgtgtttatttgccttggatttttccttacctgaatcatggagatgcccacccattcccctgaatttaaaagaagtaagtcaaatggtccttcagtcagaaaagtgatttcttagccaccaaggacaaaatagcgtctctggttaccaaccctaaagaatgtcttggcacattcctccctctggggctgagctgttttgtgtgctggccggccaggagctgctgggggtagggaatccagttttcagcttcccctttcaccagggggttggaagagcagccaagcagccagccttgccaactctctccccttctcacccaggggaagactgggaggccgaaattcctgaggatggttgtcccaacaaccggagagggtccagtgggcagcttgggtcctgcccactgggccaaaggctccagcagcaccacaggcttttcctgagtcaaggccagcctgggaaggtgacaggcccttcgggaatcaggtgctgtggatcaggtctgaacagcaccttggagccgtgctccttttgcggagtaactctgggtgcttttgtgagctctagcgaaggggccagcgtcctgtgtatttcacttcgtggtatgcaaaacaaatgcaccgattgttctcggaggaagaatagatctttggggctggccctcccagagaaggttcctgcagcctgattccttcttgttgtgcgatttgtattcagaccttctcataggaaccacctgggaattctgggcagtttctgggtctgtatggtaagtaccggaggcacacatggctggagaggccatgctgagaggatccagcaacttctcccatgacttgaggatcttttgctaaccctgttatttcagaaataattgatatggtaggaagtcaggtctacagcagtcaaaaagtctaaacctctgtcaggtcacagacccttatgagactgataaaggttcagaactcttcctagagaaaaggtttttgcacataatttcagggacctcctggaccccaggttcataacccctgccatagataagcttggaaattgcttgtcaccatggaaaggcctcctgtttagctaggtagcaaataatgattgggtatttactatattcaggcagtctgctgagagctttacataggttatctctttaaatcctcctaacaaccctgggactaggtacaattattacccacctgaactacccaatgctcagggaggcttggtaaagcccctcaacctttgtggagctgtgatgtgaatactaggcgggctcacaccagaacacacatttctaaccactgcctcattttacttcctgctgagttagctgcagaatcaagaccactgctccagtgcctaaggaatttggccttgggaaatggagccaaaacaggcatgatttcacttacctgtgaccattctggtgtggtcaggtcatgggcacctagagggcaaatgtagataagtgagtctttggctcctggaatcttggatctgccacttgctacctgagttaccttggtaattgacatattgtccctgaaccttgcgtttgccttctaatgaatggaaagatgtccatcaaccatcaagggtagttatgggtgataagtaagtgaaggtaggtagggcagcaagcctgaagtctgacatgcaggggacactgaggaatgccagttcctttaacttttcctagaacgtacctgtgaaacagcagcatcaaatggatgctgcatatctacccaattttgcagctggagtggacctttctgttcgtgaaatccaggcctctcatttcactgatgaaattgagaaccagcctggtgcggtggctcatgcctataatcccagcactttgggaggctgaggcgggcagatcacctgaggtcaggagttcgagaccagcctgaccaatatggagaaaccccatctctactaaaagtacaaaattagccaggcatggcggtgcatgcctgtaatcccggctactcgggaggctgaggcaggagaatcgcttgaatccgggaggtggaggttgtggtgagccaagatcgcgccattgcactccatcctgggcaacaagagcgaaactccatctcaaaaaaaaaaaaaaaaaaaaagaaattgagaaccagagacaagtgacttgcccaaggtcacacagaaaataaatgccaacctcgagtctagtaaaagtttcttttttctctttctcttatataaattttttactaaaagtcagatctatgtccttctcatcaatgataataattcacacatattttatgtgcatggctgcattattctccataatcgtttttgattgtatagaccaggaagttgcattcatcgtgcgtcacaatcatttgtgagttgtgtcataggaatttgctgtatgtcaaatgattacatttccagtgattgcaagtgaattcctatttttataatcaattaaaatggatttagagttattgtcagtctaatgtcatattccaacaagctttgttttattttattttattttattttgagactgagtcttgctcagtcacccaggttggagtgcggtggtgcaatctcagctcattgcaacctctacttcccgggttcaagcaattctcgtgcctcagcctcccgagtagctgggattacaggtgcatgccacctcacccagctaatttttgtatttttagtagagacagggattcaccatgttggccaggctggtctcgaactcctgacctcaagttatccgcctgcctcagcctcccaaagtgttaggattacaggtgtgagccactgtgccccacccaacaaggtttcttaagtgagagttataaccagtctgccagggaagttacccagaacctctttattctccatgctgctgctcttaatgatccactaatacctgtagatgtataataataatacttacatacaagtgattagagggctttttatctttttctgaggcttgagtttaagatctacgtattccatgggagtctaccatgcctgggaacatcctatgtcaattattaagaaagaaatgaggtttaaaaacactaggatagataatagggagaagcaagagatttggtaacccagagaagaataaaataatagtcaataccagcatctattgagtgtttactctctgctgcccactgagctaagcattctattttgtgacctcattttatcttttcaacagccatatggggtaagtacttcagatgagggaactgaaatttagaaaggttaagtaaccggccgggcgcagtggctcactcctgtaatttcagcactttgggaggtcgaggtgggtggatcacctgaggtcaggagttcaagaccagcctggccaacatggtgaaaccacgtctctactaaaaatgcaaaatattagccaggtgtggtggcacgcacctgtaatcccagctactcaggaggctgagacaggagaatcgcttgaacccaggaggcggaggttgcagtgagctgagatcgcgcctctgcactctagcctgggcaacaagggcgaaacgccatctcaaaaaaaaaggtttagtaacttgctcaagatcaccaacaggtgttgcatccaggactggagcccacctagctggattcttgcatctacactcatactagctgtagcctggtctggctctgtcctggcttattaatccatctcagggccccagagtgccctgttgacagctgggcttgagagttaccatttattcttaaaatgggtgaacctgatgtggatctcagggagagactttgctaaggagccttaaccagagaagccagtgagatcctcatggcagcttaggagactgtttggcataaactccaccttctgggagcagctggctaaccagagctttggggatgggagaagagagagagatggaggcagagggactctttgaaggatgcagtgtgtacaaggagttcacagtcctttccaagtcgcttgggtaaatgctcccaacagccagggaatgagtagccaaggccgttcctctctgtcgccatccctccccctcccggggagagggcttatccaaactgacccaattttccaattccctggggtcccagattgctgtgagaagaacactgcccttttgaagggaagagaatcaggttgccttagttacctggaaggttggcacgccaagttcaggtgcacgtaaggagaaacagggctagaataagtgtgagtcgaaggtggccaccgtcttgctgcacggttccctcagtggcagaagccttgatcaggcttcagtggcacttgcagggaatgccgacctaatgtcaggtggctgtccatgacgtgtatcaggagctctctccagccacatgtggtgctaggtgatgaggctctgcagcctccagttcagcaaggggccctggataagaggaatccacttcacttggagaagtggcctggtgacatccctatcaccagctcctcgctatttgctaagggaagcacctccacttggacagggctgagggctagatctgggcaaaaaactcccgtcttgcctctcccagcatggagatggccagctggctgcacacctttaggtagaacagcaaaggttcagttgctgctgcctcgaatccgtttcagagtgagataaagaaagagaaaactaagaaactggatacagtgacattttgttattagaccttccccagcaggccatttagcctttagttcctgagcagaaaaataataatggggtggcgggaggagggggcaggcgttcactgttgtgtgcggagaatattctctaaagatgcaggatggggaagagggggtggagcagagagtggggaggagggaaagaaaaaggacaagtgtggtgggtcacatgcccattctccccaccccccaccccttgccagttgcctgctcaatgcttctacccatgacatctcactgttgggaagaaatgagatctttcagtttcaaatgtctgccaaagaaaagggacggaggcttaagttctcactcaatggtcagccagaaaaaaaaaaaaaaatgaagctgcatcaagattagggacacctttgttggctttttttttcttctcttgctccattcatcactctctggcagcgaggacaccaggccaactgcagctgctgactttccccagtcggctgcctgctgttgcccaggcctgttttggtagcaacccccacactggcttcctccccgcccagtggtggttacttgttggattcgtccctggggtagcccctgggatccactgacgggtaacagacttggaaggataaaatgtcaagatgcaggcatcaggtggctgctaggatgagatgaccctgggacagccttccagtcctacatctgtcgtggcttttcttggagagtcgggctgtgagcatttcactgtattccaggaatttcttctaagtgcattgtttgtctttgtatcactaacagtgagaacaataactggcacctggtgataatggtgataaataatcatgattgtctttaaagatccttatccattgtctgtcacgtgccaaacactattgctcatcatatttttatggcattttgcaaatgaggaaactgaggccgagagacaagtcaagtgacaagctcatttttccactatggaaaaaaatgtgtatgtgtttgttgttccacccaaacatgggattgcataccacacgattcacgattccctgtagtagataagctctccataaagatcattagaggacactgagtcaagtctggctttgtcactttaaaatagtaagtgggactgggtgcagtggctgacacctgtaattccagcactttgggaggccaaggtgggtggatcacctgaggtcagaagttcaagaccaccctggtcaacatggtgaaacaccatctctactaaatatacaaaaaaattagccaggcgtggtagcaggcgcctgtaatcccagctactcgggaggctgaggcaggagagtcgcttgaacctgggagacggaggttgcagtgagtcgagattgtgctattgcactccagcctgggcaacaagagcaaaacttcgtctcaaaaaaaaaaaaaaaaagtaagtgaccttgaaccagttccttctcagctataaaacaaggataagaatagaacctacctacccctgagagtcatggtgaggatatgacatccaacatagaaagtcttagcgcctatcatgccttcatatgggagccctttccagttaggccaacctaccctcctgtgcattggtaacggtagaggaactaaaacccctgtttcttccttgccaactcaggtctcttcctggcgggccatggctcacctgagccacactgacattagagctcgcaaaccaccttggcagcactcattatatgaatcagtaaactcccctcctcccccagtcttatcaggggcaagcccttctttggaatttctggagtgaagcgactcttgccagtgagctggcaccagggctgtgtgtgaatcagggtaatgaattgcagttgtcatggcagagctaaaaaggctgatgcaggaactggaggtctctggaactcatttgtaactgctttgatatcatgtcccctcactcagtcttcccttttgcgctgtttgagagctgtttgaggacctgctgatttgagcatggtggtgttgcaggaagggcattggcatttatcacgtcccacccagcggggggttggccattcactcagcaggtatttatggagtgcctactgtgctcagactctgttgccagagcggaggatcagagcaaagtccctgctgcaatggggtgtgcacgcgggggatggagactgggaaatagttaaatagataaatcgcattatgactgggggtttgatgttctctagagctcttttaggaaggtggagggacagacctggtgacacctgtcgacagtggtggtgcggacctagatttgaagccgggagaccttgaggcctttagtaggatgttatcaagagcctattgtggtgaggtgggctaattgctgggagtgcaatggtgatacacaatagagtctccaactcgtagaatttactacaaattagtgagaggcacagctagtcaaggagctgtgcaaatatagtagaaataccaggctctctgagtctgtttttcttcctctcctgtttcatctggacacgttcagtcatttaacaaatatttgttggatagtgtacctgtaatatgccaggcattgttttggcactgggggttcagcagggattaaaccaacaaaaatccttgtcctcatggagcttactttcaaatgcagtgtttgtcaaacttgaggaaacatcagaaccacctggaggtcttgttaaatactcagtttgagtcagtggatctggatggggcccaagaatgtgcatttcctgcaggtccccagatgatgatgctggcttgacccaactcataccaaccaactaatacactgactcattgactccttataataacctaggagagggtactcaattatccccgttttgcagacaaggaaactgaagacaaacgaagtaacttcgtcctccctatgctaagagggctaaagaaaatggtctcatgagccaacactgtctacctgcatcactgtgattatgaggaccatatatcatgttcttttgttttgctgaccaaagcctgaccagtagcaaaatcctgtgggtttttcttgttcattaagaaataaggcacaggaggccaggtgtggcagctcacacctataatcctagcactttgggagtctgatacaggaggatagtttgagcccaggagtttgagaccagcctggacaagaaagtgggatctcactttcttgcccatctctacaaacattcaaaaaatgagctgggcatggtggtccacacctatagtcccaactacaccagaggctaaggtgggaggatcgcttgatctcaagaggtcaaggctgcagtgagccatgtttacatcattgcagtccagcctgggtgacagagtgagatcatctcaagaagaaagcaggcaagcaaggggaagcagccaatctaaggggattccagaagaccgaagggacttctctttcattagaatgtatagaatttgtattttcatggccacagcaggatcagaggaaattgccctccctgtttctcagtggaactgagccaggactcccctgcgctgagctgctcgggagaggaagggtccctgggctccttcaccccaggggactttccctacttcaactccaggaagtgcagggaggtggttttgaggaaaagcaaatccctcctctcatggaatcctcacttcagccctctagggaggccttatccaccgctattcccctagaccactgcttcagctttacatacctttgtcacttgctggttctgtgaccttggtcaaagttacttatatctttttgagccttcatttcttcaccggcaaaatgagaataaattagaatccatctcatagagttagtaataatcacattagacatctctcattatattcaagttccactgaccaggcagttctaatggcagccattacagtccccataatatatttgataactttctctatagttacagagttactgctcaattcgtttattttgaggaccagattttttggatgtaaaccacttcttgtttctctctgagcaaaatgtcccctggaaaaactggtcatgcctaagaagatagacttcttcctagtagacaatgacttttgctggacaggaatattaagaagtgtcttaatagctcaaggagtttcaaaacaaatgtaagtggtttatttctattgctgatataaaacaaacatttaccagcagccagtggaggaccttgggtttttcttcagcctcttcactggtcacgaggccctctaaggtttttgccctcgtacaatggttcttcagtgtggctccagaccagtatatcagcttcacctgagaacctgttagaaacacattctcatgtcccatgtcagaccaactgaatcagaaactctgggggtacagctcagcaatctgggttttcatgagctctctgggtaactctgctgcccactcaagtctgtaaaccactggctaagtgcacccagaaagacctgagatattttgttagtggttgaatggcagacgctggccaggattgcagaatcgcctgagcacaggtgcacacagccagttgaaatggtcttaattagcttatgaactttttttttttttttttgaggtggagtctcactctcacccaggttggagtgcaatggtgcgacttcagttcaccgcaacatttgcctcctgggttcaaatgattctcctgcctcggcttcccgagtagctgggattacaggcatgtgccaccatgcccagctaattttgtatttttagtagagacagggtttctccatgttggtcaggctggtctcgaactcccaacctcaggtgatccacccgcctcagcctcccaaatgctggaattacaggcatgagccactgtgcctggcccagtatttttttttttttttttttagtagagatggagttttgccatgttggccagtctggtctcaaactcctgacctcaggtgatctgcctgccttggcctcccaaagtgttgggattacaggcatgagccactgcgcctggccaacttaggaacatttttaatatcattcccaaatccttgctggccactctgaacctccacactcccttctccaggccctcaccatcgcctcacgtcttcttggcattaagattcagcttacaaatgaagtttagaaacaccttccccacctccccagcccaggctccatagcatcctgtgccgtaatagaatggcataatttcctgcgtcttttctattcttggttaatggatagctcagtggctggcatgcagtagaagcacattaagccagggttgaatgctccccgggtccggagttttggattctgtttctggcccttcctcttagcagcaaaccacttaaccttcctgagccctggtttccttagctctgcaatggacgaataaggagtcttgatctcctttctacaaggagatgaggaggtgtctttggagctgggggaacaaaaggaacagttagtggttcccagcttctgctacatattagactcgtcagatcactggaggggacaactaaaaatacccatgcctggcccacccccaaagattctggtttacttggtctgtggtatggcctgagcatggaatttctagaaagtccctagttaattctaggttgcagccagattggagaagcatagctgtaggtaaatatctgccttccttacaaacatttgtagagtttgaatgagattaaatgaaagtaccttgtaaaggggacaagtgccataggaatatgagatattttaaaacctaatatgtatagttttacttggaaaaattgagatgattcaggaagtatttaaaaaatagttgcaggaggtggagaagtaaatatctgggagatggccgggtgcagtggctcacgcctgtaatcccaacactttgggaggctgaggtgggcagatatgtgaggtcaggagttcgagaccagcctggccaacatggtgagaccctgtctctactaaaaatacaaaattgaccaggtgtagtggcacactcctgtaataccagctactcgggaggctgaggcaggggaatcgcttgaacccaggaggcagaggttgcagtgagctgagattgtgccattgcaccccagcttgggctacagagcgagactccatcttaaaaaataaaaataaatatttgggggaatgtcagttaccttgctgtttggtaatttcccctcttctatgcctatcttcttatttttttcctgatgggtgaagaatcaaagatatttgggctccttttgccataatgtgaaaatcttcaactcccactgcagcagtaatgcttttgaataaattgatctaagctgctttattttctatttatttgtttttgagacagagtcttgctctgtggcccaggctggagtgcagtggcacaatctcagctgactgcaacctctgcctcctgggttcaagtacttttcttgcctcaacctcctgagtagctgggattataggcatgcaccaccacacccagctaatttttgtatttttagtagagatggggtttcgccatgttggccaggctggtctggaactcctgacctcaggtgatccacccatcttggcctcccaaagtgctgggattataggcgtaagccaccacgcccagccagtctaagctactttagagttgtaagcctgggggctaggccttcctttcatttgctgaacctggtttggattttatgcacataatctacatcttcgagactccaagaaaatgggttgcagacactaccaccatatagatcgcagcctgtggacaggaactaataattgctaatatttattacaactctaggttgtgccaagctctgggctgtgtgctttgaatgcatcgcccagtttaattctcatagcaaccctatgaggtaagaaccatctccattctgcagatgaggaaattgaagcttagaaagttgaaaacttgcccaaggttgcgtagctaataagtggcagaactgacatgcaaaaccagtctgtctgcccccacagatgcatgttctttaccatcacgtaggtcaggccaggatgtcaaggagagcaaccccgaactagtcctggtgatttagactagagcgtctttcactgctgtgattccttcattggcactttcttccagttgtacagtgtctgtctttgcttggtctttgcttgttctacccttagtttagcagatatccctctctccatgaacaaggtgagtgagctctttttctgagtacatttggtttttcaaaatccctccaaggaatcatttccttgaccaaatgccctcatctgtggtggcgatcaacatctttgattttaccctttttttttttttttttttaaattgagacagagtctcgctctgttgttcaggctggagtgcagtggtgcgatcttggctcactgcaacctccgcctccagggttcaagcgattctcctgcctcagcctccctagtagctgggactacaggtgcctgccaccacacccagctaattttttgtatttttagtagagtcagaagtgggttttcaccatgttagccaggctggtctcgatctcctgacctcgtgatctgcccaccttggcctcccaaagtgctgggattacaggtgtgggccaccatgcccggccaatttcacccttctttttatggactgttctgctcaaggggtctccatctgcttatttggtatgaaaggcttcgtgagaaccaagtttgcctttgactgtttggtgcctgaacggcctgtgggcttggtctgcagcattcctgcttgcccaatagaacatccttcagaaagaatgtgtgtttagggttcactcactagaagtcaagtgggtcttcagtctgagccttgcaagcaggaggtggctttagccgtgcatgggttaccttccacttctgcagcacattggttaaaactgaaaccaaagaaagccatcccttctttgagaactgtgctaggaaaaggcagagcagtgaattgctgtcaccctacatggatcttacagacaaataataaaaacaagcaaaataattacagattaggaaaatcagagcatgctggattggaaaataacaggccttgtcactggctccaaaggtcagaggataaagttagaaagttctgtagtcagaaaaactgagtttgcttttagctttaaataaaatacatctatagtgatgcctcttcaactggagttttcatcattttgcgcaggagttcatggcactttattggcaacaagcaatgtttttttcttgaccttggcagaggagctctcaaggcagtgtcatctgttggccacgtgcatctgaacttctaaagagagtggctcaaatgcaggttccaaggccctaccccagtcagaatctctggaggtggaacccagactccacatttgtaaagagaacctccaagtgattttgatggaatcttcagtttgagaaccactgatcaagggaatagatttgtgccaaattgcaaatcaatgtagagacccagctagaatcccttcagcctcctccacaacctggcccacttcttggtcctcacatcaaaacaatctcttcctttcttcagtctttcatggactttcagttctccagtatgctcaggggctccctctccaagaagaagtcttcaatctgcaaaccccacctggtgcccctttacctgaagaacatagaagagtcccacatccactgcctccactgcccccattcatgcctcagcacctccatccctccttctcccaccccagcctcagagcgaggttccagaagtgtcaccaggggccacacagtggtatcctccttgacctcctgtagcacctagcagtgctcccaactcccttcctttacagggtcatcctcatccagaggaggtggggcattttgcactcttctccctctttgctcttccctaggggtgtcctgtgtccccaagccttcaaccacatcctttgccatgaagcctccggtgcccatttctgggtacctactggacatttctgtgtctagacaagcaccgcaaacaacaaatcgaaaattgaatccagtcctggtctcaaacaactttgcctctggccttttttgccattaccgtgagacggtatctctgtaatgattacaacataggcatggttcccatgcttaaggtccaaagggtgcatagtggaatgtagatcttcctcacacctggtccctacctacccagccccctctccacaggcagcccctatttccagaaacatccatctccattccttcttccttcatctagctgccaagttctgccaccctttcttttgcaggctctgacacctcattccttttctgtttattcctatagaagcttagtggaaaatagacccctctccctctgtcttagaaaatagagacctctccctctgtcttagtagaaaatagacacctctccctctaagtagaacatagagacctctccctctgtcttagtagaacatggagacctctccctctttgctcttccctaggggtgtcctgtgtccccaagccctcaaccacctcctctgccatgaagccacaggtgtctgtttctaggtacccactggacatcatttctgtgtctagacaagcacgacaaactacaacaaatcgaaaactgaatcccattctggtctcaaacaacttcgcctcttgccttttctgccattaccatgagagggtaccagctcagtctaacacaacccagcgctgaccagccctcccccttccctgtccccttggggtgctgggggacacactgctgaccttctcgaagctggtctcacccttatcttctaagcatctcatattttgcctcactttcctcatctgtaagaatgagaatgatagtgtttacttcatcctatttttaagtgtcttaagaagacctttcccctgtaatatttttgtatctctttaattttaatatttcaaacatataggaaaatttcaaaaatagtacaagaaatttccatataccctttacccagatttaccagtttttttgcgttgaccatttaccttatattctcttattctttctctctgaatatattatatataattatttatctaaaccatttaaattgtgtgtgtgtatatatatatatacaccccatttctgtatctctgagtatatataatgtatccaaagatatagaaattgtacatataatgtatatcatttatagatatatataaaatatttatgtacaaacaaacaccatttaagagtaagttggaggccaggcacagagtggctcatgcctgtaaattcagcactttgggaggccaaggtgggaggatagcttgagcccaggggttcaagaccagcctgggcaacatagggagacctctgtctgcacaaaaaataaaagaattagccaggcatagtagtgcatgcctgtggttccatcatcttgtggaatgctgaggtggaaggatcacttggacccagggggtcgaggttgccgtgagccatgattgtgccactgcactccagcctgggtgacagagggagaccctgtctaaaaaaaaagcataacttggagatacgtttctttttactgctaaatacattggtgtgaatttcctaagaaataaggttgttctcttacataaccacactagttcatgcagtttttatgaggattaaactgaataaataaagtaaagcactttgcagagtgcccatcacccttgcaggtgccaataattggtagccatggttgctgagttctcttcattggtccttggcttctagcctacctgggttggtgtcagttcccaagcatgccctacactttgccattcttcctgctggactgcagctcaccagccccacctgtatgcattgactcctcccctcccctcccaggcagcacctagtgcctcctgctccatgggacatctgtcatctgcctccctccctacttccagcaggaaggggtctgcttcaagtcaggccctttctggtcgaaggctacagaggcccatacaagatggctctggaaaaaagcacaggaatctcaggcaaggaatagcggcccctgctgctgggcaggtgcgggctgcaacagggaggtgtgaggaaccgaggcagcagcatctccccacacctccctctatacctacccacctatgtcatggtttcctctgcctcctaaaaccctcatttatgagtcagttctgcctcttactagcgtgtgaccctcggcaagctgcttaatcactttgagcctgttcccttgctttgtaaaaataaggctaagggtaataatagaccaggcacagtggctcacgtctgtaatcccagcactttgggaggccaagacaggtggatcacctgaggtcaggagttcaagaccagcctggccaacatggcaaaaccccatctctactaaaaatgatatacaaaaaattagctgggtgtggtggcaggtgtttgtagttctagctactcaggagactgaggcaggagaattgcttgaacctgggaggcagaggttgcagtaagccgagattgtgccactgcactccagtctaggcaacagagcaagactcagtctaaaaaaaaaaaaaaattacaaaaattagccgggcatggtggcgcacacctgtaatcccagctactcagaaggctgaagcaggagaatctcttgaacctgggaggcagaggttgcagtgagctgagatcgtgccactgcactccagcctgggtgacggagcaagactcagtctaaaaaaaaaaaaatacaaaaattagccaggcattgtggtgcatgcctgtaatcccagctactcagaaggctgaggcaggagaatcacttgaacctgggagacagaggttacagtgaccgagattgcaccattacactctagcctgggtgacagaacgagacgccgtctcaaaaaaaaaaaaaggaacaataaccaagattttattgagtgcaaagcacagttctaactgttttatatttattagctcaactaaccatcataccaaccttctgagaaaggtactaatattgtcgttatttagagatgaagacgtggcggcacagggggattgagtaatttgcccaaggtcgcacagctagaaagtggcaaagccaggattcaagctcaagttgtctggctccagagcttgtggtcttaaactgccatctactttgaagggttgttgtgagaattaagcatggattatcttatttaaggcatttagcagagaagcaaggctcatcataaatgctttaaaatgttaatggttattacagtatcacagcattagtttgcaggtgaccgcaatggacttcatggccccagcctatgcctcctaacccttcagctcagctgctgcaaatcatgagagatgctgagttgaaaatatcacagagccagccttgagctggactatcacttggtacaggagacgtcaggggtcatgtggtgccaaccgcagcagctgcccactcagggtaggtcatgggtgactggtatcctaagtactttttttttttttttttttttttagagtctagctctgttgcccaggctggattgcaatggcatgatctctgcaacctccatctcccagactcaagtaattctcctgtctcagcctctcgagtagctgggactacaggcgtgtgccaccacacctggctaattttgtatttttagtggagacagggtttcgtcatgtttgccaggctggtctcgaagtcctgacctcaagtgattcacccgcctcggcctcacaaagtgcaaggattacaggcatgagccactgtgcccagcctaaggacattctttctcagaactttgaaagtaaattgctctgaatgctcatggcagttcacagggcctggtggtttctgcctcaaacccctgtggcaaactcctgtttgtctgtgtgattcctaccctcttgctacttgaagtgtgggccgtggaccagcacgtcagcattgcctgggagtttattagaaatgcagaatcccagccgggcacagtgctcatgcctgtagtcccagaactttgggaggccgagatgggtgggtcacctgagttcaggagtttgagaccagcctggccaacatggcgaaaccccgtctctactaaaaatacaaaaattagccagacgtggtggcgggcatctgttatcccagctattcaggaggctgaggcaggagaattgcttgaacccaggaggtggaggttgcagtgagccgagattgcaccactgcactccagcctgggtgacagagcgagactgtctcaaaaacgaaaaaaaaaaaaagcagaatcccgggctgcaccccagatcccctgaatcagaatgtgaattttaaccagatccccagaggtacttacgcatgttaacattgagtagcactgactattcaatactacttctgttgtttttctttttttcttttgtggctgcctgtgcctctttctagttcagatttagggcacactacatacttgtggtatcaataaacagtggacttttacaaccagctataaatactatctagagaaaggagcttcgcagcttattcccagagccccatgtgaaataagagattgaagccgggtggggcgatggagctcaattgataggggttcacacctgcagagaaaatgcaaggtcctgaggtctcagtgcatctaccaagaaggtcaggtgccaaaggtcagagcagtctcaggctatgcaggaggtcaccagggctacagaacacgggacagcggatgagggccagccagaggtgggagcactcatggcagggtggtgcctgttggctctaataagcaatgaggtggcaggcacagaggcaggatttcagtcctcagagaacagagggaagaaaaggacaaggaggaactggagtctacaataagtttcccaggcagggagttgagctggcaaagtaagtcacaggctgcctgggagaagtattgatgtgagggggccaggcatggtggctcatgcctgtaatcccagcactttgggaggctgaggcgggtggatcacctgaggttgggagttcgagaccagcctgaccaacatggagaaaccccatctctactaaaaacacaaaattagccaggtgtggtggtgcacacctgtaatcccagctactcaggaggctgaggcaggagaatcacttgaacccaggaggcggaggttgcagtgagccgagattgcgccattggactcaagcctgggcaacaagagtgaaactccatctcaaaaaaagaaaaaaaaaggaaagaaatattgctgtgaggggactagcacaatgatgccttgggccaaggctttggttgggtgagctgggacccctaaacataaaccctggccccagccagggggaacctgagcctggagcagtcctgggaagccagaggtgggctccaggtgtgggactgggtacaggtggggacaaggagccattcacgggctgcagagagagtctgagaggctcgtgaagcaactaacctttcctggcatgagggtggcaggaggtgtggccagattccagagggctttcccatcagggattaggacactgccctcgccaggccctggctcacctgtgcacagcattttatcggaagcacggaccttgccccaacacattcctgagataacactcccccgcccgtctcagaagacactcagtccgttggtgtgagggaggctgctgacaccccccagattcatttccagtttgtttgacgttggcatgtatgtctgtgtaacatgactgaagaacgagtcattagtgagctgtccaaagtccctttgggaacattccaggaaaataaaccaatattccatcaaagccacaaataactttttttttttttttccattccttcaaagcaggctttctcagagtgtggtccacagacttcctgctttagactccccagaggagcttgtaaaatgcagattcctgggccgccaccctaagcctactgaatcagaatcccagtggggcttctgggaactgcatttttatatgctacccagatgattctaatacaccttaatctcgaaaacctctcactctctttgcccctttgcttgatcgttcctttgtgtcaacaccgtgtgcccgctgcgctctgatactacctccctgtgctgccccacctggtgaacttcagctgaagggccacctctccctgggagccttccttgccatctttgtcccatcttgtgtaggggcccactgtgttttctcctaatatgaatctaccacaaagtagtagtttctttctgcctgactgctcccctgaatggggaagcatcctgcccagtctctccaggcccagcagaaagttttgcctataattggtactaagaaaggaatcagtgcaagtgaagggtgctgagcggcaacggaagggctacagagtaggggtgacgaatggtcgcttcccgttaagaagctgtcaccttctgactcctctcctggtgagtctgaactcctaggtcaagtctggggccagagggcgagcatcagacccaagaagaggccaaggctctggctggcaggaggcacagcccacctgtttgggactgcggtgtccctggtgtaagctcagatccctgtctgtatttcagggagactccatagcttgacattcttcctgctacagaaaaacagatgaaagaacagttttccagtcccagggctgaccccaaacccaggacagctagaatgctcaggcctcccccctcttttcaggcaggagaagctgaagaatagaactattggaccatgaaactcccaagagtccttccccctcagcgtttctcagaatttgcgaccacgattttctctgtgaggctcgcaattgctatttgccaaactggtaactgttgacccaacagaaatcaaacaaagataccagcagccccagacaggctgtcttcatcgcatcagtgaagggagagcaggtgcctgggatcgaaaggacattgtccatcacctggctctgaaaaacaaaatgcatttccttattcttaacaagctgagcaccagaaacctgctttaccagtccagggtgcctcctggaagctggctcgcttatctgcatgtatgtgagggctgggggtgtttttgtggggctggctccgggcagggtggctttggaaaggagaggcctgacctagcgagactctagggtcagcccagactgctgtgacctcaggggactcagcccaggaggtccaggtgagggcagcctgccctctacgtctgcagtaggtgaagaaccccttggttacttgaagagaaagaaaggactggctgggttgtaggcagcagggccgagcagctgagggctaagtgcacagcaggccctagcaaatgcttctggaattgaattggtccaaggggagactccagctttagttcaacatgggctgtatccgaatccttctgaaatttgctgggattccatgagggagtcaggtattacaaggttttggcaattactgagtttcttttgtgcttttttctttatgagaatgttgtttctgaacccattccctttctcttcccttctcaccaaattacacttgatttgcctccaggaagaaaatagtacattgttatcatttggtcaagatttcatattcaaaaaagagtaaagtgacaatatagttcaaaaatcttgttagatgctgtggaaacctcacccggcagtagtgatagctgccacgtactgagggattttatagacatttacattttcacttgtcctcaccttccagatgaggcagctgtggcccagagaggttagggaacttaccgaggtcacacagcaagttggcaagagggttggggtttcagtctgggctctctgacttcgcagccaagtgcctgccagtgctgcattgtctcaaggtatttggcgtgttgatgtgacatcactcaccctccttgagttctctgacatttctcagagcgtttgtctgtgtgtcctgatttgagaattagttaagctctcgcactctccggggtgcagtgcctggaattcaggcactggaggaagtcctgcctccttcctggagctcgcagccagatcccacagatcctgctctgttggacagtgaggatgggaggtgtggcccaggggttggcaggatggtagtggggtgcagagtagacagggctgcgatgactctccagacccatgcttcttgtcagttcccaggcactgaacccaggacttcccccaccaaggcatcctgtcctatttcccccattgcctcctgccctcttaggatatacagctattgagaaatgtgaacacagaggccttttcagagagaaagaagtcctgctcctcagtattcccaggatcctagcttactggagagattaaaaggctggattatgtgggaaggagaggcaagtggactgggacagtttagatctaattgcctaatgactcctagaatatgtccttccagatgtcctcattttcattcagagtcactgcctgcctttgtgagaggtcatacagtgttgaatgatgcgttatcagtgtaatgcaatagcccagtgacgtcatgaaaatcctggctttctgagaacacgttcacagataggaatgcagtgctggagagacccgagggtcttggtatactgcacaattcagcttctattgtgtaactcctgggtttattggccctttgttgctgctctctttgataaagtatgattttttttttttaactttctgattagaaatcagtagtttaagcctgctaatcacctctttggcttggcctgcagatcatggaaagtccacaacacttaatctgtttgcaaatgttctcttggttccagaagttcagaaatgttaccagctcccaattttttataagattgtataatttttaccttaattacaataataaaggttctgagatctattacacagataccttttcttagtttactttttaaaaatttatttttaattgtggcaaaatatatgtaatataaaatttaccattttaaccatttccgatgtacagctctgtggtgttaactacattcatattgtgcaaccatcaccaccatccatctttagaacgctcttcatcttgcaaaactgaaactctgaaaacttctactttctgtctctatgaatttgacttctctgactgcctcatataagtgaaatcttagagtatttgtcattttttgtgactggctattttttttttttttttgagatggagtttcgctcttgttgcccaggctggagttcaatggcgtggtctcagctcactgcagcctccacctcctgggttcaagctattctcctgcctcagcctcccaaatagctgggattacaggcacctgctaccacacctggctaatttttgtatctttagtagagataggatttcaccatgttggccaggctggtctcaaacttctaacctcaggtgatctgcccgccttggcctcccaaagtgctgggattacaggcatgagccaccatgcctggcctgtgactggctattttacttagcataatgttctcaaggtttatctatgttgtcggctgtgtcagaatttctttcctttttaaagctgaataatgtttcattgtacgtacatatgtgagatgtatatacatacaatgtgttgcaatatatacacatacatacacacatatacacgacgtcttgttaatcagttcatctgttggtggacacttgggttgcttctgcattttggctcttgtgaacaatgctgctgtgaacatacgtgtataaatatgtgttagccgggcgtggtggctcacgcctctaatcccagcactttgggaggccaaggtgagtggatcacctgacgtcaggagtttgagaccagcctggccaacatggtgaaaccccatctctactaaagatacaaaaattagctggacgtggtggcgggtgcctgtaatcccagctcctcgggaggccgaggcaggagaatcacttgaacccaggaggcagaggttgcagtaagccgagattgcaacactgcactccagcctgggcaacatagacttcatctcaaaaataaataaataaataaatatgtgtttgttgcccctgctttccattctgttaggtacatacccagaaggagaattgctagatcacatggtaatttatctatttttttgagacaaggtctctttctcaggctggagtgcagtggtacgatcttagcttactgcagccgctacttcctggctcaagtgatcctccagcctcagcctcctgagtagttgggaccacaggcgtgagccactgcacccagctcatttttgtacttttagtagagacaaggttttgccacattgctcaggctggtcttgaactcctgagttcaaagcagtccgcccaccttggcctcccatagtgttgggattactggcatgagccactgtgcctggcctggtaattctatttctaatttttcgagaaactgccatctgttttccactattttacattcccactagcagtgcagaagggttccaatttctccacgtcatcatcaacacttattattgttttatttttatttttttaatagtagccaacctaatgggtatgaagtggtatttcattgtggttttggtttgcatttccctagtgatgagtgatgttgagcatttatatatacactttttttttttttttgagatggagttttcttgctctgttgcccaggctggagtgcactagcacgatctcagctcactgcaactgccacctcccagattcaagtgattttcctgcctcagcctcccaagtagctgggattacaggcgcccgccaccatgcctggctaatttttgtatttttagtagagacggagtttcaccatgttggccaggttggtttcaaactcctgacctcaggtgatctgcctggcttggcctccaaaagtgctgggattataggcgttaaccactgaacctggcccatatgctttttaaaaagccaactcctcatgccacttcaaagctagaaaggcagtagagtgtaacattcaaggaactgatcttagaagccaaactcccaggttttaatcctgtctgctctccttactaacttggtgactttgagtcagttacaagacctctctgtgcttcagtttcccgtctgtgaaatgggataagtgacctaatctcatcaggttaccaggataactcagtgaattaatagagataagtcccataacatgtgtaagactctgtgtgtttggtaggtgctgggcatcagtgctgtcagtgaacagagcagaatctgctgccttcatcctcccgggatggctttcttctctgctgaggctttttcaagtagagcaaaggccttgggaggctgaaatgagatggtggctggaactggtgggttttcacaccccaaaggtgggtgtgtcaaggggcagaagaacaggggcagtttctgtccgatgtccctcctggaacttggcatgtctggtttcaagaatgagtgagtgcagaactggcaaccagaagacaggaacaaggcctgggaatggagcggaaaggtagctgctatatatagttccttcagccagtaacgattagagccaatagccatctggatgatgaatggctcctaattgccttaaattacggcagttagctaagggtttctgttgctacatgggttaccgtaggccgctgcaccctgcataactgtcctcaggcctgcgtcccctgagtctcagcacttgggcctccatacagtgccgtatttggtaggacatccccctcatcccagagatacctgggcttttgtgccaccgggattaattccatgagcatcagaaggaccctaagttatagcttccccttttcttcccagagcggatttccaacttggtctgggaagaaccaggttctttttctagaggagatgccatgggagaaagtaatctccatctctgatccttctttaaagcctaacccaatttccttagcgaggcaggaagatcaggtgtactgagggagagaagaacttctgcctttttctgccttcatctggttaacctccttctcagggcccagcttaaaagttagttcctcaagaaatcattctccaactccctgaagggggacaggttcagtatttgccttctctcatagggcaatatcctttttttttttttttttgagacgaagtttcactcttgttgcccaggctggagtgcaatgatgacacgatctcggcccactgcaacctctgcctcctgggttcaagcgattctcctgcctcagcctcccgagtagctgggattacaggcatgtgccaccacgcccggctaattttgtatttttagtagagacagggtttctccatgttggtcaagctggtctcaaactcccgacctcaggtgatccgcctgcctctgcctcccaaagtgctgggattacaggcgtgagccacggtgcccagccggtgatatccttttcttttgaatcaattgttctgttgtaattagttaatacctcgtgttatttctgcataatgtcagctcaggaggtttttcttttctcttttaagcctcttctgttctaggaagcctagaacttttctagagcagcagttcttgaagtgtgatccctggaaatatttgagatcctctcaggagatctgcgaggtcaaagcttcataataatactaagaaattacttgcctttttaactttcaacctcttacaagaatacagtggagttttctgtaggcaacatgacatgtgattttgtaacagattgatgcaaatgcagctcttaggagtcactgtctgctattaaaccatacattacattgaggagacttgcaaaaatgtaaaatataccactcttctcaccaattttgaagggagattggaaaatacaaaaaaaaaaaaaagtttaagaactgctatcctagagaagggttggaaacccttctgggactaggcaggctttgtggaccataccatctctgtcttaactactctgtggaaggaaagcagccatagataatatatcgacaaacaggtgtggctgtgtctcagtagaaaccttatttgcagaaacaggcaatggatagatttgacctgtgggtcatggttctctatccttgctctagactaaaagctttaagagggcaggagccacatttatcttgtaaactgctttatcctcagcacctagcacaaggcctgctacttagtaaatacttgttaattttaatagaaatagtgtttagctgctggtagtagagatcaataataacagtggcttcaagatagatgttatctctttgttacataagagaaaaagaatcaagagacaggtcggtctggaccagggtggtttggtgccacattgtcatcagggacccagattctgtatgcttttctaccccaccattttttgcatgtggtttccatccttaaaatcacttcatagcctaacaatgcttcaaaacaattctcaagaagattaagctgatcggccaataaattaggcatcaaaacaaaactcaacattcttgaaagaaagaaaacaaagttcagatggtcagcaacttcatattgacagtgtccagccaacagtagaaaaggtactcagtttatgaagaaagtcagtcaatagaaacagacctagagatgactttaaaaaatttcttcgtttctttaaaagataattgactgtttagatatgtttaaagatttaaaataagtcagtagagaaatggaactaaaggaaaattctagatgaaaattacaacatctgatgaaaaatttgctagatgagtttaatagtagatcagatgctgtaaaaaaaaataaagactagtgaacatgcagtcagggcaatagaaagtattcaagtgaggctgggtacagtggctcacacctgtaaccccaacactttggaagactgaggttggaggatcccttgaactcaggagttcaagaccagcctgggcaacatggtgagacctcatctccactaaaataaaaaagaaattagccaggcgtggggtatgtgcccatagtcccagttatttgggaagctgaggcaggaggatcacttgagcccaggaggtagaggctgtcgtgagctatgattatgccactgtattccagcctgggcaacagaacgagtgagaccctgtctaaaataaaataaaaagtacccaagctgaagcacagaaggaaaaaaagcttggaaaaaaaaagtcaggactttagcaatttgtgggacattattaatcagtctaagaaatgtgtatttgcattcccataaaaaaggaggtagagagattggaaaagaaaatgtatttgaagacataatggctgaaaaattccaaagttgatgaaaatgatatcacccacagatccaagaagcccaataaatccaggaaaatcatgtggaaaactacacctagacacatcatagtcaaactgctgaaaacaaaagatgagaaaaatcttaaaatcatcagggaataacacacaggagaacaataggaattacatacaggagaacagtaagaatactgcggacttctcatcagagacgatacaaaccaaaacataactgaatgacatctctaaggtgctgaaagggaaaaatactgtcaacttaacaattctgtatccaaccacaagtatccttaaaatgaagataaaatccaaacattttcagataaaataaattgcttagagaaagtatcactagcacagttatacaataagaaatgttaaaggaaatttttcagggccaggtgcagtggcccatgcctgtaatcccagcactttgggaggctgaggcgagcggatcatgacgtcaggagtttgagaccagcctgaccaacatggggaaaccctgtctctactaaaagtacaaaaattagccaggctggtggtgctcacctgcagtcccacctactcaggaggccgaggcaggagaatcgcttgaacctaggaggcagaggttgcagtgagttgagactgtgccgctatactccagcttgggtaacagagcgtgactctgtctcaaaaaaaaaataaataaatttttcaggccaaaggaagatgatatcaggtggaaacttagatctacgtgagaaattaaaagagcaccagaaatagaaaaaactaaaaatttcttcatttctttaaaagatagttgactctttagagcaaacataataatggtgtattgtggatgattttttttttaaaagcagaacagaaaacaagaaacaggtaagacaaatagacaacaaatggcaaattggtagacttaaatccagctatatcaataattcagtaaaagtaaatggactaaacactttaattaaaaagtagaaaaaaagaacaagactcaagtatatagcctgcctgtaacaggttcactttaaatataaatacataggttacaagtaaaaggataggaaggatataccataccaatactaatcaaaagaatattggaatggctgtcagcatggcatgcagagagcttttacaataatagggtgattcatcaaaaagacatgaccatcctaaatgtgtagacacctagtagctgagttcaaatacctgaataaatgactggatccagtagagcaagctttccagctctttgcaggggagaggacagatggagccatttcctcattccagtcctgatctcctttgactcgctggcaagggcagaagtgggcagaagcaagctaacctccatggcctcattctgtgcatagcattgagaccacgtgtgtcctccttgtcctctgagatggcaggccctggggccttctgataggagcccctaccaacagctcccacagggtaccccaccctagcttttcttgccatgaagagagctttctggaacctgccaagctcacgtgtgatgccagtcaggacttggggccatgctcgctgagattggcaggggctggggtcctggagtggtggatggcatcattgtcagtctctgggaactctgggtgtcctaggacacaggagaaggtggcagtgtccgccctcaggctggttcctggcattcagatactgacaggagctgagtcagcaccaggtggggcagtggggaggggaatttttaagcaataatgaaaagttgcctggaagaggaggagaagcttcctggataggctgtatctggtggcaaagaattccatcatttacaggcagtcccatttgcactgacattccatgtgagaaatgatttcttttcctttttaaaaaattgtggtaaaatatacataacataaaattaatcatcttaaccattttcaacggtagagtttagtgcattaattatattgttattatgccaccatcaccaccatccatctccagaactcttttcatcttcctacacccactaaacaattccccattccaccctgcccccagcccctggaaactactattctgtctctggctctatgagtttgactactctagatacctcatataaatgaaatcccatagtatttgtcctttgtgacaggtggtttcacttagcattatgtgaaataatacataagactcatccatgttgtagactgtgtcaaaatttccttcctttttaagggtaaatcatattcccttgtatgttgatatcacattttgcttttctgttcctctgtcggtggacatttgggttgctttcaccttttggctatttgtgaataatgctgctaggaatgtgagtggacagtaatgattttttgttttgttttgttttaaggtaataaggcgtaaatggggataggaattagtggctcaggacaccgacctgatagtcttttttttttttttttttgggacggagttttgctcttgttgcccagactggagtgcaatagcgtgatctcggctcaccgcaacctccgcctcccaggttcaagcgactctcctgccccagcctccctactagctgggattacaggcatgtgccaccacgcccagctaattttgtatttttagtagagacagggtttctccatgttggtcaggctggtctcgaactccccacctcaggtgatccgcccgcctcagcctcccaaagtgctgggattacaggcatgagccaccgtgcccggccccgacttgatagtgttatttgttgttgttgttgttgtttttagatggagtctagctctgtagcccaggctggagtacagtgatgcgatctcagctcactgcaacctccgcctcctgtgtcctggttcaagcaattcttctgcctcagccttccaagtagctgggattacaggcacgcgccaccatgctaatttttgtatttttagtagagatggggtttcaccatgttggacaggctggtcttgaactcctgacctcatgatctgcctgcctcagcctcccaaagtgctgggattacaggtgtgagccaccgtgcccggccggaccggatagtcttatttcgcatttgtagaaacctagaacaaaaataagcatgtgggaaagtttattctgcaaatctgcatttttgaagggacagagctgctgagagcctttggtggttgaggtctcttgactcattcccacccttctatgcactggccatatgcaggccagtgtctgagttaaggtgtcatttcttgctttggttattgcaacagtcagctaacggtaaccaggctccaagatcattttccagcaatctcttgttgcaactacttttggaattttcttccacagggctttccagagcaaattactctccttctcagaaattgctcatggttctccagtgctcatagaaaaccccaaaatatcttagcatgactcagggcccccattggtcttcccagtcttctccccctctcctttccctcattctttcatttacctcttggttcatttgttcatcctgtgatatgtattttgtattggtttctgacatgtatgtctcatgctgactcgctcggatagtgtgctctagggcccaggacctaagagcaggaatgtttatgatggaaaggatcttactttttggggcctccttagctcttcgttgaaaccttgtaaggtacattgtttcatgcccaattggcaagttggaagattgagcttctacagtttagagaaatgggtttgcaattatggtccttggatcaaatttagaaccagcaccggggtgttcctctgagtgagattgtggctttttgagacactaggaagctggaggtagcaagagtaaatgcccaggggctctggatctgctttgtctctgcagtaaggtgagaccttgctagggctgtttgattgaagaatgatgaaaggccagtgcttgtagatattcccttaacaaaagcctgagtgtggtatagcattaagttggctgctgtctccactctggaaggatatcaaatgagaatataagctcgtgttggcaggaatatgctccccactttatagggaacccaggagtgaggggaaagccttaccaaaatttgttgcattcatgctgataaattctgaacactcagctgggtgggtcaagaagttagagcatgtgggtggatgtggacttctctcataaatgtgcaacccattgaaacgctgctgctcaaaacagagtgggaccagaaatacctgcagagttgagtaacttgcttaaggtctcccagctaacagaaagcagagctgagcctttcacaatttaggagtccaagttcagcgctgcttctaacacatctgcctcttggatggctttggcataagttgcagccttgggagcattaactagtctcagtgatctcacccacaaagtgtgcataataacatctgcctcactgggccgtcatagagaccagcgagctaatcaggtaaagaagtcagcaggggctagaacagaatgggttatgaatgatgctgtttcctggtgcaccctttcttcacttgctggtgaacaacaagttcttgggacttgctctccatggtcaagattcttggttgatcttgaccaataggggtatatagtggtggaggcacgatctctagagggtgaagagtctgattggataggaatgccatgcaactgtagtcattccccttttccttattagagcattgccactgacctgcaatcttagggtgggtgtggggagttttttcttttcttttattgagacggagtcttgctctgtcgtcccaactggagtccagtggcatgatctcagctcactgcaacctccgcctcccgggttcaagcaattcttctgcctcagcctcccgaacagctgggactacaagcatgcccggctaatttttgtatttttagtagagacggggtttcaccatattggccaggctggtctcaaactcctgacctcgtgatctgcccgcctcggcctcccaaagtgctgagattacaggcatgagccaccgcgcctggcctgtggggagttttttcacttccctttccccaaaagtacttgcatgacctcggtgtctggtgcccctgcttgcaaaagcatctgttattccctcagtcagcacagctggcatccacctgtctgggctccacccctcatccacctgcagtaaagcagaaaagcctcattgaaagaatcagctttttctggcacgaacaggtggatgtcgttgctctttctgtcctgataagttggtcttgccccatggctccccctctgtagggtacttggtttcttccttccctcttggtgatatctcagtcaggaagaaagtcctatcggagagcttccaggagaccacttgattgcactgctgactgataacacaatttaccctgagcagggacctgtagttttgtatgattcttaggatttaacatacactgccctcaaggcccaagggacaaacagaaagcctggttatgctgagcccaagtgggatatcatctagaaggctttgaggttttcttttccaacgtgagcttattttcttattttatatatttaaaagggttctctttttctcgtgaggcagaacttcaaaggaagcattccagaccacacttccttttggtaaatcttaaccagtgtaaatgtttacttttgtgttgtaaatcctaggaggtgaggggagaaggaatgtccgaagcaagtgtcctgccagcaaaagttgaaacttaatctgctgttttaggcgtttgggaggaaggggagtgtttataattaacaagccatgctaatgaacctggagttagaacctttttgccaggttctgcaaatttctggacccactggaatgagagagagttaggaaagcctgctttgcttcttctgctgccagggaggtcagtgcatgaaaatggaaggaatgagcaaaacaataattcaaagggtagaaagataaaggggaaagtgaaatgatagaaagcaatattacttaaaagctgtggcttttggctgggcgtggtggcttacacctgtaatcctagcactttgggaggctgaggcaggcggatcacctgaggtcaggagtttaagaccagcctggccaacatggtgaaaccctgtctctactgaaaatacaaaaattagccgggcgtggtggcaggcgtatgtagccacagctacttgggaggcggaggcatgagaatcccttgaacccgggaggtggaggctgcagtgagccgagatcgcaccactgcaccccagcctgggtgacagtgcgagaccctgtctcaaaacaaaacaaaacaaaaacagctgtggctttggttaaaaatgtaaattccaaaaaaattcctaaaagaaatgttcccgtgcccctgccaccctcactcactaggaatgcaacaatgcattggacaggagggtctcggcaatcggcttgggacccacactgtctaggaaagaaacttctggtttccatgtgctgactgagcaacaaccccttggaagaaatccttgaaaaactgggatgttctatggagggaagctactcatgagttgtgtaacttaggcaaaggcattcaccttttctgagactcagttttcttcttatcaataaaatggagctaacaataggcaccttcagaattatgatgattaattggctcgtgttttctcaacactgtcaattgttcttgaggtcactattgttacccctacttctatgcacccaccatgtatgcatggaatgtgctagaaggggaagaggtagtgggaggtgatcctggggcaaatacagctaagacctccccccatcctacatgcactcattcttctctttcctctgttagtctggaaggggttggggctgttggaagaaaaggaacataaagcagagagaaggatgcagtgagggtgtctgggactgttggcaggcagcagtcgggtttgggggctacagggctctgcaattgaggaagccagaggtggatgaagagttggccacacctctcccctaaagctgcagaatcttctgactataaaaagagctggtgcattcagaatcctctacaaccagtccttcccctgaccttcccagaagcttcgaaccctcagtgctgagctgccaagacgagctgggtgactaacatagccattctccagtttggggatgtcagaatgtccaccccttccccacttctcgagggggtcatgcttcagaactgcagccctgccacttcctcacttcagccttgtatgtaagagtagcaagcccagcaaacagcccaaatctctctccctgggggctgtgtggatacattttggggcacccatgcaatggagtaccttgtggacactgacaagtctaaggtagagctacaggtgctcatagggaaaggagtccaagatacatgatggagcattcagcaagattcaaaacagtagtttatatgtttaaagaatggagttaaaagtatacactcccatcaactagagttttacagatgggcttcaaggaattatctgttccatagaaatgtttggcccacatggttttgaaatagctgcttctccaggaccaccctttgaaagcttgtgttcactgcagtccacccttcccacttcactgggttacctgcctgggtcatgctggaatttgagtttgcaaccccaagacaactgagagtgagttaagggaaattgtgtatgtcctacagtgtgattgatcagttttaagatgaacttgtttgttttgcacgttaatatcttcgaatgtgaggtactcttatcaatgctgttggccattgctatcgttgcttgcaccatgcacaaataatgtcgtttctgttaaggtaacgtgatagctgtggcccctctgtgttttcattgaaaaccgtggaaaaaccatttgcaaacaggtctttgttcttattgaaaaactttctttgacatcttctggtgaagtcaagaaagtgctagaatcaaaattcaaagtaattgtcagcggcttggaagagaatcacggaattctctttcaagaaatgctgctgggcacggtggctcatgcctgtaatcccagcactttgggaggccaaggcgggtggatcacttgaggccagaagtttgagaccagcctggccaacatgagggaaccccatctctactaaacatacaaaaattagccgggcgtggtggtacgtgcctataatcccagttacttaggaggctaaggcaggagaatcacttgaacccaggaggtggaggttgcagagagctgagatcatgccactgtactccagcccaggtgacagagtgagattctgtctcaaaaaaaaaaaaaagataaaaaataaatgccttaacattcagtagcacaaaagaatgacactgtgaatgagaaacacacaggtgctgatgactcagagctgagaaggggctcaatcttataccatagttcattcatttcatttaacttccttgtcatacatggaaaagagagtcatataataaaggccatatctaaaaaaagtctgagctttttcagtacatataaatattctaaggtaaggaaagctttgggtcataacttattggtagtgttttccttttctggttgcatctaataattctgtttataagtgatactttcttagtaatgaagtagaatatgtgtatgtatttgatcagcatgtatatgtgtttttgtgtgcacatgcatgtgtgctgggttagtgtacctgctgatatgtctgtgaaaacatttctggaagggcacactggaaatattaacttccctgtaacttaagggtttgcatagtaggtgaggagggaaaagtttcttgttacttgtatttgtgggttacttctgtatgtttttggttttttctttttctttttcttttttttttgtgacagggtctcactctgccgcccaggctggagtgcagtggcacaatctcagctcactgtaacctctgcttcccagactcaagccatcctcctgtctcagtcccccaagtggctgggactgaaggcatgagccaccacaccaggataatttttgtattttttgtagagacagggtttcaccctgttggccatggtggtctcaaactcctgggctcaagcaatctaccctcctcagcctcccaaagtactgggattacaggcatgagccactgtgcctggccatttttcacttttattaaaaatggtgggggaacccttcaagtctcaagccccacctcagacctcctgacttcagcatctctggggatggcacccccggtgccaggcagccagatttggttctctgtctaaccaggctgaaagccaactggcatctgtaggggaccaaggactccatgaagctcacaggggtttcaaagaaactacgaattcactaaccaattgactatctccttgcccgcctctttccctttctcctctccttcctcaagtattttttgagtacctcccctatgtataatgtcaagcatgcatctgcagaccttcttttcccttcgggagctgggagtggatgatgcctattttgcacccttgagattcatggaaaatgtgcatctttataatccttgaccgtctcttcatacctttatgcctgagaatgcacccttggtgctgtgagccctttgtggagaatgtgacttcttctcccagacaagatctcattgtgaggccaggtctaggtttagaggttcataatgatgggcagcacctctgtgacttttgcaacctgtagaggctgctctgaagtgctatctgtccagaaacactgagctctgcactggtgtggctgcggaactgtcctgaaggagagagtgcaggagagggacatttggaaggagcacatccccccgcccaggctttacctgcacagcttccctatttatcagcccaggttcattatgctaaggacttaggaattgctatcccttctatgctgaggactcagaaattgctatcccttaccagccccctcccactccttcaagatgaactcattacaagattcttacagaactatagcctgatcatccccttgcataaaacactttatgttctgtcatggctcttaaagtctactctccctggcctggcaagggggctcatgcctataatcacaacactttgtgaagccaagacggggaaggatcccttgagcccaggaggtggagaccagcctgggcagcttagcaagacctcatccctactgaaaaaaaaaaaaaaaaaaaaaaagccatgtatagtggtatacaactgtggccccagctactggtgaggctgaggagggaggaccatttaagcccaggagttcaggcttgcagtgagctatgatgatacccctgcactccagcctaggtgacagagcaagatcctgtctcaaaacaacaacaacaacaacaacaaaaaactcttctctccctaacgtggctcacaggacactcaacaacacaggactgaccctgattttgcctctccggccccatcctgtttctctgccccacccccactgcactctggcaacaggtctcgagagacattgcaaccttgtgcattatagagacttgcaaatgctggcctctctaaccggagttatctttcctgctctcttcacctacttacacctactcatccttcagccctgagtttaatcacactcacttgggaagccttctataactgtgaggagtaagatcagaccctcccccctccacccccatttacagtctcatgctcctgtgtgctgctgctttgtagaattgcccaaattatttctgtgtctgccttctctactgcactgcaagctccttaaggacaggggactctggctgtttaccacaaaactgtatcctcagtgcctggctctagtgagttctgaacatatattttgggcaactgaatgaatcaatgactctcctgctaagcagcaatgcttctcccaagaacaagggttaggcccagcttccagcagggaggcagctgaggatgtgactgagcgcctgagcgcctggagcccagctgaagaagctgattggtgggatggaatgctaccggtccctctggtatcctggatacggagagggtgggaatgtaaactgggcccagaggctgaattcttgaaatttcactgcagcctaggaggagcctgcagggaagtgaacctgaccttgaagttctagccttgatttttttcccctctaaaaaaaaaataagataaaaggtgcaatcatgcaacacattctttctgagggagctgtgaggtgagggctttctaagtccctcaaaagtcacttctaagtcacttctaagtccactcatcacccaggcctactttttgctggtgcaggtgcatcttccaaggtttctcggcattgcacaccctagaggagttgaagttcctggtgggtacttcttgggtgctagcagagacatcccagcagcagttctcctaatgaggtgtcacagaagataatatcaagtgtttattgaacatctaggccagccatggcggctcacacctgtaatcctagctcttagggaggcagagactggaggatagcttgagcccaggagtttgagacctgcttgggcaatatagcgagactccgttctcttaaaaagaaagaaagaacatctagaatttcctgggcaatgtactaagcactttgtgtatctcatttgagctggacctcccagtacacctgtacttgaagaattattatgctaattaaacagaagaggaattaggactaaaggaactgaactgatctgcctatagtcacacagctagaggtggaagtgctgggatagaatggagatccatctatctagtggctcccaagcctctgttctgagcactgtgtcacctccaagtaggcctagcagccagcacttgactatttccagtcttcttagcatgttccattcatttgctaatttaattgtttataaaacttgatgaggaagatatgattactttcatttctgaaattactaaactgaggcttagagaaattaattagcagaaccaggatacagacacagctccctctacccagaaagcccttgctttcctccccctaaggggagaggggagtctgtgtcacttagagcaaatcgcttgtcctctctggtcctcgtttcctcatctataaaagcaggacattggacgttgtcagaggttttcaaatgttgttttagcaatggaaccatttcttgaaatggaatcttctcattgaaccctggtatgcaaacccctcccttaaccgcccacttactgctgccctcagcccacctggatatgtgggccccacaaaacccaatttgagaaactcagctgtaggtgatttccaaaggcctttccagtttgatcagccatctttgcttctgtaattttgggtccagcagaagagccaaggcacgttctcctttttaaaaacaatacccggccagccacggtggctcacgcctgtaatcccagcaccttgggaggccgaggcgggtggatcacatgaggtaaggagttcaagaccaccctggtcaatgtggtgaaaccccgtctctactaaaaatacaaaaaattagctgggcatggtggcaggcatctgtaatcccagctactagggaggctgaggcaggagaatcgcttaaacccaggaggcggaggttgcagtgagctgagatcatgccattgcactccagcctgggcaacagagccagactctgtctcaaaaaaaaaaaaaaaaaaaaaaaacaataccttgtgatctccatcctcctcaggaccccggccaggaggatctgagcctgtgccccagaactccttgttgtatgtttaacactgactccaccgtagggaagaaagacgaaattcgtcattttacttgtgtgcttggtattgtcactcactgggaaattcagatacattagtagttaatacaggacagttagagttaaacggaattggttggaatcactgcacctgtggtctatagtgtgtgactgtagcaagatgcctaccctgtctgtgctttagttcctattgcatgtggagaaagtggtgacgccgacttcagatcctgcttttaagctagatggtgtatgtgctcaacatatgtgagctgatattacgaatcttgattgcaaagcatcagctgtttttaatgtaccatgaccgcagtgagaaactggcactgagctaaacaaccttcacctaggtataaagatccaagtgacatcctaagaaaaaggaacctcaccctgtgctcctcataccagcggcccagccatctacaccaactgatgctggcagaatcgttggggtcctgcaatcattggggacctggttttgtaactctctccccactcccactggtacacgtagtggggagcagcctgtcttggcatccatataccccactctccaactgtgtggtacttttgcatgaattcttttttttccttacttcaggcgtattcatctttcaaaagctccatcggtgtaactaggaaggttttgacatctcctctctttcctacacccctccccccagaaacagctggcaatgtcaagacatttctggtggtcacaactgggagggtgcctctaaatggctaggggccagggatagtgctggacatcctgcagtgcacaggacagcccccgccacaaagaatcatcctgcccaaaatgtcaacaggtctcacagtgaagatcaaggccaggaggccctgaaagatatgttaagcatccatcaggcaggcctggtgatgaacaagagaaacactgtttctgttttcatggatcttatagtctagtgtttgtgctacagacggtaagggagacagaaattcaatgaccaaagaaagaaagaaatgcatcattgccaattgttgtaagttccatgaaggaaataaaatggtgccatggtggagaataaatgaggggacctcactaggatgactcagtcacacaagagggtgacagttaaactggggtctgcaaacccaggagctagccatgcaggaagaggatggcattcctggcatgggtcacagtgtgctagggatgaggagagaaagaagggcgggtgctggagcagagtgagccttggagaagacgccaggacctggaggaggctggagggctgggcaagagtgtgcagtttgttctaaatgcagtgggaaggccaggcgcaggggctcatgcctgtaatcccagcactttgggaggccaaggtgggcagatcacctgaggtcaggagttcgagaccggtctggccaacgtggcaaaaccccatctctactaaaaatacaaaaattagccgggcgtggtggcacgcacctgtaatcccagctactcaggaacctgaggcaggagaatcactggaagcagggaggcggaggttgtggtgagccgagatcgcgccactgcactccagcttgggcaacagagtgagactttgcctcaaaaaaaaaaaactaaataaataaataagtaaatataaatgcaatgggaggccagtggaaagcctttaacttagaagtgacaggatagagtttccttttttttctttttttttggggggggattgagtctcactcttgtcgcccaggctggagtgcagaggcgccatctcagctcactgcaacctccgcctcccgggttcaagcggttctcctgcctcagccttccgagtagctgagattacaggcatgcaccaccacgcccggctaattttgtattttttagtagagacgggggtttctccatgttggtcaggctggtctcgaactcccggcctcaggtgttccaccttagccccccaaagtgctgggatgctgagtttactttttaaaacattttgagagtatgaatcagaagggatttttcctgcaagttgaacactgcatgttctcactcatgtggaaggtacaaaaagttgatctcatagaagtaaaaagtagaacaggggattctaaaagctgcaaagggagagttagggagagatttgttaaaggatacaaaattacagctagacaggaggaatacattctagtgttctatagcactaaaaaactatagttaaccatattaatatagtttcaaatagctaggaggaggatattgaatgttcccaacacaaataaatgagaaatgtttgagataatgggtatgctaattaccctgatctgatcactatacattgtatgtatcaaaacatcactgtgtattctaaaaatatgtacaattatgtgctaatttttaaaaattgaaaaagaaaatgatgaggtgctgagaaacggtctggctattgtttagggactgaaggccccagggaagctgttgtcccctcagcaggggtaaggacaaatgggatgacatgacaaggagcttttccagctgggctcctggtagaaataagactctaagagcagagggatgagggtggggttctgggacctggggagggagggagctcttccttccccctagctagttgccttgggggaaagaatgccagtggaggcgctgttggggctgtgaagggtgcagtcatttgatgttaaggagaatgtcgtgtttgtttttgccaggtggttctgacttcaaatcaagggatctctgggtttagggaacattgttgtatatgtggtggctcgggcaagggtggctttccctggttctgccgtttactagccctgtcaccttgggtgagttacttaccctctgtaagcctcagtttcttcatctgtaaagtgggaaaaatacagtacttccttccctgggctgtgaggttgaaataaggtactgtttgtaacttagcagactatccagcacatagtcaaggtgtaatgagtattcagttacttacatagtctaggtaacaaacacttgacagataatagtacatttaagttaaccctcacaacgagactatgagacaagtaccattctttttgtttttctttctttctttctttctttctttttcttttctttctttctttctctctttctctctctctctctccctctctccctctctctctgtctctctctctttctctctctctctctctttctctctttctctctctctctccccctctccctctctctctctgtctctctttctctctttctctctctctctttctctctttctttcttttctttctttcctttctttcctttcttttctttctttctttcttttcttttcttctctttctctctctctttctttcttttagatggtctcgctctgtcgcctaggctggagtgcaatggtggaatctcagctcactgcaacctccacctcccgggttcaagtgagtctcctgcctcagcctcccaagtagctgggattacaggcatgcatcatcatgcccggctaagttttgtatttttagtagagacggagtttcctcacgttggccaggctggtcttgaactcctgacctcaggttatccacctatctcagcctcccaaagtgctgcgattacaattcaaccatttaaagcttacaattaagtggctcttagtatactcagagttgtgcaaccatcaccacaatcacttttataatattttcatcacctccccacaaaaaactctgcaccacttagcagtcatcccccaatcttcacttccccccagccctagacaaccactaatatactttctgcctctataattttgcctatcctggacatttcatataaacagagtcatacaatatgtgaccttttgtgtctggcttctttcagtgagcatgatgttttcagctttcatccatgttgaggcatgtagcagtacttcattgcttttcattgccaaataatattccattgtatggatatgccacattttgtttatccattcatcagtttgtggatatttgggttattctcactttttggctattatgaatgaatgctgctatgaacattcacgtacaaacttttgcatgtacatacatttttctttcttttggatatctggtagggactatttttctccttgttttacaaataaggacattgaggcacagaaagtttaagttatttgcctgggtcacacagcaaataagtaacagagtcataattagaactcaggtagtctgcctccaaagtctgtgctgttcatcagtacctctcctgaacgcttccttatagcagctactgtgccaggagccagagagactggggagagcaaagcagacatgtccctgtccttgtgaaacttacagggagaccatggcgcaataatcgaagacacgggaaataactaccatgacagctgcgttaaggattacagtcgagagttgcaaggttctggcaggtagaccaatgggctatgggacttgtcatcatcagagtggccagggaaggaaagcttccctggagaggaggtgcttgctctaagatctgtaggacatgtaagtgctaaccaggcagagatggaggaaagcagcagctttaaaggatgcaagactcgagggtgcggccagtatagtatgcaggcttctgaagtcaagcatttactcatctattactcagcaccccataggcacaaggctccatggataatgggtcctagggacactgctaactgagaaaaatctctccagccccaggcaggaacacatcttgctgtcagagatcactgatgtcccagtctgagagacccaaattcccatccctgcctctcattttcaacatcaaaaggctgctatgctttagatctaaaacccaggatggcatttttcatctcctctcctctaggtagctggcctttcaaatgggggagaatatcattcctcttcaaagcggtgcaggtgtcatttgctgatttaaaaaaaaaaaaaagattttggaaaaagtaaggcctgggtcaccagatacacacctgccaggtgttcagatgctggtccttccctggccccttaagtgagccatgaaaaggacctggtgattcacccacagataacggaagaaagttctgttacctcttgatagcagcttttgtgtccaccccatttccccaggtgggccgagagcattggtagctaattgtaatcactccacacaattagagctgtgctgccccttcccctagccagtggacttcggtacccagagtgaagcctgcagcctgtgtcagacaccagcatgtgtaatgggaggaaacagcttccatgtccagagcgctggttccaagggcatcttcaggcactgaaattggcactgaataggcatggggaagtttcagtggaagtgaatggggagcactggggggacttactgaaagactttcagatacagggagtatttgacacagctcacctccaactggcctggttttattctgaattgtttggagcagaggaagggagagggaaaacataaagatcagggtaataggttctaggagctgacggagctgatggagctgaacagggtagggaccatggaaggtagagctattgcgcaaaaattaggcagcctctaggcaggcaggcacttggctggatccaagtggcagtgttaggtgctgtgggtgaatgcacacccacaagtatatgcacattccctgcctcctggaagctcacagttcagccagtgatacatgtatagaagtttgaagcagtaacattagatatgaggttgaattcatgctgaccggatttctgtggacttcgtggaggccctgaaggctttgtaggatctagaaaggcagaaacagatgtggtgggggataggttgaagagtcgtggatgactcactaagacattgaggtgggaaggtatgcagggactataccacactgtgtggaggagggggttcatggaaagggtaagaactcccaaagggtagatgaagagccatgaagacccagctaaggaaacccatgaatgactgggatccactggaaagtcttgagcaaagaaccggaggatgcaagtgctgcagagaacagaccccatactgtggacggattgagagcacagtgggggcccctcaagctgttccacactctgggcagtagggtttatccaagtgcccaccaccaagtatctgggcactaggcagggagcaaggggtgtttccagttccagtgttaaaaaattccatccaatttgtaggttccaaggaaggattgggctcccagaagcttggagttcttgttttatgaccaccatccagccctaagagcctggggggtttgtatgcattttcattgcgcagatggacctcccaattttctcaactttacttccctttcacatttgcacagaccatataatcatggttttaaaggtcataaagttcactgtgctaggagatacagaaatactttcttgatgacggggccaaacgttcattaagtgctttcatgtgccctgcatttgaatttattcatgatagcttcaacattctgagtgtttactgtggggcaggcactgtgctaactgtgtattatcttgtatacttttcaggacaagtgaaagtgatgaccccatttaatagatgaagaaaactgacactcaaagaagggaaataacttgcccaagatcacagagctcaggttggctggactctaggacatcccatgcctccacaccatgctgcttgtcagcagcagcacgcagagctggttgcaaaggaggggctgacatatattaagagttgaggccgggcgtggtggctcacgcctgtaatcccaacactttgggaggccgaggtgggcggatcacaaagtcaagaggtcaagaccatcctgaccaacatggtgaaaccccgtctctactaaaaatacaaaaattagctgggcgtggtggcgtgtgcctgtaatcgcagctacttgggaggctgaggcatgagaatcacttcaacccaggaggcggaggttgcagtgagctgagatcatgccactgcagcctgggcgacacagtgagactatgtctcaaaaaaaaaaaaaaaaaagttgaacttttgcttctgggatgtttatgttttttcctagtcttcaggggttcagggctctcagatgtctcccccaccatacctccactcagtcttccactgatgacatttcttaataattcacgtgcttccccctcggctcagttacacattggagaacactgctgcatctgaaccactgtagctgacaagctatcatgcagctcacccaaacagcagcttgcaaggcctatccattctgaacatttggaatggaactcttctgatccttattttccacctagaacagtcataatggggcaatgggaatgtattgattgtcactgttttgcttgtataccttggactgtttctgcaaaaggagatatgtttgagtgttttaaggcagccttgcagatagcttctaaaaagaattcactggcctgaaaaaatgattcctagcctgcagaactttcatttgtcttccctgtgcttgagagagttgggtagcccacaggaaagaacaagtggtgaaaacctggcttctaatcctaaagcttccaacagcgagttatggggtcttgggcacattctttacatttcaggctcggttttctcatctgtagaatgtgagtgttacttttctcctccagaattgtcctgtgggtcaagatgagatagcagatgtcataagagctttgtaagctacaaagtagatgtatatgtgtgggataatagtacacagtttcctgaactaactcatggagttcttgaagacatcagatgaaacagtagatgggaaaattctgtgaagggaagaaactctgagcatctctgaagcaggtgctcttgctcaagccttagcattgcgtctgtcacagcaggaagcaggggctgcttgacaaagcagtgcagggggttcatattccaaggggaggttttatttagaagagaaattacttaaaatagaagtcaaacatttatagtaaatattggggggaaaagatttgatcaggccttcattttgagaaatgaaactaaaaattttaaagtatatttatactgtatttaacaacatactgcaaccatgccccagttcttagtttgaacaaagtgttgatttattttttgtgtaattatttggagacaatgagaatagcagaaaaggacatttttctcttctcgtttgactttcccaccaggctcataaggaaggtcatttttacaaaatattgaaggttttatctgttttcctgtggccttgtttaaccccttggtatcactgaaatccttctcttttattattttatttttagaggttcactctgttgcccaggctggagggcagtggtgcaatcttggctcactgcagtctccacctcctgggttcaagctgttctcctgcctcaacctcccaagtagctgggattacaggcatgcaccaccatgcctggctaatttttgtatttttaatagagacagggttttgccatattggccaggctggtttcgaactctcgacctcaagtgatcctcacctcccaaagtgctgggattacaggggtgagctaccatgccaggcctgaaatccttcccttttaaagggcctgttgtctcttcttctttatcttaatggattttctccttttcagttgttacctgagtaactcagccattccttgggtgtgattgagtagttattcaacatgacattcacaaacttcatgaaatcctgcctcttttagaatattagtgatttcccttgcagttgacttggattgtacttgcattgctttgtcagatgctaagacatccagcagacccataaagatgttgacagtaaatactgatggcatggactagacactaatgttaagtggggagcaatatttgtataggcattgattttattataagtactcaattcatgggttaattttttaactcagctcatagtttttatattttgatgactcttatttctctaagtgatcatctaagtgcaggaatcaagatacatatccagtcattgactttcccctgattaagagagcaagctgtggagtcagagtggctgggttagaatcccagcttctacttgtacaatctgtgtgacccttgataagataattaaattattggagtctcagtcttccccagtgcgagcctgcggggaccctgtgtggtgagagaggctctgtccaacaccaccagggcagggagaaacaactggccccatttcataacagaatcagatggcccaggagggacccccaagagtgtttgattgggatgcccagccctggctctccctccacctgaagcccaccgagattaatcgggtacctatgtctgatgtcgaaaggaaggagaagggtttgctgaggactgatctcagcaggtctgaagttaggctgaaaatctgtgttttgcaagtataaacactgtaaggagatacaagatacttaggaaagcagggagcagcccagagtgcgagcccagtgtcacagactcagaatgatccaggaaccatacagggaaacaatgcccgcagaaaacagcagctgcagatgtatttcctcccctgctcagctcctcctgccctgcatgagcaagaccctaagaccctcaagagaccctcagaaaatctgtccagtgccccaacatcagaatgaaggcatctggggaacaggtagaaacacagtgcctgacacaccgatgcccttagtaggcgtgcctgaaatgcttgttgagaaaataaatgcatgcagaatacaagactcatttgaatacctcctgtttgactaggagcagaggaattcaggtgagccattgttgagaaacctgtatgactagttagaattagttaaaaagtaaaagccgggacctcccagggcccatgcttggtatgctgtgagtgagattgttctgtaagttggtggtggcttagaaatgattgacagacatgtcttattttttaatgtgacaatggatgtttggttccatgtaaaacaattagaggaggagccgtttggttggtgtcaggcactgtgtttcgacctgtttcccagatgccttcattctgatgttggggcactggacagattttctgagggtctcttgagggtcttagggtcttgctcatgcagggcaggaagagctgagcaggggaggaaatacacctgcagctgctgttttctgcaggcattgtttccctggatggttcctggatcattctgagtctgtgacactgggctcacactctgggctgctctccactttcctaatagggtccttggatgtcacccccagacgttggcaatgtccccagccgactgagtgacaagggtcctcctcagaggctaaagccagcatctctccagttcagttgccctgactgtagatgggtgctgtgtcctggggcctgggatgccctgagttctcgagttaaccgctgtcagtcatgtgccctccagggcagacctcaagaaggaggcagttccagggatactgcttattcagctcaccaggctcgcaagggtctcttccctacttccgatccaccttcagttgatcaccctggccttgcctggagagggaatttgaaattctgtgccctaatcctgactgcttctctaggatttctttggacctttcgttgagatgctgatattgaagaaaaggtcgtgtgaagtccatgctcaccctgttaagaagtgtttgtgggtcccctgctaaagcagaactgaaaccctgtttctgtcattctgtcagctcgtggcctcaactgggcacagcgcttgggttccctcttgtaccctccctcttggtgtaagggatggccctgaagaaggtgaagagcaatctatgtgatgatctatttcatttattagcccgagtgaaattggaggcctcttttcttttacagagtcattgtcgagcaaggtcagtccaaaaaaaaaatccctatatatttatgattatgtatcaagaatgattctgtcccctgggtatactgcagtgctctaaacagtcctgatcgctgcccttgcagaggtcactatctccagagaaagaatgtaagtcattgtgaagagctgggaaggagaagcagatgggctgtgggcttatcaagctgggatctgccctgttggaagggtcagaggagtcatgctcaggagatggcagtgtgactattagagatttctgctatgataacagagtattgagcacctgttgtatgcaagcactgtgcaaacacctggcatacctgagctcctttattcccgagatgggtgttactggcagccccatttgacaggttgggggatgtgatgtgcaccgtttcctgaaggtggccaagagaagtgatgtgcaccggccacacagctggcaagtggcagagctggttcctgagctcaggggacgtgactgtgatgtgtgtgcacgggtgtgtgcacaggctcaggtagggtgaagctcagggagacccaagccctcaccctcaccctctctactgttttcctgccaaggaggggcacatcctcaggatgtttgcaggctttattctgcctgggcagtgacccaggctcctttaatccacagccggatgggaagagctgctggcagagggaagggccacacatcattgtccctctccctgaagcatacctctcaagaagttccggggtggggtggaagcttggctgtgagcacaggcctccctttatcccaccttgacctcaggtgggccagaggagagccacacacatttgccagctgggggtgcggccatcacaaacaaggacttctccaaggaggaaatacaaaggtgccatccggaaaagatcaaggagtagttgtccaggcagggtctgctggagaaatacaaagaaagaaattatcagcctaggaaagggccctagcagagccatcctgaaggtagcccagaaggaatttgattggggtggggccaggggtatccagcccccacactgcagcctgggatctttgcttgagggtgtgagaagaaaggggtttcccttctgatggaaaagttcctgagtggtctgaaaattccaaagctaacacatgtcagctgctttcaatatgctagacataatgcctactgctgtacacacgtcatcctataaacctccccacagctctgtgaggtggggatgattgttatccccattttacataggaggaaactgaggcacagcaaggttaatacgcccgagattcaagagctggcaggtgacagagcgagttgttgaatggtcatggccgagtcccttctgttccctgtgcgtcaatttccccatctccacaatgagatgaccagacacagtgatttctaaaagtcctttcattaccgaattcccatgattgtgtcccagagacctgtaaggtcattcagccatgcaggtgtaggcctcttgggcacgtgggtttctgacacccccacccagttctcttcccacccctctgacacgcctgtttctcagcaagccttctgaaatcttttgtatatgacaccccccaccttataactatagaaaggttttgtttgttttttaatgctttccagctttgggctcaggaaatcccttcttttcttccctgtaaaagatttcttccttccatcccactctccagggcctcatcctggccaagcagcctcaccctctccttcagcacagccctgcaggctggctctgtcaccttctcatatttactgagcatctgtaacaaggacttgctcaagggcacacagtcggtaagtggccacgtcaagctggtacctacattgtggtctgctgttcagcacacagtaggtcctcaggagtgcttccttctttctccgtcatttgactggctctccttccctttgcttctgtttgcagatagaaggtagagtggggctgggagtggggttggctgccgtgggccactgggcgggaggctcacagcccttcctgtttttggaagaattggtctggagcagcagctccaccaaccccagttctgtgaccaacagcggcctcttaagtaaccgtttgtttcctcaaaataacactccacctttcacctagcaagaaggatggttatctgcatgggtgccatctttctgggccctccaaatgcggacagctcacctttgctgctaaaaacacctgcttcacctcccagctccaggtcattcctctgagatcttatggaaaagctctcagctaaattggacattaaatactagaggaatggattggttcacatactgggaaagtccagaggtcactgttcaatgcagggctccagttgtatcatcaggtcttagtttctctcctcctgactctgcctgctgctgtatcggcttcgttctcagtttgcacatgatgatcttctaggattgaagaaaaatgcaaaaagaggtctctcttattcatggctcagatggaagtcctgaggttgacttttactagtccatagtgggttgtgcaggaatgatttaaaatcaactgctcaccaaagcacgtggatggagaatctttagagaggtgggttcctcaggaaatttgcaatgctgtcaccaaaagaggcagaaatgggtgcttggtggcagaaatccaacaactgttctccatcccttcctctgctggtccccaggtcacagtccaggaggctatttggcgtgggtcacgagggtgcttggactgaagttgagcatgcctcttctggactggctctcccttggctccctactcttaaacattgttctgtttttctccaccccaacataaagggcatctggccaagggcaggacaggaggaaaaggacgtggaagaaagcctattgttatcatgatcattcactcattcattcattcattcttctgctcaactatgtgcttaataaatgtttattgagcatctaagacattgcaaacaatgagctaaatgagggtttccaaaacttcagtcactggtgcaccctcttcccaatttttgccaatagaagtaaaatgatgttaccaattcccagctagaggctgggcgcggtggctcacgcctgtaatcccagcactttgggaggccgaggcgggcggatcatttgaggtcaggagttcaagaccatcctggccaacatggtgaaaccctgtctctactaaaaacacaaaaaattagccgggcgtggtggtgcatgcctgtaatctcagctacttgggaggctgaggtaggagaattacttgaacctgggagatggaggttgcagtgagccgagatcacgccacggcactggagcctgggcaacagtgagaccttgtctcaaaaaaaaaaaaaaaaatcccagctagatagcccatgggaaggcaatgagcctagggtccaatctctcttagttaacaaaggagcctggcagaggttggagtagttaaagacacagtagctccagactgtagactctactcttgattgaatctgaaaagctgaagggtaattgaaaagggaatagcattttccctgagagatccaatgttttttcctgccttgcaagtgcacctcataaagtcatcctgtgtgccaccaaaaggcatcatatacacatgggaaatgtataatactcatggaatccagaaatgaatccaactcggaccttgtctcgaagcgacttccactctaggaggcgagagaagagcaggatacaaatgaaagtgccatgagttaggatatgatggaaggaggggtgcaggtgaagggctgtgggagatgagaagaggttgctctcctggggcctggcaaaggctgcaggtgggagacagtgtttgcagcaggcctggatgcctgcggagaatttgacttccagagaaagggattgggcagcccaggcaaagaggaaacgagaaagaccagggaggttggaggtgggtggagaacagcaaccagtcctgtcgcagccaggctgtttctgcaccacgtgccgcctgcccactctgggtgtcttgtttatccttggatcctaatggtggtgttgagtagactccactcagaactgagacgggtgtctgcctagggactggctgcttctctgcaccctctccacccaagacacacttgtttgccccacgttctctgtgcagtaaccctcccgtggcagctgatgtggtagaagcagcagattccgatctcagagctgccctttgctagctgtaggacctgctgtcccgttccttagaggtcactgagcacctacctcaaagggcggtcaggagcatccaatgagacaaggcctggcccatggcaagagctcaattaacattaacacgcacgagtcttgaatactgtccacatgtgcttattgaggccctcttggcttctcaagctttctgagccttagtgtcatcatctgaaaaatgggatgtccgtatcaggtggtcaaataatgtttacaaagtgagaaccacttagtatgtctttggcaaatatttcctttgcctgggtggcttctgctgtgcttcaggtttatccagtaattattcaaatatcattcattgagctctgcactttttcctgatactccacaaagtattgatattgttgttcctgttttattaattgcatggtgcatggtgattaggagcttagaaccctgaacctatttgcctggattcaaatcccagctctgccaccttccagctgcaggacctaaggcatgcgacttgacctctccatgccttagttttcatctgaaatgaggattatatatatataatttttttttttttttgagatggagtcttactctgtcacccaggctggagtgcagtagcatgatctcggctcgctgcaacctctgcctcccaggttcaagcaattctcctgccttagcctccaaagtagttgggattacagatgcccacgaccttgcccagctaatttttgtatgtttagtagagatggggtttcaccatgttggtcaggctggtcttaaactcctgacctcaagcaatccacccacctcggcctctcaaattgctgggattacaggcatgagccactgcacccggcctggataataattttcaattatacaaaatagtaccatctcacaagattgctgtggggattaaatggagttaatatgggtaactcttaggtcaatgcctattgcatagtaataccctgtaaatgaaaactatgattgttgctatcattgttactaatgaggtgaagttacttcattggctgaactccaattcgaacccggacctgcatactccaaagcccacgttccttctaccccacagatagcctccctcccactctgaacccctttttgtgtattttgggtccttccagggggcctgggaaggtccccacactcccctcagcaggttactcacctcccaccccacattccctaagagaaggccatgactgaccttccccctactccctaggctttcctggaggtaccctgtgacctggcctggctcttccttccagacttttcttccagtctcatgctgtccttccagaccctgaggcagtccttgccctttgcatgtgaagttcttaagtaaagagacaagatgctactagtgtgcaaacacgcgacagccctgcccctggcatcagccactcctggcatcagcctgccgtcgtcttgccaaccctccacctctctcaggcctcctgctgcccctcaatggcatgccagcctctgtccttctcatctcaaccccaaagagttagagttgctgtccttccttcacctgacgcccagggagcctttgcacctggaccatgatctagagggctgttcctccatcactcgctgtgtgccgtcaggccaatcaagcgcttcttgaagccttagtgtcctccactgtgtagtgtgtggttgggaaggttaaatgcaaggtcttatttatttggcccgatcactgccaagtcagggcccaagctacttcctgcttcctctacagaacctcctgggagtagtccagcatgcacggatttcacctttctgggaatcctgtgtcgcctgttgtgaaagtttcatttggaacgatgtcttcattcctccatatacatgatcatggatgaatgaatagtttgtgtgtttacttccagctgggtttaagttcatacttggtgctggacatacaatagctctgaaaagatatttggaaataagcttaggctcttccaaaaatgagtgctttttctttttttctttctttttttttttgagatggaatcttgctctgtcacccaggctggagtgcagtggtgtgatctcgtctcactgcaatctctgcctcctggattcaagcgattctcctgcctcagctacccgagtacttgggattataggtgcctgccaccactcccagctgttttttgtatttttagtagagatagggattcaccatgttggtcaggctggtctcaaactcctgacctcaggtgatccgcccccctcggcctcccaaagtgctgggattacaggcgtgagccaccgcacccggcctgagtgctttttcattttttgttttttaatattgatgcactggaatagaattaaatcaggggctcattgttgaatcttttctcattggctgtattttcattaaggaaaagcaaaatttaaactatttggatactttttaaaatatattttagctaatttactcctccattctatctttttggggaacctgggatatgcctagcactagtgctgtcctaggtacaaaagtcatgatgcctgcagtttataagacctttgaatgtttgtcatggacccaattcccgggtctgacttgccagtctagacatctgtgtattccattccactggtaagtttctcctttgtggacctgccttagttccatcatttcagtcttcccagggagggttctcagggcccgttctttggtcatttccagtttgctgtggggtgtgtagagagcattgagcttccagagtgaacagttttgtggcctgcagcaggccctggagtagggctatatgctctgtatccctggaagtctttgttaggctggctttgtaagcaataggctcagggactttgcttcaggaggtaaaaagcaagaccaaaaacgcccccaaagttttcctcttagagaggaggagatggccacaagccttctgctatgttcattcagcagatattagggagcctcaactctgccagggcctgtgtttggtcataggaagacaatggtgaactctgcaggtgtgactctgttggaatgggagagacagacagtcaacatatcaacacacaaatacagtgacagaaagtaattgggggagggtggcactcagtcaggcctgcccaggaaggcctctaaaaaacagcatttcaggctgggcgtggtggctcacgcctgtaatcccagcactttgggaggctgaggtgggcggatcacctgaggtcaggagtttgagaccagcagagccaacatgttgaaacctcgtctccactaaaactacaaaaattagccgggcatggtggtgggggcctggaatcccagctactcagaaggctgaggcaggagaatctcttgaacccgggaggtaaaggttgcagtgagctgagatcgcgccactacactccagcctgggtgacaagagtgagactccgtctcaaaaaaaaaaaaaaaaaaaaaaaaacagcatttcaactgagagccagccatgcaaaaagtggacaggtgtgtagacagggacaggtaactgtcccaggcagcgagacctgcgggagcaaaaggctctgaggtgggaatgaggttactgcattctgagtattgagaaaggtgaagctggaggagcaggtcaggggcaaggagttctattccatcctgttttggtggtaagactttgaaggggttggagcaaccgagtgacaagactggattaatgtgttgttgtttttattatgggggtgggtaagggagtgaacaggaaggagtgtaggtagaaaaactgagaaaataaacagctggagaagtgaggaaagggtgctgcaaagtggggagagaaggagagaggcagagagggaaggaacaagagagagaaagagagacggggagccagagagacggagagagatgtcagtgattctcttgggggggctgtgatgagaacaagctattgtgatttaggggcttctggaaagccccaggtgaaggttcagtccatggcctgtgaacacacagagcatggggatcggttctcccatctaggtaggacatggagagtgaacagcaagggaaggatcttggttcattgtctggtgctctacccaattcatggcagaatcctgccgcatgatttctgccgactagattcattacgtcgctgaagagcgtgtttattgtaaggcttcattctggagagaaagtagcaggaagcaaaggaatgcacacttcttgagtcctgttcagttccagggaacatgccgatgcggccggaggcccatggaggcaaggtgtctggcccaagctctcacggctgtgaacctgggtccctggggttccaaaggctttgcccgctcccctggcctccaggctcttatgtgttggtgtccataggaaaaaaggtgtcatacatcggtgtcaggcaagagtcttccaagtcagctgagctgggagaattccccggcccacaccctgctctgatctgggaatcgaatgtgataatggagtcaaccttgtctctcaaatcactgaaacctgtagacaatccacaaggatcctttctaccttagtgtcaccttcttcccccaggactttcgagtagagctatccaagggctgcagaatgcacatgccagagagagctggcttcttcatgatgatgattatactaattaaaatgaaacaggagtaggagacagaggccttgtttgctacccagtgggttatgcattcccaggggaagggaattggctcttgtcgcgcttctccagttaccagctgggaataagggaagcccatggagacggttcctggtggaggagatggagcagtgggccaaggctcaggtggctcatatccaataatcctggccctacctagggccctgggagccctgtcagttgtgggaagtctctgagtgtcatctgtaaaacagggaaataatcatgatggtcatgatgccactgttgtgacggttatttgagtatcaaataaggtcaagaatccaaaagcaccttgaggaccttaaatgtttcttcaatcacaagtttctctttgttgggacaagcaaaatttggaaagtagagggcctagctgtgaaccctgctgggaattccaatgagatctttctttctttgttcttttgtgagttcatttattcattcagtgaacattcatttggtgcccactcataagatgctgaggttacaactgttaataagatattaagatactgtctttttcttcctctttctctcttacacacacacacacacacacacacacacactttttgggccaactggaaattcatacattctccccagcactggagctcaaagcgtctgccaacctgtgggtttcttttccgtgtggttcaccatctggagtggcaacctgccttctgtgtgtgtgtgtgtgtgtgtgtgtgtgtgtgtgtgtgtgtgtgtgcgcgcgcgcacgcatgcacgtgcgtgcatgccagggtattgtgttccctttctgtgcttgagaggctgaatgaacaagagaagagcaaaggcaaagaggacaatgcccagaagtcatcctcgcagtatgaatgaataattcatattgtatctgcctctttctagggcttcccaaaatagctgttttaattgcttatttgtttcactgctgactttattccagccgccttcagctcagaacacttcggtgtttcatgttgacttgcaggtagggcttcccttcagggaataacattctatttattttcttctttaaaaagaaatgatgggagaaaaacccataaagcaagtcatacttttcagaggcgaaaactgtttcttttccactgttgtgcagagctcctttgtaatcagttactgtaggcctctgtggtcctaaaaaccaaagaaatagcagtcgagttgcagacaaggcgagcttctggctagagcagcctgctcactgtgatgtgttcacttgggaatctgagtgtgcaaacacttgggaatccacagacttgggacccttgcatgtggtgggccatgctggcttgtggttttccagacatgtcagctgcagcatccggaacaggtctcaggaaggccctgtctatctgggtgggtgacctggggaaacagtgtcatgtctccctggggccctgataggacacctttggtaggcaatgcacagcttagtttagaaaaggcttcatacagtggtcctggagggatgacttattgtatacaataaggagatgtcaggaggtgtgttcagagaatgaatgaggatgggcaaggagagctcggtgagtgtcagggaacctgagtgtccagaaggatccactcctctggctgcgtgaccccaaacacatccttgggacacagtcatggaaactcagtgctgaaaggtcctgtagccatcactttgtcatctcatggtagggatgggaaaacagcagcccaggggctgggaaggtgcccacagccactcagtagtatagctgaggattgataccagttggatttgcctctcaactagctgagtgtccttggatgaaccagttaacctctctgtgcctcagtttctacatctataaaatggagctaataatactgtgtataagattgttttaaataagctaatatgttgcattgaattgacgattttcttttttcttacaactttattgaggaatttttgaagtctactaaatggtatgtgtttaaacaattttatgagctttgacacgcatatatatatatatatgtacacatacatacatgtatacgtacacatgtaggaactcctcatcataatcagtataacaaaccttatctccaaaacttttcttgtgcccctctgtaatcctctccctctaaccctcctccccaggcaaccactgacctgctttctgcccctgtagttaatttgttttttctagaatttcatataaatggaatcacacaatatatggtttttgttgttgttggtggtggtggggtgtgtgtgtgtgtgtgtgtgtgtgtgtgtgtgtgtgttcgagacagactctcactctgtcacccaggctggagtgcagtggcacgatctgggttcactgcaacctctacttcctcagctccaaggatcctctcacctccacctcccaagtagctgggactacaggtacgcgccaccatgtctggctaatttttttgtattggagagacagggttccaccatgttgcccgggctagtgttgcactcctgagctcaggtgatccacccacctcaacgtccccaagtgctgggattagaggcgtgagccaccacgtctggcctatacactatagagttttttacctaatatgtgtctgaaattaatcttcattactgcatattttaatagtttattcctttttattgctgagtagtattctgttgtttggctgtaccacagttgtctatccatttacctattgatggacatatggattgtttctagcttggggtttttataaataaagataatattgattttaagaagcaccattattgtatgtgccataagaaagggaaattgtgccaattaaactatgtcccaatgtttttatgtaattagaatgcttattttatatttgttgaaatacatttttcaaggttagttttttttgttttttcttttttaactcacatatcacttgtatgtgtaaaaaacccacaaaggaatatatgagaaaaataaaactctggtattcctacagtgtcttcccattcagaatccagttcttcggagtagctttttagctgagttattaatgtctgtgcttttaatattgtcctttgtgcccttaagagtgttagtcatacagccttgttataaagacccacaaaaagggactcaaagcttggcaattctgtagaggtagccagcttaagagtcctgctttgggaatgttgctaaacaggtctgttgcataccttctccacacctttccacaaccatttggttcctaggggttaaaagtgcttacaactttattgaggaatttttgaattcctcaatgtcttgtctgtgggatttttatcccaagcctgtagcacccgttccaccagtggcagtgctgatgcctttgatatatgtgcacacacaggcagtgacagctccatcaggactgcagcctaggtgatatcagttgtaagatgtcagtagtagtagcatacatcagagtttcagaaaatgctgaatgtgtttaaaaatgtgcatcttttggtgaaatagggtctatgtaagggacattggatagtgcctggcattttgcaaatactcaatgaaattttgcttttattattattattgctattactattaagcctcagtttcctgttggtgaaattggggtgattgtacctgcctcacagaaatattgttagaataaaggaagcgatctattttacatggagcatatggtcctgtgcctagtgcttcactggccttaagtggaagctgccctgacctttgggacaggttggccaggtattagactaaagctgcagagggtgccttaggggtgttaaattctagcttcctctgttttgcaggtgggaaagaccaagagaaagggttaaggtccagcaacaggagtgccttgcccaagggcatcgtcaggcttcaaacccagatctcatcattcttcttccagtgctctgtctaaaccatgcagtcttgggaggggccccaagtcagacaggatctcagaaaagtcttcacggtcaattccatttctagaaggaccagctcctcaagctgtgtggtaagggtcagagctcaaggagcagaagattctggaatggccaaattccaggacagggtgagctgctgcctctgcagttactgctgatgaggcttctagacagcccagcacctgggaagagcccttgggaacccagctcatgaggctggaaggaataaggctgggagttgagtgtccccagagtcctaaatacagaaaggagtagggctgcaggcctgcctggggttgtgtgccaggtgctgtgttgagtcttgtccgtgcatgaatgaatgcaagaacctgggaagcaggttttcttgtctgctctatacctgcaggaaaactgaggctcagacctgggggaaggaatggactgagattacacagctaggaaggatggaactgggagtcctctctggttctgttggctttttctttagggcacagagcttccatagcctaactcataattcaggaatgaggatgaagctggggttgagcagggtgaggagcaaaaagatattccagggtcttcattctactgtggtgtggggcttttaggaaattaccttccaagtaggtaatgagaaaaatgaagagcccacctcccaacctcgtctctccatgaatgggagcttcatagttctccatcttggttcctacccaatgatcagtctcattcggtataatagggttagttagcctgggaaaatgctatcaatacctatttcttggaggctgttcagatgcttattgaatttcaaatggagccaagcccagcaccaagctgatttgatctcctggcattatgtgatgcagggctggagttggtccccaggtcccctgggtccttgggtggctccaggcaagtcttttatctctgtccctcagtttcctcattggtaaagaaagggagttgttttgttgggtttcttttaattttaacattctctacgttgggggcctcatttgggcagcagtgtgaaaaataaatcactgggtgcggtggctcacgcctgtaatcccagcactttgggaggctgaagtaggtggatcacatgaggtcaggagtttgagaccagcctggccaacatggtgaaaccccatctctactaaaaatagaaaaaattagccgggcatggtggcaggcgcctgtggtcccagctacttgggaggctgaggcaggagaatcgcttgaacccgggaggcagaggttgcagtgagcctagaccgtgccaatgctctccagcctgggcaacaagagtgaaactccatctcaaaagataaataaataaataaatgaaaaacgaatcactcacatttatcaagcactcactgtgtactcatgtgctgtttcatgcattatctcatgtaagcttcaaggagcactgtggggcaggtctgaatggtacctgcctgaaagggctgttgtgaaggccagctgagtaaatatataaatacattaactgcttggaacagttgctggtgcatagtgagtgctcagtatatgtgttcttatttttcctgttttgcaaatgtgacaactgagccacatagagtttacatatcttgtccaaggtcacacagctagaaaatgacagagcctggattcaaagccagtgagtctggctccagagccctctgctcttaaccaagaggcaggagtgacacattagaaagcaatggggacaaagtgcatccagacagtgcctgtccccaaaggtgtgctaagtccgtttttaaaatatagcactgtagtagatcaacaaacatatcttcaggctgaatttggccctcaggttgtccgttggctttacctactctaatccatgatttggttctcagaactgaaatcttaaacccaacaggcagcacacagaggggattagcagcctggattcaccccatgtcagtgagtgggaacagataagcatagagactcaagatggaggtgaaggaaggggatggacccaaagggcacaggtgtgtgatctcaccaacccagcagggcagagggaagacagaatccaagatttggcagtggggaggtgagccactggtttgtgggggcctagtctgaaggtagggagggtttggggtggaggaaccgtctggaatctcccctccagccctccctcctcttcttttttctataaaagaattttaggatgggaataactaggccaagaaaacttctgggtaagccagcccaaacagagtagggaaacaaggagatctaagggtggaaaagccagaattttgagacaggtgttcggagggtagagaacaagaggaagggaagtgtttacgagaagaagaacttgggaattccaggtataaatgcctcctccttcagagagcagattttgagaaccaaatccaattcagctactgtctcctaccttctcccatttaactttctaaaaagagagaggaagccaggtgtggtggctcacacctgtaatcccagaattttgggaggccgaggcaggaggatcacttgaggtcaggagtttgagaccagactgacaaacatggggaaatcccgcctctactaaaagtacaaaaattagcccggcatggtggcgggcacctgtagtcccagctactcaggaggctgaggcaggaaaatcacttgaaccctgggaggtagagattgcagtgagcttagatcacgccactgtactccagcctgggtgacagagccagactctgtctcaaaaaaaaaaaaaaaaaaaaaaagatggtttaagcagtcccagctcctccaggaagggaggtgatagaatacagtgcaaggtttattagctgtgcaagccaggacaattattttgcttcagtttccccatcatgaaaatcggggtataaaacctaactcatcctaacagccaatgtagattgaaccctgaatgccatgtggtcagcacagcccattttaacgcagcggtgactttgagcacccccatcttatggatgaggaaacaaagccacacaggttagagttcatgcccaaggggacagagctaatgagtgacagtgcctgcattgggacccagatggctgactccagacttgtgagttttaaccaccaccgtgtatctcttagggtgaagactgataatggtgggtgtggtgatggtggtgatgatagctcacgtgttaaggatttgagataaagggtgatgtgattcttcacaacgcgcagaactctctgattatgtttgcaacccacatttatcaagggcttgtcttgtgccagtcccggcactagatactgtataggttatctcatttaatccccacaacacccttatgagagtgggccttcctgtgtaagtttcacagagaagaaaactcctctcaagcaggttacataacccacctacagttctggaagaggtggagcctgggtttcagcctcgcatcccattcctgagcctttgtgggtaacatctaccctgcctcctccttaaccatggagctgaccacagctctttcctcctcccctccccagccctccctgactacaccccattgctgcattctctccctgcccatggcccgttggcctttcgcgtctatactgctgacgtagcaccttattaaatatccctgcatcctctaattacctgtggctcaggccgcgggtagcgttacagccacatacactcccatggaatgttgtggggatgactccctgcctgtttggagtgtgagtcttgttccccggccagaccctctgcccctggaagcagaaacatggcttcttcaagcgtctgagccctcgtagtgcctagcatgggcctggagtgccatactcacttgataaatgcttgttgcttggtggattgattgaaatgagggtggaaggatgagagtggagggtgaggcagagagtgtctctgggtcaccctccagctcaacacaagggcagtggtcagaggaataatccaaagtgcatacccaggccccagagccgccaaagctgacctccgcctccacttcacctgaatagcatggatctctctgaaatggccctcttgatttgcttctggctggggtgcatctcgccctctagactgtaagggcagggccctatctgtctctttcctctgtagctggtgttaacgaaggctctgctgtgtgtcatgtgctcagctctcctaacaaacttgagagatggttatttttatcatgcccagatttgttagacaatgagtaaaagagtctgaaccaaactgaattaaaggaagaaggacttcaaacgttgcctttcttcctgttcattctggcctccccggagctaaaggtgaagggactgcttagaaatggtgttctgcagcagccccaggtgaaggagcattatcaggaattgtgcaaccttagctatgggaactatgcgtgtgaaacagcccagggcgggaagaaccagcctggccattgtgcctgggctggggaggagaggttcggctgaaagtttggacagttcttggcttggagtctggagggccctttagaaagtgatcccgcccagccagccctcagagagagcaggccagcatcctgctggacggtaataaagaggttactgtgggaagctgggacttgcttgggaaacactaggaacatgaaagatagggtatgcattcttcagtcccgagagaatcaccacccagtattaaacttggcagaaggctttcctctcctcctctgagctgcctccttagaaaaggcacattgtcagaatgccgaatgcccaccgtggtctcatgtcctcacagcccgtaggaaagtaactaccagttacccactggtggttgcccctgagaggagggtaagggaggcttccagcccccggggtggctctccccgacaggtgtgcctgtgtgctgtttgtagggtgctcctggcagaacctacctgtctccacagcgacacatctggccgtttttccaggagggcctgttgagaaacattcaggaatgtttgtgctcctttagagatttgtaattaagaagaggcagaactcgttcttgtctggcaccctcccttcttgcccctccagcatctgggtcatttgatttcacaattggggttttcggcagcccgagttgtggaggctggaagcagggaccgactgaaccaggctggatggtggtgaattgcttcacccgagggtgggggctgggagttccaggcaggcccccaagtcctggccacatctgaaagtggacatttcttcccaggttgcatccttagcacttgcccaaggtgaaacatttcaggccagtggagcacccacagttcctgggggacggggggtggctggtttaaatggacaattcctctccttaactgccaggaagagtgagtgtgtgcatgtatgtatgtgtgagtgtgtctgtttaaatctttgtgcagccaaaaacacatctcttcatcctgaatgacacatctctacacactgaataattcatctccctcttggcatttgttccggagagaatcttgctgtccagatttcttgtaagttgcatagccttccataggcacttccttgtttcccatggaagagctctgggagtcaggatatcagtcagtcagccctctggcatttcccctgtgatcgcatcaaaggggaatgagaatatcaaacccaaagtgtttctctctcctttgccctctccttctagctttgggtcctcttgcctccctctgctttatttctcttgggcacagtgtctgtgttcactgcaagtggaatcagcattgtgtcctggtagggtatccacatgtctgtcacattactgatgcttggagcgaataaatgtatttggctctgacatctcaacgtgtaaggctggaacaatcagtggagttaatggttttccagatagtgacacattttcggggtttcagtcccgtcctcctaaccccatctccatcctcacacccagcaagctcagtaaatcatttgtattaatgactttgaaacactttttttttttttttttttttttttgagatggaatcttgctctggagtgcagtggtgtgatctcagctcactgcagcctccgcctcccaggttcaagcgattctcctggctcagcctcccgagtagctgggattacaagtgcctgccaccatgcccagctaatttttgtatttttaatagagatggagtttcaccatgtttgccaggctggtcttgaactcctgacctcgggtgatccacccgcctcagcctcccaaatgctgagattacaggtgtgagccactgcacccagccgactttgaaacacttaattgcctctttattaagcagccatggatttcccaggtctattgaatatccttgcaccaacacatagataactgaaggtcccaaatatgctaaagcccccatgccttttgcctgcttcagatgtccctcttgtctcatttcaccttctgtatctctagcacagcttgctctgtgttccagattgttctgagactcacccttcgtcttgttattttttatttatttacttatttattttgagacggagtcttgctctgtcccccaggctggagtgcagtggcgggatctcggctcactgcaagctccgcctcccgggttcacgccattctcctgcctcagcctcccgagtagctgggactacaggcgcccgccactgcgcccggctaattttttgtatttttagtagagaaggggtttcaccgtggtctcgatctcctgacctcgtgatccgcccgcctcggcctcccaaagtgctgggattacaggcatgagccactgcgcctggcccagtcttgttaatttttattagcagagctcgagttttggaatctggcagtggaacttcaggttatacctgtggtgtttactaactgtgtgatgccgagcatgttttcttatttgcaaaacagagtaagagcacctgctacctggaaagggaatgtcacatacacagcttgctttctaggcctagagttagcccttattcaacattttagttatgattaatatatgaacacaacaaataaattaataaaaaaaaagaaagagaagaaataaaattacactgaaatccctatattcagatagcgtttcaatctgtgtctttccagtttctttactaacacacacacacacactctcttcaggcaaaatgtcatactgtaacagtatcctgtagcttttatctttgaacagtgttgtttttctcagagtatattgagagcatctttcatgttagcaaaataaagaacacttcatctttttttttttttttttgagacggagttttgttcttgttacccaggctggagtgcaacggcacgatctcggctcatcgcaacctccacctcccgggttcaagtgcttctcctgcctctgcctcccaagtagctgggattacaggtgtaagccaccacacctggccagaacacttcatcttttttggttgttcctacatattcattacattattcacccattgcacaaatatttattgagcaccaattatgccagacacaggattctgtagcttggatgcaccactgattaaaatcacttaattaatctccaaggaggaattttgaaaagtgatgatctatacgcagaaacaggggagctgttgggaaggggacgtatcttcttggttttctgggttgcaaactgtctatataagattcatacctcttctggtaggtgggacttctctgggcacagtgcaggtggaggaatgagccagaatgatctctctggtggcctgaccatgcctgtttccccacagattgacctgtcatcagccatggagtcactccccatggaaggcatacctgcgtgtggagctttccttcagagcccctttcaaggctttgttagatgaggtgatgttagatgaggctttgctcttggttgctggtcttcattctccataaggaagagggaacaaaccacttaaaaaactttaagcaagacactgagagaagtggccttttgtttctgacatctggcagggcatggagggtggtggcgggtggcctggagacggctttggggaaacttcatccaggtcgtttggagcagatgctcctgaaccaagtgcatcctgagctgagggaagtccccatcacctgtgtctaccccattttccctccttctactccaaaatggtagtttgtgttttcccgtggggcttaggagatgcaatgaaggtgtcagctttcaagataatctggtagctccctgcaggggccctagagaccagccatcttgcttgaaatcccagctttgtctttgacattgagaatgttatttagtctttcttagcctcagtttctccttctggtaaatggaggtaaggataactaatgatttttgagtgcccattcacactagcacctgtgctaaaagtactcacaaacatggccttatttaacccacccaacaaatggagagttagtactgtcctcattatacagataagaatactgaagctcagagaaggaaagtaagttgcctaactcacacagccagtaagtgatgcttactgaacccttatttgttttgttgttgttgttggtggtggtggtggtgttttagagtcagggtctggctctgttgcccagcttgtaatgcagtggtgccatcacagctaactgcagcctccaactcctgggctcaagcagttcttccacctcagcctcccaagtagctgggactacaggtgtgtaccaccatacccggctaatttagcacatagtgtattgcacatcacatacctctggcctcatcctcatggaaccagcagccttccacagtgcagcagtaaattactatcagaagcttttgggtattcattcaaccaaaaggtatttttcatagcctgccagaccctgggtatatagtggtacgtgaacacaccaggtcctatccagctggggctctttcagcatccctttcttcatgtatttttctgtaagttggatttggagtgagttttagagggcaggagagtgtaagcctctttttttggtttttcctatgtattcattacattattcactcattgtgcaatttttttttttttttttttttttgagacagagtttcacattgtcacccaggctggagtgcagtagtgtgatctcggctcagtgcaccctccacttcccaggttcaagcaattctcctgcctcagcctcctgagtagctgggattacaggcaccagccaccatgcccagctaatttttgcatttttagtagagagagtttcaccacattgagcaggctggtctcaaactcctgacctcaagtgatccacccacctcagcctcccaaagtgctgggattataggcatgaatcactgcgctgggccccgttgcacaaatacttattgagcgccaattgtgctggacacaggattctgtagcttggttgcaccattgattaaaatcatttaattaatccccaagaaggaatttaaaaggtgatgatccatatgcagcagcaggggagctgttgggaggggacatatctagcaagtctcttccttggaaggaagcccttgatgagaaatcctagaccccagcccagtcatctcccgtcctgtcccgttgtacttcactttgccagtctatagaaagaatctgaagcagagccttctgggcttccagaattgggattgggtaggaagcagacaggagaaggagattgtagaatatgtattttaggcagaggcagtgatgggaagaaaccaaagtgactgtctggaggggccacccaggctgaatctcatatacccagattcccagcttcccatactctggtttaaatacttgacaaattgtttgtgatagttttctagcactgacaagcctttgttagtttagttgagtgatttgtttatttgatttagccattgagacttggtgattactaccactttgatccccacaagatggggacatagagagcggttattgctaaaagatcagtttggcctggattgtctaaggaagcgccattgtgggtgcaagcatttgggaatcagctcaagaggaaaataaatactgctcattggccaaactcacagggatggaacatctgctattcttgatgttgcggcaagccagccttccaaagggcaagtgagcatgacaggcgtgagacagagccaggataaggattagaggtggggtggctgagtgcgttgcaggtgaagaagccaaggagggctggagtccaactcaagaagcaagacttgaccttagaccctttgcctgcaaaccctcaatcagagttgcagaaacagaggcccaaagaaggaagttgacttgctccagtcacttctgaaggagtggcaaagttgggaccagaacacagattccctgcctcccacacagggtgatcttatcctgctgctgcagctatgtgttcaccttcccgggaacaaaggggacaacagagctggtgctgctgtggtgtaaaacttttggatctgttgagccagcccagaaaagcaggaggcacagggaagcagcaggttgcaggcatttggggactgtaggctgatggagtctgtttctcctctcccttgccaggtacaccaaaccgctcacctttgctgactgcattagtgatgagttgccgctaggatgggaagaggcatatgacccacaggttggagattacttcatagaccacaacaccagtaagttcccgacggtcctcccttccctgtgccctcttcatccctccacctccaagcccatcctccctccaagtctggaagaaccacttgcagactcttggagccagattgtattttgttttatatagatttagatagaaatgtcgatgtagatatagatagataatgtatgcttgtgtaaaaataacagtttagaagggtttttaatagaatctaaaactcctctcacaatccatctccccaattttatgggggcagccactgtgaacagtttcttgtgtatcattccagaaattttctaatcatgtgtttgtatgtgtgtatgtgtatatatgcacatatatatttacatatgtaaatttgtgggcataccttttcttccccctaaaagaaagatgtgtcattgtcattgccagactatcttagagcagccagagccctagcaggccccccacagcatgtatgcatatatgtccatagtgaattggcgagagagagagagagagagaaagagtgtgtttgtgtgtgtgtgtgtgtgtgtgtgtgtgtgtgtgtgtgtgtctggcccatcataccagtcagcccaccctcacttcatatctgtgatccaagtatcccaatccgttacaaagattcctagtacctctgtctctgggactgtgatggaggaatgacttgaggaaagaagcaggttgtctgacaggtggaggaacccagggagcaatcctccagcgggggagagttgatgtgtgtttgggcctcatccactgagcaccctcttggccaagactgttctctgaaatttgctgtcccacttgtgcatgtgtacagaggaaagggatttttcagcctcactctcagccttctaaactgtagcatccccttaatcctctcaggcaagaagaaaatagaatgaaatgggatgtgcctggcaaagtctgaaggctgagactagggcatcaaatcctaatagcctctgtttactgagcacacagtctgtgccgtgtcctgtgctgaggacttgataggcattatctcttttaatcctcccaattcctggtgggatgttcagatgatcatccccatgtcataaatgggatttagagtcaattgactacttaagactcacagctaaaatgtggcagggctgggattggaactggccctggagaatgaagttgtacttctccacctacttcctcttctgggtttcagtagcaccctggccacacctgtcttgtgcccttcatcaccctgtattataatcatttgcctgttgttgcaggtctcctagagcagagactgtgtctaattcatctctctagtcccaggcctttgcctggtaaggcacatagtaggtgtgaacttaacctgtgctaaatagaaaagggcatacgtgcatgaatgcatgaataaatgggtgaatgagtggactgttgttggcaccaaagtgtagaagagcttctgagagacagctaatggcattaattgcattgttgggggtagcaaaggtttttattagcactcatgattgcgtactggataatgagaagtaaatatgcctaattgagtgtgtatggggaatgaggttaatgcttggagggctgcatgggatgctgggttaaacactgatgtgcaggagacctaatcagtcttttcctgtttctaattgctgagtgcatccccctcattaaaatctcatggtgggagtgggatttcaaggtgcttctgggagctgttggaaaaatggaagaaagtagtagcaggccgtggcagagtttattcttgagggaatgaaggcagaaatggggtgtatgggggtgattaaatggggccatagcaggaagaattctatctggtagtttcacaagctgtcaggctactggtttcctcttggtttgaggtggtctggttggatgtgggggaccacctcagtagatggagccattgatagcaatatagtaggaatatgagcaccaaggcccaggcattcagagccatgcacttggaccagttctgtgtgtgcattgttcatggactgaaattctcttaagagttatagacacaatatcgggcatgtttgcatgtgtctatagtcccaggtacttgggaggctgaggcaggaagatcatttgaacccaggagttcaaggctagtctgggcaacatagcaaggccttgtctcttaaaaaaaaaaaaaaaaaaaaaaaaaaaaaaaaaaaggtgggggtgtgctgggcgcagtggctcacgcctgtaatcccagcactttgggaggccgaggtgggcggatcacgaggtcaggaggtcgagaccattctggctaacagagtgaaaccccatctctattaaaaatacaaaaaattagctgggcgtggtggcgggcatctgtaatcccagctgctcaggaggctgaggcaggagaatggcatgaaccctggaagcggagcttgcagtgagccgagatcccgccactgcactccagcctgggcaacagagcgagattctgtaccaaaaaaaaaaaaaaaaaaagagagagaggtatagcacaatataatcaaacaacaattcgctcatacattcaccatcgagcattcattcatttagcaaatgtttattggccaactcttctgggagcttgcgatacatgggagtacaaaatggcaaagatccttgctcttatagaaatttcattttggcaggagagacaaaaaataaataagtagattatgtagtatgttagagaatgttcagtacacagaaaaaaggagcaaagtcgggagctgaggtgtatttgggggtggcgaagaaagggccgtggtaatggtgaccaagagtaccattaaatatgatgtggtcttccgggaagaagatcttgttgagacaatgagatttgagctaagacttgaaggaggtgagagagcatttcaaatagaaagcatagatagaagaagaactccaaggtgtgatcacatttagcggtcaagggatagcaaagaggcaagtgtgcatataacataatgagtgaggagaggggagaaggacatcaggacagagtgcagcagagtagaggtcaggcagtggtctgccccagaggcctagctcttccgctgtgtgagatgggagtgagccattggagagttttaaacagatgagtaacatgatctgacttatgtcttaaaaggaccagtctgactgccatgctgagaatacaccttattagggcaagggtggaggcaaggagacttgtgagcgacaaatgccacagtccaggcgccctagacctgggctgtagcaatggtcagggtgaagattggccagatgctggaggtattctctaggtagagacagcaggatttcccgatagattgcatgtaaagtatgaaagaaaaaggaaagaataacttctggagctgagcaactagaaggatggagttgctatcaaccaagtggagaaaactgcagggggagtagacttaggaaggaagagcaggagttcatttggacatgtcaagacttacatgtctattacctatctgagaggacatgtggcttgacagtttgatatataaacctggagtttaggagagaggtctgggctgaagataagtatttgagagttgctggcatatagctagtatgtaaagacactaagttggttgggaatgaaacagagaagaggaccaaggaataagtcatgggtctccagacaacagagggtggcaagaagaggaaaagcagcaatgattctgagaaagagtgatcagaaaggagggagggaaaccgagtgtgttggaagccacgtgaaggaaacatatcaagcagagaattgccgacagtgtcgaaggcttctgacagggcaaatacaaagaggaccaaggataaaccaatagatttagcaacctgggtgacctgactttggagggcagctttggacgaggactgggagcaaaagcctgactagagtgagtctaaaagaaaacaggggaggaattggaagcagcaatgcagacaactctttctttttttttgtttttttcttttcttttcttctttttttttagacgaagtctcgctctgtcgcccaggctggagtacagtggcagatcttgtctcactgcaacctccaccttccgggttcaagcaattctcctgcctcagcctcccaagtagctgggattgcaggtgcccgccaccacgcccagctcatttttgtaattttagtggagacagggtttcaccttgttggccaggctggtctcaaactcctaacctcaggtgatctgcccaccttggcctcccaaagtgctgggaatacagacgtgagccaccatgcccagcctacagacaactgtttctaaaacataagccatttttactatttcatgtcagtattcagtatccccgattatctacacataccatgattagatggttttaatcagtgatcaaattttatgtctgttttcttttcatactatatcatagatatctaagggatgctatataatcttcatatttgtcttttttttttttcttctagacagagtcttgctctgtccccaggctgtagtgcagtgatgtgatcttggctcactgcaacctccgcctcccgagttcaaacaattctcctgcctcagcctcctgaatagctggaattacaggcatgtgccatcatgcctagctaatttttgtatttttagtagagatggggtttcaccatgttggccaggctggtttcaaactcctgaccgcaggtgatcctcctgcctgggcctcccaaagtgctgggattacaggcgtgagctgctgtgcctggcccatatttgtcatttttaatacatcaaaaggatgtgtcaatacattttaacacataatggaggaagtcctagccagagcaatcaaggcaagagaaagaaatagaagatacccaaataggaaaagaagaagtcaaagtatctctcttcgctgatgatttgattctatacctagacaaccctaaagattctgccaaaagacttctagaactgataaatgatttcagcaaagtttcaggatacaaaataaatgtaaaaaaatcaatagcatttctgtaaaccaataatgttcaaactgagaaccaaatcaagaacgcaatcccatttacagtagccacacacaaaaaaaaaatacctaggaatacatctagccaaggaggtgaaagatatatacaaggagaactactaaacactgctgaaagaaatcacaggtgacacaaacaaatggaaaaacgttccgtgctcatggattggaagaatcaatattgtttaaatggccatactgcataaagcaatctgcagattgagtgctattcatatcaaactaccagcatcatttttcacagaattagaaaaaactattctaaattcatttcgagccagaaaagagtccaaacggccaaagcaaatctaagcaaaaagaacaaagccagaggcatcatattatccaacttcaaactatactataaggctgcagtatccaaaacagcatgatactagtacaaaagcaggcacgtagatcaatggaacagaatagagaatttagaataaagccgcacacctacagctatttgatcttcaactaagtcgacaaaaatatgcagtggggaaaggacttcctgttcaataaatggtgttgggatagctggcgagccatatgcaaaagaataaaactggacccctaccttttaccatatacaaaagttaactcaaaatggattaaagatttaaatgtaagacctcaaactataagaggcctagaagagaacctagaaaacaccattctgtacattggccttgagaaagaatttatgagtaagtcctcaaaagcaattgcaacaaaaactaaaattgacaaatgggacctaattaaactaaagagcttctgcacagcaaaagaagctatcaacagagtaaacagaaaacctatggagtgggagaaaatatttgtaaactatgcatccagtaaaggtctaatatccagaatctataaggaacttaaaaaattcaacaagcaaaaaacaaataaccccattagaaagtgagcaaaacaataaacagacacttctcaaaagaagacataaaagaggctaacaaacatatgaaaaaatgctccacatccgtgatcatcagagaaatgcaaatcaaaaccacagcgagataccatctcacaccagtcagaatggctgttattaaagagtcaaaaaacaacagatgctggtgaggatgtggagaaaagagaacacttatatgctgtcagtgggaatgtaaattagttcagccactgtggaaagcagtttggagatttttcaaagaacttagaactaccattcaacccagcagtcctattactaggtatatatccaaaaggaaagatatcactctaccaaaaagacacatgcactcatatgttcatcacagtactattcctaatatcaaagacatggcatcaaccttagtgcccatcagcagtggattgaataaagcagatgtggtacatatacaccatggaatactatacagtcattaaaaagaaaaaatcatgtcctttgctgcaacatggatgcagttggaggccattattctaagcaaattaatacaaggacaaacactcaaataccacttgttctcactttatttttttgagagtgggagctaaacaatgggtacttatcgacataaaagatggcagcaataggcactaggggctactagagagggtagggagatgggggcaaaggttgaaaaactacctattaggtactatgcacagtataccccaaacctcagcatcatgcaatacatccatgtaacaaacatgcacaggtaccccctgaatctaaaatttaaaagttaaattttttaaaaagggaaaaataaaacacataatggaagtaccataatgcttcctattgccaaccttttggtttattttcatttattattttaaatagcactcagggaagactctttgtgtatgttactttctttgtgataatttcctgaaaattcatttccaagtataggattttgaagtcaaagttataaataccttgggagcttttagtatatattgctagattggtgaatatttccaaaagattatatcagcttgtattgccacaagacatgagggtactgttttcctcagaccttcatcagtatggggctatgttcgtttcttttgacttttgatacatatatcataggtttaaactcttacttcattgttttgaatttgcactcctttgcatagtaacaaggttgaatattctccagatgtttttaagagaattgcttttgttgttgctaaggcccttggaaaatgcagtattgttagcggcgtgggtgtgtatgcagtgtggagaaaacaggtgtgtggcaagtgtaggaagggatgggtgtatggagaactcatgagtgtgctgccatgtgtgctgtgtggagaatgtgtatggcgtgtgtttgtagggagaggtttagagcatggagcagaagaaagtggagaagtggttctcaatgatgcctgcactagagcagatacaagtttggaaagtagctgcttttggaaagagggatatgagggagatgttttatgtaggaaattttatagtgcactgaattattaagctatatctatgtatacttttaattaaaacaagaactaaaatgtagtagtggccaagatgatctcaaagggcctgccagttacaaagttacctattttggtaagatggacttgaggaagggtagtgtcagcagaaggggctgggctgtcggaggaccccctcagggtgtgacagttcagaactaacggcattaacacaactcttttttttatttttttgagacggagtttcactcttgtcacccaggctggagtgcaatggcgcgatcttggctcactgcaacctctgcctcctgggttcaagcgattctcctgcctcagtctcctgagtagctgggattacaggcatacaccaccacacccagctaatttttgtatttttaatagagatggggtttcgccatgttggtcaggctggtcttgaactcctgacctcaagtgatccacctgcctcggcctcccaaagtgctggtattacaggcatgagccactgcatccagccaacacagctctttagaaccatgtaaagaacttttaaaaggcccaatgcccttgaaggataatcttttcaacagttgttggtacaactggtatccatatggaaaaaaaataggccaccacttctacctttgcctcacaccatgtgtaaaactaaactcaaaatagatcatagacctaaacataaaagctaaaattataaaacatctagaagaaaacataggagaaaatctgcaagattttatgataggcaaagatttttttggacaagtcataaaaagcactaaccagaaaagaaaaattaataaatttggtttcatcaaattaaaatctttgttcctcaaaagacattattaagaaactgaaaagacaagccacagataaggagacaatattgcaatacatatctctaacaaagaaccatattccaagtatgtaaagacgtcctacaacttaacagtaagaagcagctggcacagtcgctcatgcctgtaatcccagcacttcagggtgctgaggtggagggtcacttgagcccgggagttcacgaccagccatagcaaaacataaggcagcacagggcaacacagtgagacctcatctctacaaaaataaaaatacagaatcagctggggcatggtggtacatgccaagtagtcccagctacttgggagcctgaggctggaggatcactttagcccaggagttgaagaccagcctggacagcatagtgagacccccatctcaaaaaaataaaaaaataaaattccaacgaggtatcattacatacccactataatgactaaaatgaggaaaaaaataacaataccaactgctagcaaggatgtggaagaactagaattctgatacactgctggtgagaatgtaaaatggtacaaccagtttggaaaagtttgccagtttcttatgaaattcgacatatacttgcgaagtataatccagcaattctacccctggtatttttgtccaagagaagtgaaaacatgcccacacgaagacttagagtattcatcataataatccctaactggaagcaaactaacaatttatcacaaagacaatgtgatgtattcatacaatagaatattattcagcaataataagaaatgtacaacagatacagcaataggaatgagtctcaaaaaccttctgcttagtgaaagaaccaaggccctaagagcaaataactgtgtgagtccatgcatgtgaagttctaaaacaggcaaactgggagagggggtgagtagaggaaattgcctgggagcgtccaggggatcattggggtaaaggaaatactctcagaaatgtaacaaattgatgcccacttcacactgtagatcaattcagtggaaatctctcgggtgattccagtgtgcaaccagtttgagaaccagttctggtgtgagtttgtgtgttgtttttgtctgttcgtgcacccatctattcttattggtttacaaaagagaccatgagccacaaaaaatggtcgccaagccacctggcttggccagaccttcaggtaagggtctcatatacctttatagttttacagagcagtgctgaggtctaaggccaaagggaaggtgcccgttccagatgaaatccagaacactgtgggagggtccacctaggtgtcgcttagggaactggacacgggcccagcatttcaaccagcacctgggcaggcgattccacctggagcccgcatcgcacctgccagcctcagtgaccaatcggcccatgtgtttgtcatctcttaaacaccggttctcaccttgggtggcacactggaattatttggggagctttgtaaatcatcattgctttattctcactcccagagattgggatttgattgatctggagtaggattgaaatttttaaaaaattctcccgggtgattctaatgttcaaccaggggctctcagctatatctgcaccagagtcacccagagaagctttaaaaactgtcaatacctgagccccactcctggaaattctaatttaagtgttcttcggggggtggggtggggttcaggctttttttttttttttgaagcttctctgctaattctaatatgcagcaaagacccagaatcactggatgaggcactgacttttaaaaagaaaaaaaaaaaagcaatttcactgagaatgtggggggaggcactcatgtatgctgtttttgagaacagaaattacctgcctttggaaggtaatttggtaatatctattaaaattgtaagtgtgtgtaccctctgatctagtagtttctctttaagaaacctatcccacagaattaatagcacaaattcatagacatatgtttttaagaacccttactgcagcattgaatgtagtagcaaaagaactgaaaacaattcaaatatttcccatcgaggtctggttaaataaacccaaataccatagcgtggaacactgtacaggtgtttaaaagatggtgcacctacaggcaaaaatgagcatgctatatcatttggagatgaaaacaagtcacagaccaatataaatggcatggtccatgttgcattaaagtaaccttgtatatataggcgtgtatgtgtaaacaaaaattcatgtataatcagaaggcagtatctgtgtgagactcaacaacagttacctctgggcaatgggattggagagatggaaactctcttatttcacaaacttgtcatggtggaattgtgggatttttcttttttgtacttttcattattttgtggtgaaaaatcagatcttctaaaagttgcaaactttaagaaacattgccagcctgctcaagataggctgagctgcttttttctgtgggctgtgccagctggaggtgtagggcagatccctcagggggacccacgattcctgaacgccaagggaatccacagctgctgatgggagatgggaacccacagcagctgttctgtagcccagttttacaaattccatctccgccttgtttttttgttttgtctttgtattatttttgcatttgttcctgcctcttgtttggtttgaagggatggaaagctttcctcatgaggggcagttttttgtagccactgtaagcagtcttcagaccttactttttttctcagaaaaaggaggaggaaaagcttgaagaattgctattcacagacgattcaaaaattggtcctaggctgggcacagtgcctcacgcctgtaatcccaccactttgggaggccgaggcaggtaggtcacctgaggtcaggagttcaagactagcctggttaacatggtaaaaccctgtctctactaaaaatacaaaaattagctgggcgtagtggcaggcgcctgtaatcccagctacttgggaggctgaggcagggataattactggaacccaggaggcagaggttgcagtgagccaagatcacgccactgcactccagcctgggagacagagcaagactccatctcaaaaacaaaaaaaaaaaaagaaaagaaaaaagaaaaagaaaacaacaacaatgaaaactgatcctaggcaatagtttgggttttactttcactatcatttgtttcctttacctggcacaagtgctttagtttcctgtttcctgggcagtagtgatgcagggttcattaccccctttaagagatacaaaagtagattcagagacgttaaacagcctttctgttgtaacacagcgattattggcaggaatgagaacttggccctgctgcttctttgatctttatttcactggagatgctcattggacctgtttaggaggaatgagagctaaagggcctagattgggaggcataaactccagtgttccccgggctaggcatatgacataaatgaatgaagcagaccaggttttgacagatggggtgctgggatttctgaccagttgtgaacccaaggtggccagaacttctgaatgatcaagaaaagccataaaacaggattttaatgaagatatctctccattttttacataccagtaatcaattcagaagcaatacctatctggaggctggattcaccacattgccctgattttacaatttctggcttgttgatcacccctaacaccacccaacaactgggggtgactgaggagttaatagtccatgggcattgattctttgacattattttaacctcttccatatctcgtcagctgcttttttttcagatcattagtgtatatgttttttgtacacataattttgtaaaaaataaaatatcctaaaatatcctgccacctagttggttgttgatattttcctattttctcatctttttgagaatgtacatattgattttgatagatagttatttattcggttttatgacctgcatattataagtacctttccatgttattaatttttcttcaaaggtgttatctttataatagtgcattctgtgaatatagcatacatatttgaacacttatttctgtgtgactttgagcaagttacttaacctctctacgtctcagttttctcattggtataatggggatagtaatagaatctataaggttcgtgtaaggatttaagaagtgaacatatgtaaagttcttagaacagcacttatcatagaatcaatgacatgtgcttgctacttcataatatattattattatggttttgtacaaatatatgactgaatttaaattactttttataatgaattactatagggagaattattggtcaaagggtattaacattttaaggctcttaatttgcattgtcagatagtcttctagtaaggctgttctaattcacatttccagctggctatagggtacctatttctccacatcctctgagacattagttatttttctttcctttagtcttcaccaaaggagattaccttgagcatctctaatgtccttgagcctctctgtctagattagtactcaaacctgatccttattcaggccgttctcagagattgacattgggtttggaaattgatcctggtttattcttttttttttttttttttttttcagacagagtctcattatgtcatccaggctggagtgcagtggcacgatctcagcttgctgcaacctccccctcctgggttcaagcaattcccctgccttagcctcccaagtagctgggattacaggtgcctgccaccatactggctaatttttgtatttttagtagagacggagttttaccatgttggccaggctggtctcaagctccttgacctcaagtgatccacctgcctcagcctcccaatgtgctgggattacaggcgtgagccaccacacccaaccccctggcttattatttgtttgactactccaaatggagaatcactgtcatttagtaaatgagtttgccccacttacatttattgtgatttgtctatgcattttgctttttgttttctgctagtggataccacaggccaccagcccaacagatatttgtgagatgctgacctagaatctctggggtctgttccagaaaccactcagattgaggatcctcgagtacaatggcggcgggagcaggaacatatgctgaaggattacctggtggtggcccaggaggctctgagtgcacaaaaggagatctaccaggtgaagcagcagcgcctggagcttgcacagcaggagtaccagcaactgcatgccgtctgggagcataagctgggctcccaggtcagctgtgagtacctcccactaccaccacccccaccgacaccaacagagaatggccacactgagttctgccaatattgcttctcaagtctgcccatttctcttcacctctactctttgtccaaaccaccatcttgtttactgctcttcctgctcctacctgtgccttgcagtgattcatttgccatttgcgtttcattttatttcatttgtaatcatctcagaatgccagtcggattacatatctcctcatttaaaagctttcagggactaggggaattgggaatggggaattcttagttaacgagtacagagtttcagtttgggaagaagaaaatttctagaggtggatggtagtatgttcacaacagtgtaaatgtacttaatgctactgaacaattcacttaataaatagttaaaatggtaaattttatgttgaatatatttaccgcaatttcaaaacaatcaaatgcccttcagtggcttcccctcactctttccatggcctatacagccctccgtggtcaggcccctgccagccactcttgcctcatctcatgccctcctcactaggctccagatgcactgagcccccagcccccctttctgtttccctaccccaccctgtaattttccacctcagtgccttagtatgtgccggtccccttcctagaatgctttgtcacgcatccatttgcaaggctaagtccttctcagtcttccagtctcatccttcaggtcatcacctctgagaggcctgctcggacaactctatcagaagcctctcttcctcaactctagtcttggccatggctgtctgtttatttccttcatatcacgtatcacaatacatctgcttgtatgttatcagtatttcctccaccagaccataaagttggtcagagtggggctcctatcctatccctggtacccaaaggaggagagcaagcatgccaaaatccccttgttctttttttttttttctttttcttttttttcttttgagacggagtctcgctctgttgcccaggctggagtgcagtggcgcgatctctgctcgctgcaagctccgcctcctgggttcatgccattctcctgcctcagcctccagagtagctgggactacaggcgcccgccaccacgcccagctaatttttttttgtatttttagtagagacggggtttcactgtgttagccaggatgatctcgatctcctgtcctcgtgatgcgcctgcctcagcctcccaaagtgctgggattacaggcatgagccaccgtgccctcgctctgttgcccaagctggagtgcagtggcacaatcttggctcactgtaacctccacctcccgggttccagcaattctcctgcctcagttgagattacaagcgtgagccaccacgtccagctaagttttgtatttttagtaaagacagggtttcccgatgttggccaggctgttcttgaactcctgacctcaggtgatccacgtgcctcagcctcccaaagtgctgggattacaggtgtgagccaccatgccaagcctcactgtttctaataaccaaattgttcctgtatttattgagtctctgtttcatgccagacactctgctatagtctgaatatgctatttctgttaattctcataacagttctgtgagcaagaacaattaatatcacccttttacagattaggaaactgaggcttaggatcaacaatgtgcccagggtcttacagctggtgagagatagtggtaacttgcaaatccattctgttgtccccacagtattttcagtgtgggccaggccacagggactagcatcagggcatggtgtcagggtggccatggctgggttgggccattgaactctcccctagtgtgaagcccttactttgagaagttctttctgctaccaagacaggacaaaccttgccagggtacttactgtcccagccctccctttttccttagcagctcaggaaaaccctcaggatctcagaggttatagaaaagaactgtgttacattcattagctattctgtgtcaagtaatgttctggagacttttagaaggttttagcacttaatctgtcttagtcgactcgagctgccataataaaataccatagattgggtggcttaaacgttacacatttatcttcttacagttctagagcctggacgtctgagattcgggtactagcatggtcgagttctggtgagggctgtcttcccggcttgcagacaactgccttctctagtgcctctttctattagggcactaatcccatcgtgaggagcctaccctcaagacctcatttaagcctgactatttccccaaagcctcatcttcaaatactatcactttggggattaggacatcaatgtattatatttatttgggagagacacaattcagtccgtaccatttttgttaagacggtcctggaagggagatgttattgtccctgttgaacctcaggtttaaaggggcaaagtgatttctctctctctctctctaaagtcccacagtttgaaaaagtgtcaggtgtatataaaaacaaaaacaaacctttgtattttgggggacaggatatttacatggacccataatcacatgtcaggtaatgagaattaccctacaaatcactcactaatttcagaaagatgtacttttacattggagagatgggcagccaccactttacgtagtggtaaaattagcatgaccaataatgagaccaggtgatatcaatgccttctgacgtgatgcaataaagatatcatgaaggatccctcacaagaatatttcatctgaatctaatcaagagcacagccagacaaatccataatatggattattctataagacaattagactaggttttttttttaaagcctaaagaggcacaccaccaaatgaaatgtttgtaccttgaattagagcctgaaatgggggaaaagcagccataaaagacattctcagacaattggagactttcctgagttgtgataatggagttatgaatatgtaggagaatgtctacatagattttatgaagatgcatgtggcaacatatctgcagcttattccaaaaaaggtccaagaaaaaaaggaaaggaaagaaaataggaaaaactcagtcgggcacagtggctcacacctgtaatcccagcaatttgggaggccgaggtaggtggatcaattgaggtcaggagtttgagaccagcctggccaacatggtaaaatcttctctcttctaaaaatacaaaaattagctgggcgtggtggcacgtgcctgtaatcccagctactcaggaggctgaggcaggagaattgcctgaacctgggaggcggaggttgcagtgagccaagattgcaccactgtactccagcctgggtgacagagcgagactccatctcaaaaaaaaaaacaaaaaacaaaaacaaataaataattgtcgatgacacattgatggctttgaatatggtccagattttgccaccatttctaatcatgattagtagagggcttattgtgaaccaccctaatgagagaaagaaagaactggggtgggaagagggatggcaagaagaagcatgggaaaatatttaaaattcatggctctaagagaaggatatattgagattcattacattattctttcaaattttctatagataagaagtttccaaaattaaaaactaaagttgggcactatgagaatgaaacattcacatgagaagcactatagtaggaggccaggtgtggtgactcacttctgtaatcccagcactttgggaggctgaggcaggtggatcacgaggtcaggagatcgagaccatcccagccaacatggtgaaaccctgtctctatgaaaaatacaaaaattagctgggcgtggtggcgcatgcctgtagtcccagctactcgggaggctgaggcaggagaatcgcttgcttgaacccaggagacggaggttgcagtgagccgagatagcaccactgcactccagcttgggagacagagcaagactccatctcaaaaaaaaaaaaaaagaaagaaaaaaaagaagcactgtagtgggaggtggcagctggactctgacatcagacaacctgggtgttctctaggggaccgtactccctctttaagtctcagaatctttatgtttaactattgaatttttgtttttttttttttttttttttgttaatttttaaattcttggcacccaacatgtgacatgaatctatgacctgagattaagagtctcattctctaccgactgaaccagttgggcagaaatgttaatagtaccttcatctcatgggaccatgtcagagtttcttaacctcagcaccattaacatttcagtctgggtaactcttctttgtgagagctgtgtattttagggtgtttagcagcatccttgttctgtacccactagctgccagtatcacccccacccaagttgtgataacgaaaaatgtctctagattttgtcataagtgtcataggggataaaactgcccaaaccactggtctaggtaagacacttggtactgtttccttagaacatattaatggctcaataaatagtcctattgataggaaatacataatattttgagactatagaccctggagccagacttttttggttcaaatccaggatatgcagattactagttgttgtaaccttgcacaagttatgccacttctgtgtctcagttttcttcatctataaaatcaatctaatcatagtatcatcttcatgggagtgttatggggtctaaattagttaacaaatgtaaagtccttggaattgtacttttcatattcttaagctctcagtaaataattattattattagttcattcgcattgtaaatgaaaaagaggttttttttacagatctctggaaccaataagaataaatacatgatcaaaggaaggaagtaaacaatacagttcctcagccttgtgatatgacttccagacactcccaagagctccactggcctcagaggcaccaccaccattttcattgttaaatatcttctatctgaagggactagggtcatttcaggcaactggatctgagattcaaaccacacagaaactgggattcccccagcccaagcatcccagttaaacaaggtgtgacccaagcctcatcatgactctgtcttcaagttttacaagccaggtttgccttccaagtcaagctcttggcatgacagatggatgaagtcacacgcctgttctctaactcagatggcttgccagggcttgtgagggttttgccacctggccttggctgctctgggtcccagacacagacggggccctgccttgggggtggagactttgctgtcgactcgctggtgtaatctctagctccatggggaagaagggaactaacatttaatatgcacctgttgtgtgcctggagggcaatatgttaggcactctaagtaatctccctcctgaatcacacacacagtcctctaagacagtgttgttcccattctacagacaagggaactgaggcccccaaagaggaagtggcttccccaaaggcacactggtaaagagtggcaaggtagcctttgtaaccagatatatctgatctcaaaatcaattttcttaatttaacccacgtcagtcagtcaaatgctaaggctcttcagctacacttggttcctccaccctctaaaaggtgagaactcaagagagctgggttctttgggaccttatcatatttttcccctccctaggccttgatttcccatttggaaaataaatcagtgagggctttctagttaaaaatgccagttgaagccaggcttggtggcatatacatgtagttccagttactcaggaggctgaagtgggaggatcgcttgagcccaggagtccagtccaggcaacattgcaagatctcatctctaaaaactaaaaaatggaccaggcgcggtggctcacgcctgtaatcccagcacttcgggaggccgaggcaggcagatcacgaggtcaggagatcgagaccatcctggctaacacagtaaactccatctctactaaaagtacaaaaaagtagctgggcgtggtggtgggtgcctgtagtcccagctactcgggaggctgaggcaggagaatagtgtgaacccaggaggtggagctttcagcgagctgagatccagccacttcactccagcctgggcaacagagcaacactccgtctcaaaaaaaaaaaaacaaaaaaactaaaaaatgccagttgaatcactcacttgattttactcactgcaaaactaggagtatcagataaaatatatttttaaggcatatatatatatatatatatatatatatatatatgattagggaaaattggagaagaaagaacagcaataaaatttggaagctggaaagcagacagacaggtggcaacctacgtagcagacctgagaaaagagaaaatgggctgatagtgaggaaggctcacaacactgttctatagggcacttgcaaaaactgtagatgttggtggcagcagctatttctgcaagtaagactgaagggaagagggtctcaaagaggaatgggtaaaggttgtttctaagacaattagaccatcagatcttttccttaaatcgatacagtcaggcaaccaccatcttcagtctggcaaatgactggaagtttattttttggagagggtaaaatagagtctctggactctaggacacaagcaaattcagagccagagtgtactatcctgaaagcacgagtaagtgaagggttttgagaccttagccctcatataccacttggtgcccagaacagtgccaggtcattaccctctaggctggacagtagagaactctactggaaatctgaccagggaagagatataaagagaaaagctggaaagacactgacattgaggattcctggatgaaaccaaatcaagtccagccaaatcatatgctgtggccaggcgctcatgcctgtaataccagcactttgagaggccgagatgggaggatcacttgaagccaagagtttaagaccagcctgggcaacatagtaagaccccaactctacaaaaaatttaaagaagaaaattatccgagtgtggtggcaagcacctgtagtcccagctattcagtaggctgaggcaggaggattccctgagtccaggagttcaaggttacagtgagctatgattgtgtacattgcacttcagcctgggcaacagacacctgtctcttaaataataaaataaattttaaagatagaaaacaaataacgtactgtgcaactcacagtccacaaaccacactctagtcagcattttgggctcccatccttaaatatgagcagaaaaccaagattccagatatccgaggaaagcctctaacagagaaaatagagactcaaaccaacacgtggtgaagggagggcttggaggaaacaaggagtatgcatgaagaagagaccgttaagagaagctatatggtcaggaaacaagaacacggtactacattgtttaaaaaggaaccttcagagaataaaaaagagctcatggaaattaaaatatgagagtagaaatgaaaactccaaaggaagactggaaaataaaatggaggaaaccttctaaaaatcagagcaaaaatacaagattgaaaataagaggaaaaaaaaatagactacaaggacaggaaatctactatctgaggaaaatatgttccagatagaacagaggaaacagaggagaaaagcatcgctgaaataattcagaaacatttcccagaactgaaggaggagaatttttagactgaaagggttcactgagtgtccaacacagtggatgaaagtcagctcacaccaagatatctcactgtggaacttcaaacactgggacaattcaagatcctaaaagctttcagagagaaaaaaatcaggtcacacagaaatgatcaggactcagaatagctccagacttctcaccaatagcactggaaacctaaaagaccatggtgcaatgccctcagggatttaaggaaaattatttctgacctagaattctatatccagcaaaactacctttaatcaagtgtagggccgaataaggctattttcagacgtgtgagattttagaaagctcatttccttcatggtttctttctcaagaagctactggagatgatgttctaccaaaatgaggtgggtagaccatgaaaaggaagacgcggtatacagagaggtgaggagacacacagaggaacacaaaggcggatctcaggaagccagccgaacacagagagcagctcgctcacactgaagcagggcagaagccctggcaggacagatcccaaaatagaaaactcaccagattcacattggtctggactctatgagaggagatttagataaccagcagaatgtgaggttgaattagtggtaagtttgtagaaactaagcaaacgtaaaaatgacaataattaactcaaggggaaaaaaagtgctgaaaagtaaaagtaagcaaagtcagctagctgattgcaccctgaatagtgtttgcagagtaaaaataatgcaaacactgaacatcgctttcaccaaaagtatgctattgcttttaggatgacggggagatgggagaggttcaagtgcatgctgtaggggctggggaagggaaggaagggaggctaagtccccaccctcctgagaggtaagtaaataagtaatgccgaaaacagaaaagatcaagaagcagtaatgcatgcatataactagacacatagaggtagccacccaagaaattgaaaatgattttcttttaggttgtgagttatggggataggggttgtggaatgctcttttttatagcaaacctcaaactatgttggactgttaaactgtgttcatatataactttaataaaaactaaaaattaagaactattaaactttggggcaagatagtatttaaagtcctgttggatataaagttcttgtagcggggccgggcgtggtggctcacgcctgtaatcccagcacttggggggccgaggcgggtggaccacttgaggtcaggagtttgagaccagcctggtcaacatggtgaaactccatctctactaaaaatacaaaagttagctgggcgtggtggcaggtgcctgtaatcccagctactcgggaggctgaggcaggagaatcgcttaaaccctggaggtagaggtggcagtgagccaagttcacgccactgcattccagcctgggcaacagagggagactcatctcaattgaaaaaaaaataagttctcgtagtagaggatagtgaagggatgcagacacaaaggagaggctgatgacctgttttcttgattacagtgctgattgcttgagcgtgtttcttttgtgaaaattcctcaggctgtacatacatgatgtgtgcacttctatgtatgtattttttacctcaatcaaacatttacttacaaaaggataagtagcaggctacatcttgtgtcagcggctttaggtaaaaattgtgcacttcacagtgatactccagggtataagaattaaagctcctggtggcctaattggtgagaatctcttctttttggcatctttttgtctccaggatttctgggcatgcccaaggaacacgatgcatgcctcaagtcagccctggcgtgactggtctacacagccaacctctccctgtctgagtcaggtcttgccatttttacagactcttccacgctgctgccacagtctcctcaacattgccccacagtacagacccatgtccagaggcacagcctgatgaacagggtggttggcaggacagggtgctcctagaacagacgtcccccgctccgccccacaccccttgaggacgtttctgtgtgtcttcccaggttattgccacactgacgactcctctcttctttcaccttgtattactgttgatcagtgagtgagaaatggtgttaactgtcttaatattttgttgaaaggacctatttgggaaatacagcaggtcctcaaataacatcattttgttcaaggtcattttattataacattataatattataacctccccacactgtatgcttaaggtgatacctccagctaaatatccaaccaggtctatccctgaaatccccaagtctagcaaagaccaaaggaattagacaccaggagatgaaaactttaaattggcaataaaacatctctgtacatggattccctgttccatgcttgagacaaaggctacaaggcccttgccaccccaagtgttgtccccactcatctcttctggtaaacctcggtcttctttttctccatcatcattatcattgtaaattcagcagaaatgcaacacttcttgtggtgccaaatatcttttatgttattatgcagagcagttttctcatcccccaaacttccaagtattacattttaatgccttatgcataaccaaaaggcctattaaaatatttttaaacaaagccaaacagtagcattcccctcatgactgtcatgcctacctccagacactgacaattgccagcaatcaccaaataagcttctctatcctcagaaaaacccagatctcagcaggtgatctggctacatgtgaacattaaagagtgttcagatgatagccaggtgcggtggctcacgcctgtaatcccagcactttgggaggcccaggcaggcagatcacctgcagtcaggagttcaagaccagcctggtcaatatggtgaaactttgtctctgctaaaaatacaaaattatccgggcatggtggagcgtacctgtaatcccagctactcaggaggctgagacaggagaacagcttgaacccaggaggcagaggttgtagtgagccaagactgtgccactgcactgcagcctgggcaatagagtaagacttcgtctcaaaaaataaaaaagaaaagaaaagaaaaacccagatctcagcaggtgatttggctacatgtgaacaggaaagagtgttcagatggtagtaggtaggcaggggagatgatgaaattgttcctacagtgtgattaaggactcacaggagaaatacttctctggcctcccgaccaagaataactgttcttttctgaacagtggggttgtgtttaccttaaggacaccacaaatcttatatctggtcctatttccccctcacattaccagttatgaggctcagagcttgtcgccagtttgtttccttatccttattttctctttgtctagttttccttagtttaaatgtattttactgtgtagtattcactttcataagccttaaaatcctttttcaagacattagtaaatactatttttaaaatacagtaagattacaactacgtgatagaaccgtggatatatactggaaggcaacctaggaaaacgataattgtattagggtggtaagatatggataatttattttcctttttgaatgtacattaatattataaagtacaatcaacaatacttttatttttttctgattgtaaagcatatgtttattgtttttaaaaaaagaaaagataaaaatataaagatgataatatcatttaccatctaactctctagatatcagtgttctctttggtatttttttcagtcttcttaaaatgcatatgtgtgtgtatatttggaaactatattttccaaatttaaattattctttttttttttttgagatggagtctcgctctgtcacccaggctggaatgtgatggcgcgatttcggctcactgcaacctctgcctctcaggttcaagcaattctcatgcctcagtctcctgactagctgggactacaggcgcccaccaccatgcccagctaatttttgtatttttagcagaggcgggatttccccatgttggccaggctggtcttaaactcctgatttcaggtgatccccctgcctcagcctcccaaagggctgggattataagcttcagccactgtgcctggccccaaatttaaattattctttacactttttttgtaaacttgctttcacataatgagtttcaacattttcccttgtcattcaatattcttcatcctcattttaagttgcgtagtccccgtttgcgcgtgtaccatctttatgtaacaaatccccctttgttgaacatttaggttgttcacttttagtccttccctttctaggtttatttagatggccaataagccaactttgctgaaatctgtttcttctactgatattcttgtttttcttttttccttacagtggtctctggttcatcatccagctccaagtatgaccctgagatcctgaaagctgaaattgccactgcaaaatcccgggtaggacctcttcacctatgctatgtgctagtgattggggccactgaggtcttaggccacaagcccacccacaagaccagaacagatgctccagccaggctatgacagccagtgctagcaaggtcctaaataataacagtagaagcggtagtcacagtaatagtaatggttgtagcagctaccatttcacaagcagtcaccatgtaccaggcacagtgcgaaatatctcatgtgtattatctcgtgtctatgaagtaactaccgtcatctgcattttattatttttatttatttatttatttatttttatttttattttttgagacagagtctcgctctgtcacccaggctggagtgcagtggcacgatctgcgctcactgcgtgctctgcctcctgggttcacggcattctcctgcctcagcctcccaagtagctgggactataggcgcccgccaccacacctggctaattttttgtatttttagtagagacggggtttcactgtgttagccaggatggtctcgatctcctgacctcgtgatccacctgctcagcttcccaaagtgctaggattacaggtgtgagccaccaccaagctgtcacctgcattttaaagatgagcaaacagaggcttaggggagctaagaaacttgcctaaggttacaagagattcaagtcttactccaaagtttctaatatagtgtactgtcttcctagctactgattattctgcattatcttattttaattacttcatgattaccttagggcataaatattagtatttccattttaccagtatggaaactgaggcacagcagtgaaattacttgctcgtggcaaagtcagtattttgaatagtggtttagttaaactcaaagaatttaacaatttccacaaactcagatgcctgcaagaagacataaatgagggatgtgggctgggggtgaggcagtagagagttgtggtgactgtgtaaccaggagaggtctgcccagtcttaaaggtaattgcatttgaactctagtccagcccatgctggaatgtgggcccagtgttaccagatcttcagatgttttcataaaggaactgtgtgtctaggtttattatgtgacctttctgaagatttgattattagcaactcattttaaaagttgaataatacagtgtaggccacacaaaccagcagaccgagtctagctcctaaggcatgtcttgccactaaagttactaagttgcctcttgcctccacgtgaagcactctcatagcctttgccagctttaagtgatccatggctctggaaattgccattgtcctcatccatcagaacaggaaagggaggctcaggatggcaagacagcttgagagagttcacacagcgaggaagtgggaaggcccactctatcccaggtcagctcctgtccacctgtttccctggagcaaggactggctaggaatgacctacagaaacactgcctgggatgctgactgaatgggcatctgcagagaccaaggccaacatcggtgacaggagggggctctgaccagtgtggcgcaaggggtgctgacctgagtcattatgcaggcgcagtgggaggctctgggttccctttccagggagaaggcagcctgcaccttggtgtcagcctctgacccagccctgtgtgtggtctgctgccctccaggtcaacaagctgaagagagagatggttcacctccagcacgagctgcagttcaaagagcgtggctttcagaccctgaagaagtaagtacaccctgcatcccagagcatgggggctgctccccaccctggttcccctcctgtcctctctgtctctctctccttcagtccctttcctcccttctcaaaatgtggctctctcatcattcaattcaagttctgttccactggcatttcctgaagatactgccacccaagggtggggtttggaaagaggaaaggggagtcatttcagaccacagaacactcattgtcccgtggactcctgaagccattaagatttgttccactcagccgagtgttactatccagtcacagaaacaagtattgcccagcatttctgtgcacacgcctcatctctagtcaatccagtagggtctcatatgcacacaaacaaaatacacttcttttttccatatcccctaaaagcagtcactaagtgcttcagtgaaggattaatgatctcttctagcaaaaaccaattactagaaaagtatgcacaatgccatatgcattgtgctctatgggtgacttaaggagtttccaggataactttcaccaaatgtaattttcacccttagaagctgagctgtggccaggtaaaatacagctccgttgtgtcttcttcttcttcttttttttaacttttatttgaagttcggggtacatgtgcaggtttgttacacaggtaaacttgtgtcatgggggtttgttgtacaggttatttcatcacccaggtattaagcctagtacccattagttattcttcctgatcctctccctcctctcaccctccaccctcccagaggcctcagtctgtgtttttcccctctatgtgtccatgtattctcatcatttagctcccacttataagtgagaacacgcagtagcttcgttgtttcttaagagtggttgtgttacctgttgtgattgtgacgatattagctaagctttgttgagcagttactctgtgccagggaacccctgcagtgtttccatgcaggtgtgttcctttgatcctatagcaacactgtaaggaatgctttgttatataactacccccattttatagatgagaaaactgagtcacttagcaggtactcaagaaaggttagcttattgtggctgggcacagtggctcaggcctgtaatcccagcactttgggaggccaaggtgagaggattgcttgagcctgtgagttggaggttgcagtgagctgattgcaccactgcactccagtctgagtggcaaagtgagaccctgtcttgaaagaatgagagagagagagagagagagaaggggaggggaggagaggaaggaaagaagggagggaagaagaaagaaagggagggagggagggaaggaaaggaaaggaaaaagaacgagagagaaagagaaaaagccctccagtctgggtgacaaagtgacaccctctctccaaagaaagaaagaaaaaaagaaaggaaggaaggagagaggaagaaagagaaggagagagagagaaagcaagccctgcagtctggttgacaaagtgagaccctgtctcgaaaaaaaggaaaaaaagaaagaaaagaaggagagagaggaggagagaaagaaattaagaaagggagagagaaagatgttagcttattgttgttattaactacagcatgtaacagactcattcattgaattgtgttcagtgtatccaatgggctcactggacaatcattatgaaggtcacctggtagccctcttagaagctctaggcaagacactcggcagatttctcccttctaagggggcagctcacttacattcccagggaggccacacctgtatggatggctgtttctcgctttttgtccctccctgactgctataccttttcctcattccatgaatttcaaatccaccctcatcattctgtggccatagccccaagcctttggctgtctatctccaagccctattagttgagggaactgtggtcatccgttgagggaccagttggttctttttcacgtcttcccaccccacaagtccccaccgcctggggtgagccacacaaattcagcacaacacatgctgtaagaaagtatggctttgtattattacaaattgtatgtaatttttgtgtcttacaaagtattataaattatggctttctgtatgtttacatctacgttatatacgtgttatttatatatgtgtgtatacatataccaatcttgtctctcaaaccggattctgaactttttaaggcctggaaccatgctttatgcttcttggtaatcttcagtagcaccattgacagtttggggcaatagtataagcttagaaaatgcctatttttgacctattgaagcaatagcctgattcctccactttgcagcaaaatggcttctgagcacacagtttaagggctactcactcccacatcattttactgaatgggttctctctgcttcctggctactgcagtccaagagcttctggttagaacacttcccattattctctgagccactgcaaacctgttttaccactttgtcaccctgtagcagcattgaaaactcttgttgtttggtaagctgatgctgaaaccccaaagacaagcctcctttcttcccctccctctgccccatgtttgatatcaggacagataagactccatggcagctccagccgcccacactccttagccggaagctgggctctgcgtccagtgtggaggaagatgcgtcctttaatgtacaccttggcagagagggtcaggaatgtagtcttgagaggcaggtggtcagggttcaaatcccagttccctgggtccttggaaaagtgacttaacccctgtgagctttgacttcatttgaaaaactagggattgtaaagattgaattggaaaatccgtgtcaagtgtgtggtaatgcctggcatgagggaagagctccttgagagtgggctggggtggtgacctctagctggttgcctgcttgtattgggaagggaactcggatgaactctttgtctgccctgggctagacagtgtgctggggaagcacttcacgccagccacctcatttcattctcttcaccccccttttaagagacgtttttgtcctgccatatattacagatgagggcactggaagggttgaaaacatgcccaaagccacccagctagcaggtgacagggctgaaacccaggactactggattttgaagttcatggctcaatacctcccttcccagcatcatccctgataactccctcctcattcccagaaaatgtaaggcccctttttcagagtctaacagggatgctatccagtcacttctacttctgtgcctaccctgcggcagaacatggagaaaggtacaacttatccttaaggaatttccaggataactttgaccacatgtaatttcccctattagaaaatttctctttagcagccaaaagctctgttgtttctttttctttctttctttctttctttctttctttctttctttctttctttctttctttctttctttctttctttcttttctttcttttctttctttctttctttcttttctttcgacagagtcttgccctgtcacccaggctggagtgcagtggcgcaatctcagttcactgcaacctccgcctcccaggtccaagcgattctcctgcctcagcctcctgactaaatgggactacagacacgtgccaccatgcccggctaattttttgtatttttagtagagatggggtttcactgtgttagccaggatggtctcgatctcctgacttcgtgatctgcccacctgggcctcccaaagtgctgggattacaggtgtgagccaccgtgcccagccagctctgttgtttttgaagagcagctatgtcacctgtcatgattctgatgacaccagctaagcttctttgggcagctgagttactctggaccacgaatccatattagttcaattcatagtcagcaacctgtttaaaaaagagaggagagaaaaggttgatgaggattaaaggttgcctcttggaggagattgcaaagaaaaatcaagacgaaagcttgggactttgacttgccagctcccttgcaaatagggaagagtggagaccaggcatctcgcccctgtcgggggagggcagtgcagcacctctctacaaagcacgagccctgccgtgcccaggcaggaggtgtctggacaggaccaggagttggctgctgtcagcctttgccccacctctctgtggctactgggtatgtgaatctctcaaggcctgaagagaggacagctgaggaatttggaaatcctaaaacacatgcatacacacacacacacacacacacacacacacacacacacacttttctttcccttaaaaaaaaaaagattcattcaccgtgtgcataatggtgaccctttgttctcccccgaccccctccccacccagcttcatcccaatagtgttccctctcagagccgctctctggagccaaattccagaggccgggttgctaaggcccttgaagaaatcaggtagaggctgttggaggcctggcagacaaaccacttctgtctcatcctgcaagggattcgaagcccttcttgccctgttggcagaggacagctgggcacagccccctccccagagtccccagccctcagatatgctccaacaaacaacaactccctgcagcccctatgcccatctgcagcagggccactgcctgtcccggacactggctgtggggagcctccttgccacggagcatcttctaagctcccttagactaatttttcagactaaatctggggccggtccttgccgacctgataggcctgccgaggcccgagtcctggaaaggaatagacaggctatttttagtggggagacataaacggggctttgttttctctccatggaggctgaagtaaccgcagggggagcctgtgttgagaccgtgctccatgcctcgctctctcctctgcttggaggcgcagacgatgaggccgggatgaaaacttgcttctgctcaggattccccatgagggttatttttagcccaggacagtttggtctgtagcaggaaaccacaaaggaatgcctgtgagtagtttctcatcctgaaataatgagtttgtggtgttcccgcagactgtaaaactcctttttctccaccttggactgaaacctcaggcctagcctttggcgaaagtgtgatgtagttaaaatgcatctctgcccctggacctttttgacacctcggccctccttctccagaagctcacccctgcctgtctctggtttggtctgaccttcagaaaactatgtcaggacacttttttttttttttttttaatttttcccccatcaaaatgaacctgtatgtagggcctggataagccaataagctctccagactagaagcgttttaatcccttatgtttgtacagtaattcttagctcatcacaagattgcccatcccatattccatttgatgttcttgacaacttcatgagtatgggctaggtggataatgttatccaggctttttagaggaggaaactgaggctctgtgtatttgagagacaacctcagggtcatcctagtaataggtagtagggctgggagtttttcatccttctctccttttcttcattgtgttcattagctcaacacatgcttattaaagactggttcttgaccagcatgattttgctccgtctccctcaagggacattaggtaatacatggagatattttcagttgtcaccattcagggtgggggtaccaccagcatcttgtggggtgaggccaggtatactgctaaatatcatacaatgcacaggacagcctgccctccctccaaaaaagaatgagacagacacgttcaactctgcctcctgttcccaagcctcccagagtcaagtcaacgatgctaccgcataaactataaattatcacacaatgtaacgactgcagagtcacagctatgtgtgatgtatatgggaagcccctacccagcccggaggacccagggaagtaatcagggaaggcttcccataagagctgatgtttagaggactgtgacttcatgagcagtgttgcttctgcagccacacacgttggccgtttaacagggactttctatgccttttttttttttccttttctttctttcttttttttttttttgagacggagtcttgttctgtctcccaggctggagtgcagtggcatgatctcagctcactacaacctctgcctcccaggttcaagcaattctcatgcctcagcctctcaggcagctggaattacaggcttgtgccaccatgcccagctgatttttgtatttttggtagagacggggtttcaccatgttgctcaagttagtcttgaactcctggcctcaagtgatccacctgccttggcctcccaaagtgttgggattacaggtgtgagccaccatgcccagcccgggaccttctatgccttatcccacaagtgggacctagggaggaagggttagcaggacagagggaggggccttcttaagggactgaagtcctgtggtctgtgcttttcccctggggagaccctgtccctcaccctatctaaggctgacctttcccattaactgtctcctagaatcgataagaaaatgtctgatgctcagggcagctacaaactggatgaagctcaggctgtcttgagagaaacaaaagccatcaaaaaggctattacctgtggggaaaaggaaaagcaagatctcattaaggtatgcaagttcctgttgatgtgggtgccatcttgatttctcctgagtattcctgtatgccagtcgtatgcgggctatttccacgtggtacacacatcactgagttctcattaccagtcttcctggggttttggttccatttcatagaggaggacgtggaggctcagaagcattaagtgactttgcataaggtcacacagctagtgtaaatggcagagttggaatggaagtcatctggcctagtccaaaggccacatccttgccactagctctaactacctgacttattttttctttgttttttaaacttttattttttaatagggagagtcggccgggcgcggtggctcacgcctgtaatcccagcactttgggaggctgaggcgggcggatcatggggtcaggagatcgagaccatcctggctaacacggagaaaccccgtctctactaaaaaatacaaaaaataagccagttgcagtggcgggcgcctgtagtcccagctactcgggaggctgaggcaggagaatggcgtgaacccaggaggtggagcttgcagtgagccgagatagcaccactgcagtctggcctgggcgaaacagtgagactctgtctcaaaaaataaataaataaataaataaagagagagagagagagtcttgctatgttgctcaggctggtcttgataactcctgggctcaagagattctcccaccttagcctcccaaagtgctgggattacaggcttgagccagcgcacctggcccctgccttatttttcaaggaatgaaatggagggaggtggtttcaacatcattaacctctgacatcaaaatgtagcatctctataagcatttcattgtgtgttctgcctctatgctgggaactgaacaaattataatagatattatgtaatgtgccaggtgattatgccaagccttttgtatgcatcatgtctcatctcttaaatcaaccctagtttatccccatcctacagaaaaaagactgtacaactcagagaggaagctagagcggtgattcaaaccctgacttacagacccattctcttaccccctgtacatatcacctccctttccacaaaccaccctgacctcagatatttcactggcagattaggagtcctcagagatgctataaatgacttagtgaaggaagctgtatgctctatgagaaacagaacagtttggaagctcctgcccaggacagcagcccagtgaaaacatttagatgaagagctcatggacagtgaggcatgttcctgttatgattagtggttgagatcatggagccttaagccagatagaccaggtccaaatcttgcctcggtcaattgccagcttctcatcgataaattggggataatcataggtcattctttgtatgactattgtcaggattcagtaagactctggtaaagctgacagttactgagtatgggctgtattcactagtgttttatacttgtcatctcatttaatcaagatgatggccctgtgagataggacctgcgattcttccccccttttttttttaagaaccagggtctcgctctatcacccaggctggaatgcagtggcatgatcatagctcactgcagcgtcaaactcctgggctcaagcaatcctcccacctcagcctcccaagtagttggaactacagacatgcaccgccacatccagctatttttttttttttttttttttagagatgggagtcccactgtgttgcccaggctgatcttgaattcctggcctcaagtgatcctcccagctcggcctctcaaagcactgggattacaggcatgagcacccagctgattattcccattttataggagaggaaattgaggcaaagagaggttattcagctaggtcaagtcacacagctgggaagcagcagagcagggattccaactagggcatgtggctccagagtcggcatccacaccggtttctcctatgtcataggcccagcgcagagcctggcacacagcaaggacccactcactgctagctctctatcacaggatcagtaggatatctggggagggcacaggttcctaaattaagggagggtagagagggaagcacagggagcgtggcagacccagagctccctcctgggaaggcgcatcactaaccctgctctcccctccttcagagccttgccatgttgaaggacggcttccgcactgacagggggtctcactcagacctgtggtccagcagcagctctctggagagttcgagtttcccgctaccgaaacagtacctggatgtgagctcccagacagacatctcgggaagcgtgagtagacggggcaggttgctgggggccttccacaggatggcagctgggaggctgctgtaatggacagctgccttctcatggctcaccagggagctggccaggggttctctgcagggctggctgctgcctcagccctctggagctctgttctcttacagacctcctggccccaggaggatatgatgtgatgctgtggaggaaaagcctgcactgacggacgtcatggccctgagtattgcctggccaggtgcttgtgtctcttaatgctgcacagaaagcatgtttaaaggacaaaatgtctttctctggttttttttttccatactattttgcagttccattttcatttttctttccccagctggacagcagaggatattttcctcctgttagtctcaaaacaatgcatgcagctttcaggcagctgcttgactcccagttccaaagctcagtccagtcctagttatgaatagtgaaagcactgtccagatgtggctcaggaaagagttagagtagggctgaaccatggtgcctcgtaacttttggagagcttttgttttactagagccagcaacattgaacgaatctgccttccagcctctgtggcggacagcctctatatgctgttcctatctaagttccatagctgtcttcccacttgtccaagggtgaccggtgagccttgtagcttcttgctgctcttaacagactagcacagaaaaagaggctgtcccttccttccccataccaccatgtgtccagctactagccatctgcaggccaaagtatttgtaaaggaactgtacccctctttgtgagtgcaggggtcttctccccaactacccagtgtttcactcctgactgcagcctctgagttttctatggatcccctcaccagtgcccctagaatgagtttcttgatattggctatccctgtttcctcctcaccaactgtcctccatgcttctgtggcttgaatgggcaccaagccaagccatttggggctgcaagatgatattctgggcttttggcttctattttcaaagtgatcgatgtctgagcgtacggttcttcccgtggcctgaagggaggaaagtgtttttgcttaaccagcttccctgcgatctgcaccgccagcccagtcaccgggggctattcttggctactgcccacgcaagctgtcaagtctctcatgagccctcgaaacccaactcagcaccggccacaacagccacataattcctgactttgttcttctcctccagttcggcatcaacagcaacaatcagttggcagagaaggtcagattgcgccttcgatatgaagaggctaagagaaggtaattgggctggggctaggggcgggatggttccaaaaataataactactattgtagaatgcctgctctgtgcttagcttttcacacacttcgtcttctttaatcctcacaaagattatgaagatagttattatactttttatattttcatcctctctgaaattcagagaggaaatgactcacccaggacacttcacaagacagagagtgaaactatgctttgaacccagatctgtttaacctcaaagccgagttatcttcccacttgcctgtcttgatttctgcaaccgaggctttcccatgatcctgtaagcattttggtttgaaggagtacaactggaatttcagcaacaggctaaaaagattatggacactacccacttcagtgtctcctgcacagctgggagcaagctgggcttttaagcagtgtagacctctgggatttagatgttctgtggcttcacagaatcctaagcaatcaggttccactaccacaagtaaaatcaaaataataatcaaagctgacatttttagagcatctgttataggcctaaagagatttttatttttaattactttgttttcttttttagggacagggtctcgctatgttactcaggctggtcttgaactcctggccttaattgatcctcccacctcagcctcctgagtagctgggattacaggcacgcaccactacccttggctgagattgtttattgtactaaaacatttgtgcatgcatcttctcatttaattttaaaagcaatgcatcttctcatttaattttaaaagcaaccttatagcacagggtctatcttattatctccatgttagagaggagaaaggtaagaccaagatatttcatgactattccaggtggtagaggcagaatttgaatcctggacaatctgtctttaagttcatgatctttgctttttttttttttttttttttgagacggagtctcgctctgtcacccaggatggagtgcagtggcgcgatctgcaagctccgcctcccgggttcacgccattctcctgcctcagcctcccgagtagctgggactacaggcacccgtcacaacgcccggctaatttttttgtattttttagtagagacggggtttcaccgtgttagccaggatggtctcagtctcctgaccttgtgatccacccacctcagcctcccaaagtgctgggattacagatgtgagctaccgcacccggccaagttcatgatctttctgtactctgagccagtgttactggcaaagaatgccctgggcattgtggtgtggatggaagccaggcacattgcatccattccttcctagactaagttgcctggcctgtggaccttctcagccaggccaggtgaagcatggcagtgcccagctctgcccctctgccaactctgtgtgaatagtagaactctttgcagagatgacagaaatctaatagaaaccagagaaagcaaaaaagggaatgtattgtgttatttaactccaaagtcctgagatacctagcttcaggcacagctggatccagggactcagatgatgttacccagactcagtctctctccttttcttcaccctgcttgcctttatgttggctttaccctccagcagactttcctgtcaatgtggccaggcaactcccagcaattcggagcttacacactaccaggttagcaatccctgtggaaagggggcctacctttcccaatagttttaactagccttgggtttgagactccctggcatttttgggtgaaccaagctttgttacaggacagttgggggtgggcaaaattaggattctctaaaggtctaggcatgcgtcgtgtttccagtgctgggaaaagtcagctgtatgggaaccaggtgacttgaaagtacgaaaggagtgatttcccaaagacaaattggaatattattaacaaaagaagaaggaattgaatactggtcaggtagaaaaaaacagatgtcctatgtactatttcagctcccccaggcgtccagcaaaacagcaagacatctgtatttggacagccacttcttgttctctctgaagaggaccactctgaaccttggatctgttccatcctgcaggaatgcctgtcttagatggtcagtccttgagacactaaaggactgcagtgctctctctggagttgagccattagacttctcatcacagagcttcctagctcatctgactttatgcagcctcttgcttgcccctccacccgaagctcattttagtgtaaaggacagagcagcctgctcaatgggaaagcaagcttcaggacttgaaagagggaagggaggtgtctgtaatccaaggagggtctgatcattggatgtcaagttttgtcacacatgcatttctgagaagagagactagttgtgtttatcagattcttaaaaggatgtaaggcctgaaatttaaggagcattgacatagggaaagagaaagtatatccagtaaagcatcagtcacttcccaatgtcctgcatatggtggagcccctgcccggccttaccataccatttcgttctcaaagtactgcagaacagcagctacaaagttgtctcaaagctgatcttgatagattactgtatacatgaatgtgaatttaaataactaactacagtcagtcctctgtacccacgggttctgcatctgcagattcaaccaaccaaggatcaaaagtatccaggaaaaaaaattaaaaaacaatacaaatttttaaatatagtataacaactatttacatagcatttacattgtgttgggtattataagtaatctagagatgatttaaagtatacaggagagtatgcataggttatatgtaaacactatgccattttatataaagcacttgagcatccatgaattttggtacctgtgggaggtcctggaaccaatcccctgcagataccaagggtcaagtgtataagaattcctcctgggacacttgcctggggaacaagcaaatctaggtatgtttttctacatggaatttttgctgcacatcatggtaaattttgtccccagcagtgttctgataaaataagaattgggccacattgtctgcacgtaagattgaactgggagtccagaggcctctggtctcaacaagtgttggccacgtttatgatttgcagtcttaggtgcatcatatcctccctgggcatctgtccaaccaggtgaacaactcctatcttaatcaccctttagagatggggtggccagggcgtgagagctgatggtactttgcagaggccaagtcctaaaggatgatgtcatgattgttgttagctatttgtagcagtattcattgttatactgtggatcttattttggcccaatgataataatactgaagatctatataacacctggcaatgtataaagggctcttaatgctgtgttctcacataacccaccctataggtaccatatcatctctgccttatagatgaggatatggagtcttagagaagttaagggatgaggctgccagctctttcctttaactgttatttagtgcctgcaatataccagtgactgtgctagaagcttgtgataccaaaatgctttcttgagaaatggtcccttccatcatgaaggccagagcgagccaggactccaactccaggcctctgaccccaaatccacagttgttcacacagtgccactacctgtctctgaattgagaatacgcggtcagtagttgtagtcttagtggtccagaactgtcagtgactcagtacttgttatgtgccagacacccttcccaatcattctgatgaatgaatttttcttatctttaaggcctggggaattggcccaatgttacatacctaataagcagtcacatcaggtcataacaacagtagcaaggacttactatgtgccaagtactgtgctttgcaggttacagattatatcataaaaccttcaaccaaaataacatgaggaaagagcttttgttattccattcagagagatgagcaacttgcccaaggccacacagccagtgctaagaggttagtgcctggtgatgaatccacatctctattgtaccaggaacagggcaaggacattgccttgttcatgtctgcaccccattcctgcagagcctacttcattgttggcacatggtaggcacccacatgtgtttgtttagaaaaaaaataggttccttgagatgacaagctgatcaaaggaagacagtaactgtcaaagattgctctgagatgtctgtttcttcatggcatctcctgttccctcagtgccattaggcacaccagtcatgcttgctttcttggcccccaggatcgccaacctgaagatccagctggccaagcttgacagtgaggcctggcctggggtgctggactcagagagggaccggctgatccttatcaacgagaaggaggagctgctgaaggagatgcgcttcatcagcccccgcaagtggacccagggggaggtggagcagctggagatggcccggaagcggctggaaaaggacctgcaggcagcccgggacacccagagcaaggcgctgacggagaggtggggctggggccccagggtgtgtaggacccttctctcactggcagtctgtcctcagcccccagatgggggaagaatgagggggctccgggcccctgggctccaccctgagcacgctcagttcagagatctctcaggttgccgacataggaaatcaggaaagatggtttgccatccagtgcgccagctaccctggaattttgcatggtgaatcatgctaccaaaaagtctgcttaggtgcaggtgttcaaaaatgtatcttctgactcaattaagccacataactctatataacttaaagcagtcattttccaactttttgacagtgatgcacattttatactgtaacctgatccaaggttcacaaaatagtgcatgctctttctacctctgatggtcctctgatgttttctcccttctgttgcattttgtttcatgcagtttgtgactcaccaaattgatttcaccccatgctaagtaaggggttgcagtttgcagtttgaaaaacactggtctggataggggttgcaaactggcatgcttataggagccaagcaggtcacagaaatgctagagacccacctggcagtggtctgtgttagaccagagtgcacagaccccactggtctaaagcaggtgctgtctctctgctccagcaaatgggagtgcaggcctcgggctgccagagctgcctgtacttcaaacaaaagagtcgttcagattttttatttttaaatattgggaactaatccagaagtttttttaaaaaaatatgcaaatcagcctcatctatgggcctgatataacctaaaagccaccggtttacattctttaatttagaccttattatagacattgtctttgtttatttccttcagtgttcccaccaacctcctcacccacattgcaccgaatgcaacactgcgttcaccataggctttacaaagctctccagcttcatgttcatttattcattctgttcatcagccaatgtttactcattcatttgagaaaccttttgctgcacagattgtgtgtgcaaggcaatttggggcactcagaaattaacaagacatggtccctgccccatgacctttaaatctattctagttattttcaccattttttggcaggagcctttattcagcaaggtccctgcccgtaaggagcttagaagtgaagctagagattttcaagtgtgtgtgtgtggggggggggggggggcgtgtgtgtgtgtgtgtgtgtgtgtgtgtgtgtgtgtggcatatgtggtgtgtgtgtgtttggaatatgagcaagggaattcctttttctagtgaaatcagaggcagaggcccagtctatgaagcaagtaaacgtgcctactgcctcagtggaagcagtcgggagtcctagagatgctgtctgtgctcactctgtcaccccatcatggggcttccagagagcctttgagctctaaggcacccagcttgcagtaccattctagcaactgagtaggccccacttgcacatggcatggtgccaggtggatcgggttccccaagttcttgcctggcctcccatggcttcagagacccccttgactcatcgatggtaggaatctctccgcactagttgcttagtcagaactgctaacagtgatgtccaaagcgtatccatttcctctcttccgttcttcattggcagcagcagctgattagccctgatccaccaccagttggtgggagaaggagaaggacagagcttgaataattggtgttctgcagcccttggaagcaccttgctagaagtcttctttagcaccacgactccattctgctttctctgggattttacgctttggggataaggcctgtgtctatatgcccgcatgcctttagtgttcgttgaaagaataaatggttagctggcctaggtagacccttactgggcctctgtgtatatctcctggtctttatacccattccctgggtccctcacttgctcccagaccctgtaattgccactgggaagcccttagctattcatcatccccacagccagcagctgaagagaacagattcatggcagcttcactccttgttgggtcaaaagcaatacgcttctcacttgctgaccttgagcaagtcattgaccaatttgggtttcacttgcataatagggaaaaaacaggatacattaagtctcacttaacatttgttagtaggttcttggaaaactgtgactttaagcaaaactacatacaatgaaaccaatttttttccatcaactttatgttttatttttatttttttcgagatggagtcttgccttgtcacccaggctggagtgcagtggcacgatctcggcttactgcaacttccaccttccgagttcaagcaattctcctgacttagcctcccgagtagctgggattacaagtgtgcaccaccacacccagctaatttttgtattttagtagaggtggggtttcaccatgttggccaggctggtctcaaactcctgacctcaggtgatccacgtgcctcggccttccaaagtgctgagattacaggcatgacccactgcacccagctctatcaactttattaaaaaatgacatttaagaatttgatgtacatcattttgcttaaagttacagttagcaagaacctatctacaatgttgaggatttactgtaattacattaaatacatatatggtctgaaggcaggcagttagacgaggctgtgaattgaggctcttcccttctgtaaaattgttggtttcttgaaactcgaattggaggctcttagggacccctaggatataccacatgtaaaagctcccatcctgtgccagacagtagcctatataatctcatttaaacctcccaggatccctgaggttaatccccattttaaaaatgaggaaactgaggctcacccgagatccctaagtgccagagctgggattagaagaccacaagtttgctaaccccagaggctgtgctccctttaggatgctcgccactcagaaggccttctgttattgccttcaaccccatctttcaaaggtctgctggctcctcaggagcagtgagttcacatagctagtacagggaggccagaacctccactcctctgcagctgctgagcgggcagctcggagggcctggtaggagggtgcttggggcaaatgcagtggtagggaaactggagggcatgcaggcaggcagccatgtatgccctaagaggagtctaaggaggaagcccacaggaatggggtaccatgctcatggctgtgggtctcccacagtggggagacgggaaagccgccccagctgtctttgtgtctgcagctgtttccttccagctccatgtcagtctgtctgtgttcatccttctgactcatattctgtttcccttctgtctttgtttctcatgtgtgtgtatctttatttttagtgtctctgtttctttctctctgtctcccctcgctcctctttctctattctctgtctctcaaaatgggattattatgctcctcatcttcacacaacagcctcacattcaaggtgcctttgaggacaggaatagacacatccaggagaggccgactgcaggacctgccaaaccccgctcacaaatcagtcagactcacaggcatccaaacaaacctcatcctaccctctgcctccccctccttcccgagggccttccccactgctccccagagctggtgtgcagtcatgcaggatacttgctagcgcacaggctccctggcccaccccagggaccgattcttccggcctgagatgcagcccaggttcttacatttttaaccagcacccaaggtgctgaaatacagcttgtggggactccagccccaccttctggatcctctgcctgcctccatgcttgatgcgttcttggcctcccagcgtgtgccaggcatctcacacatgtgccatctatcctgcaaaacccaatgccactgggaggtggcctcggcacctgtgcattgctagcagtagctagcccctaatgccaggacgtcatggcagcccaactcccagacccctcatcatcctcttgaggcttcactggggacccacatttactcccagcacacacctctgtggcttttctcccacagagaagaggaaaaccaaggtaaaaatggtgagcgccagctgctccttgatcctggacctcaactgttcctgagctttccttttatactgggtcaagagattccacagccttgttcattgtgttgaaagtcaaggattttgtttattacgggttccatctgccaacccactgtgcacccccaccccagcctcaggcaggactctagaagaacagtgccagggattgagctgaccaagaaccatgccaaggccactctgcctgctgctcctgttgccttgtctgtgatttcacggatttagttgtccagtaacaagcccgacccacccctcaacacttttccgttgtgtttagagcaagctctggtctttactgcagggcgtgtgctgggggcttggatgtgtgggtagagggatggcatgacttggcttttccatggaaatgagccctttctcccaggccccaggctgggttagctgtatcctagtttcactccctagtccagggatcaactagtcagtcatcccctcttcagcaggttgacatgaggggatggaggccaacagtggaacacatctgtccatggaaggtataataatatgcaggtctttcagcagagctcataaactgtgcctggcttcatctggagaaaaagtcatccattcagcaaatattgagcatgtctacatggtgggcactgtgctgggtgctaggtgctgggtgagcaagacacagcctctgcctctctgccatccccatacagtgcagcaacttgcaaaccttggtgtgcctaaagatcacctgggaggcttaatgaaaagagagatttctgggccctacccctgggctttttgattcagcaggtcaaagtagggcccaggaatgtgcatttcaataagcactctccgctttctgatgcaggtagtctgtgggccacaggcggagaaagactagtctagtagacacatgagagcagcccaggtcacgagtttgtgagggcacaggcttgctcgatagggccctttattttgtagtgggcccactccaggggttggagagccattccaggggcaaagacacaccctggagtccacccaagctgccctccatgggaggtttcaggagaggtcagggctgagatatggtccaaaagccagaggtctcttccaaacacaaggatttgtctccagggagatagtttactgaattgggctttggtgtcaggcatgcctgggtgaaaatctttgcttccagttctgtgacattccgtcacatccactaacttctcccgactctctggtcccattctctccagctcctttgctgactgttgccagtccatccaacctcagaatgttgtgtgtactcagagcttggtcctaggccttcccttgtttttgcttctgtattttgccctaagatggtgcgtgagtctactagggctgccataacaacgtaccacagactgactgggtgacttaaacagtggacatttattttctcacagtctggaagctaaaagtccaagatcagatgtcagtggggttgctttcttctgaggtctcttcccttggcttgtaggtggcctcctcctccctccgtttcacatggtcttcccccgtgcctgtgccctaatctcctcttagaaggacaccagtcatactggattagagtctgccctactgacctcattttaccttaattacttcttaaaagccctatctccaaatataatcacatttggaggtactgctgcttaggacttcgatgtaggatttcgggggacaaaaatcaagccagaacagatggtaatctcattcaggtggtgatccatctgatagggacccccccgccccgacctttagagcagcccacctgttcagtattcatacccacatatccataatagagctcttctcttcccccgggatcctctgcctcagccttttcctcttagcagatgccatctgcagggccacttggctgcccgtagcagtaaccgcacagtcttccacatttactccctcagcctcagctgctcctgcagcccaggcactgtctctgtctctgcattgctcaagcctccaccatctcggttacacctcacagccaccctccccgccttcagtcttcagcctcctgcccattgtcctccccacagtcatggtgacctcaagatgataaggtctttgctaaagcccctgcttggaatgttcttccctcctgcacttttcctagccaactgctgtccattatccatccttaaatttctctactagtcaggaatctaactgctgcaagaaacagcccccaaagtctccgtggcttcatacaacgggtttattttttgttcatataatgtctaattgggtatgtccagttaacaggcagccttccatgtggtcattcaggaactcaggctctttccatctgtgacgcctcccctttgagtccacaagagtccatgcaacagacagtaaagaagacacacacacttttcttaactactagtgctcacatcccattggccagaacttggtcatacgccctgcccacccggccacagggaaggctgggaaaatggtggaggcagggtacacaccaccagtctcagccacagagtcacttgactggaagaggctcacctgccagttcaaattgggcctctccttttgtgttcttttctaccatttgtactttttcttcatggaccttgtcacacactgtgttaattagatatttgagtatttctttaatatcggttctccccagtagaatgtaagccctataagaacagaaacaagtcctactgtgctcactcactactttatccccagtgccacaggcagggtccagtacaaaacgggcattcagtaaatatgagctgaaagatggaggaaggaagagaaggagggtatggttgggtgaaatcctaattctgccactaattccacagctttaggtaaattatacaactctaagggcctcgatttcctcttatgtaaagtggtaaaaatcattcttactatgcagcattattgtgtgactgaattaaggcagtgtcctaaggttcccagcagagtgcctgatatatatatatagtgggtgagtgatattgcagttatcataggattataatatatgtggaagctctagctccccagatgccgtggtcaaatgctttacggaaagttcttgtgcctgtgggtctgggtgtacatgggtaagagtgcatgcctgtgcttccttttggtgcatccctcgcatgctttctctccttccaggttaaagttaaacagtaagaggaaccagcttgtgagagaactggaggaagccacccggcaggtggcaactctgcactcccagctgaaaaggtgagtggtgggcggtgaggccactgctcccctgggcatggccagacatgggtgtccccagtgtcccagcccaggctctacccttcacttgtcctccgtggcttgagagtggatgtttagaagcatagcaaatggattgtcagcagactcgggcgtggcctggtgtagctaggaataggggtcttgacctctccagactgatagcacaaagaaggccccaggcaggtaataggtagtcttaagagactcggctgggtgtcatggctcacacctgtaatcccagcactttgggaggccaaggtgggtggatcgcttcagctcaggagtttgaagccagcctgagcaacatggcgaaactaaaaatacaaaattagctgggtgtggtggtgcatgcctgtggtcccagctactcaggaggctgaggtgggaggatgacttgagcccgggaggaggcttaccgtgagccgagattgtgctactgcactccagcctgggtgatagagccagaccttgtctccaaaaagaaaaaaaaagccttaggaaactcacactgccacctacctgcacaacacagagaatgtagcctcagacctgggcctccatgaacaacagtgcatcagtggaattcaataacattttgttccattagatttttttctaatggtggtcttctctttgtagtaagtgatactgcttttcaaattacacttaggatgtaaagtttccttttaatatagatgttttaaagtattaaaacagtgagttggggcaggcgtggtggcttacgcctgtaatcctaccactttgggaggccgacgcaggcggattgcctgagctcaggagttcgagactagcctgggcaacacggtgaaaccccctctctactaaaatacaaaaaattaaccgggcgtggtggcaggtgcctgtagtcccagccacttgggaggctgaggcaggagaattgcttaaacccaggaggcggaggttgcagtgagccgagatcgccccactgcactccagcctggcgacagagcaagactccatccccccccaaaaaaaaaaaaaaaaaaaaaaacacagtgagttgatttcaagaaagatattaagaaatctttattacataatggattcaactatgaaaacatatcatacaaatgcaacgtagccaattggagctttgggaaacacagatttagaggaaaaagtggacttttaaggcagctataacttgagtccaaagcccagctctgccatgtcttgattatgtggccttcttggggtatcagttttccatgaagtgggggtgaagggtctaccctagagattgccaagcaagtctagtgagatcatggtgctttccagagctcagcagaaggtctcagggggcccacttcactgtgtgcatctcactgtccttcccctccctgtgtcccagtctctcaagcagcatgcagtccctgtcctcaggcagcagccccggatccctcacgtccagccggggctccctggttgcatccagcctggactcctccacttcagccagcttcactgacctctactatgacccctttgagcagctggactcagagctgcagagcaaggtggagttcctgctcctggagggggccaccggcttccggccctcaggctgcatcaccaccatccacgaggatgaggtggccaagacccagaaggcagagggaggtggccgcctgcaggctctgcgttccctgtctggcaccccaaagtccatgacctccctatccccacgttcctctctctcctccccctccccaccctgttcccctctcatggctgaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaaggtagagagcaccatacccagagggtgggaaccaggaggagggaaagagatactctgtgctcagaaccccccagtgatcattctagtcgatatttactgactgcttctgtgtgctgggtctttgtatggcaagtatatttattcagtggatgtttattaactcagtatttttgaggtcctgtgtgaagggttttcagtagtagattctgtcctccaacagacatttagcacctcataaaactaaatgtcaggtcatcctgtgctaatggatatacatggattcatctattcatgattatagatatgctgggtgccaggcactgggttggtcactaaggattctgtgttgaagacagacagggtccctgttctcatgaagcttatgttcaaatggaggcacagggaataaacctgcaaccaaacaagcactacaaagaaaataaaacagggaatgtgatccagcctttctggttagaggtgggactgccagggcaggttgggttgtgaaagaagatgacatttgagggtgtcttgaatggtgagatggagccagccttgggaaaagcaagagcaaaatctctgaggtcagagcaagggactagaaggggagccaggaagccatgagtcagaggtagggggttaccagtgaggctggagaactaggcaagagtccagatcctgaaaggcctggtgggctgtgctaaggagtttggattttatcctaattgcactggggacccatgtgaccgtttgaagccaggaatgatatgatctgactcccattctgcatggggtcagaaagaacattttggtgttggccggaatttaagttggaatcttcaaaatagaagatgatgctgacattgacagctaagatttattaggagaaaacctttttatctttagcagcaaccacataataaatcataatagttaacttttattggggatatattatgagttgggtaatgtgcttgatacatggtgaaatcagttatttctattctgtccatttcactggtgaggaattggagattcagagaggtgatgtcacttgccttaggtcacccagccaacaagtgaggaagcagggataggaacctgagtgtttctggccccggaacccaacccccttattgtcatgccttaggctgggaggcagttcagcatgcacattcatgccaactcctggtgcttggggccccaccaaccccatctggctctgggtgtgaaggtcaggactgagtaggatgctcagtaaactcacctgggccttcttggctttcctggccacagtaaaaatagctcacaataatcatagctatgatatatagcgtacaggtgtttaggatttaggtacttctctgcatatttactcatttaagccttacaacacctctgggaagtgggtgctatttttaatctccttttttttttttttttgagatggagtctcactctgtcacccaggctggagtgcagtggcaccatctggctcactgcaacctccacctcctgggttcaagcgattctcctgcgtcagcctcccgagtagctggaattacaggtgcacatcaccatgcctggctaattttttttttttgtatttttagtagaggcgggctttcaccatgttggccaggctggtctcgaactcctgacctcagttgatccacccaccttggcctcccaaagtgctgggattacaggcgtgaaccaccaagtccagccccttttatccccatcttaaagatgaaaaaagtgaggcacagtgaggttaaaagacttgtctgaggttagtcccacagagtgaaatggcaagaccaggactggcacaaggaccacctgctcagaacgcacactgttatccatgtgctgagttctgtctacaaaaagctggtgctcctggctccaggtgaggccagctagaagcagccagacccatgtcagctctgtggctccaggcatgggcaggagtggtgctgctgtgcccagaattatccatgtgtgtacaagggccagtgggagcatggtagggaaatgaggtttccttgttaacgaaaggctttgagtgccagtggtttccttagaagaggagccgagagatccctgggtttccctcatcaggaagggagtcttgctgagtgctctcaaaataaaagcaagcgccctactatagcaggtggcaagcctcagaaaattgttccctggagaggagggggtgcaggtggaacctctaacaaggctcaaagagcatgcctctgatatcaatattaagccaagtcaggacactcagaccccagctatgtcctgtgaagtgaccccctcctctcccctccctaacagtgtctttggggcttgtgggcctcagacagcacattaggctgggcacacacaggtctcgggatggcatttccttcatgccatctccagaagccttccctgcagcaagcaatgccaggcagagcttagacgctaagcaggttatgtgattagtgccgctgttcagtcagcagacaaattaatctccttaagtggtttagtggagggtggagatgcgtgggtctgaaagcaggaggtctccgcgggctcagcaggcatgggacgcaggctcagcttccccatcaccagcacttgcagtctcccagacccgccttgtcacccatcgccgtccccggcctgccatgccctggactctgtgcccctcaatgctgcgagcccttgccctgctccggtctgcccgcaggtgctcagaggtgttagctgtgaggttgtaagatctggatctggccttccccgctgcaaggagggcaggaattgtcttattcatctttgtagttctgaacatggcaatgggcctggcacatcgtgagtgatcattacttgggcaaggaaggaatgtgcagcacgtgttgagtgcttagttatgagcctcagatcagagactttcaagggcccctgttaaggttagggaagaggaggagctgaattcggagtggaaagggataggcagtggaagaacgggtgcttaatctctcccttctctgtcctgagggtccaggggctgttattttgccccaggtgggtagggatggatctgttaggttgatgcaaaagtaattgcagtttttgccattgaaagtatggatatctacagtgataggaacagtagtggcaataaggatagttgtaatgagttttgcagagcactttgcctgcctgcaccaatctctatattaaggacttcccttataatgtctcgctgagtcctgtcaacagccctataagtaggtattattatccaagttttacaaatgaggcatctgaggcttaacaggattaagtcagtatctcaaggtcatgaagcagtgagtggtggagccggatttgaatccaggcagttcgactcaagagcctgggatggtaaaacacaaaatcacatgtgactccttccatcaccctaaagcaaacttttttttaattttttttttttttttttttttttgctttagcatttagaggtggttggaatttggtggaaccgtctgtcttccatagagagtgtatcaaaattgggagttcaggctccccgaatcccaaagtgttgggattacagtcgctgacgcctgtaatcccaacactttggaaggccaaagcaggcagatcgcctaagaccaggagttcaagaccagcctgggcaatatggcaaaaccccatctctacaacaaaataataattcaaaaattagctgggtatggtggcacatgcctgtagttccagtatttgggaggcggaggtgggaggatcaccagaacccgaagtggtcgaggctgcagtgagccatgattgtgccactgcactccagcctggatgagtgagaccctgcctcaaaaacaaaacaaaattgggagtcgcaaaggcagtttcctggttcctgaacctgcctttccattttccttccctagctgtgaatacggcccaggggtgtggcctgaaagtggcctgtgtctcagccgccgtatcggacgagtcagtggctggagacagtggtgtgtacgaggcttccgtgcagaggtaggtgtctgggtgctggctctctctgtggccctgtaagccatgaactctgaatatccagagcctaggcctgtggagaggcttaggttttggcccccacagtgtgtgggaggagccccaagagggcatgaccccaccttcctcttggctgcccaaggcacagacagcataacttttcctggggttagagatgcttcaggtttgggggagtgctagttctgtggtagctacgaaaaaggtatatggctaaggagcaagcactagagaaagggaaggccccttaagagaggagtccaagctgggcatagtggtgtgagtctgtaatcccagctacttgggaggcttcagtgggaggatcacttgatacaaggagttcgagaccagcctgggcaacatagtgagcccccatctctaaaaaaaattttttttaattaaaatttaaaaaaggacctgaagggaagctgagcaaaccccaactttccttcctggggatgtaacctcagcctcccagaatagtttgttcactgtagggaagcctaactcctcctcccctgttgcctttcagactgggtgcttcagaagctgctgcatttgacagtgacgaatcggaagcagtgggtgcgacccgaattcagattgccctgaagtaagtgacgaggacgaggaggacagaaggaacggtctgtgtggggtcccttcttcatccacagcgttccccagcatttaccttcacagccgcccagggtggaaggcagcaccagcaggacctgctggccattgcagcttcttaactgaagggatgctgattcgttcctcacctcccagccatccgctttacagataggagaaatgaggttggagaaatggggttttaaaagaccttatgacttggcccaactcactgagctggctggtagcagagccaggactgggactgagacctcctgcctctcagtgtgtttgttcattgttgctgtggcttttgtctttccatcccatctaggtttcattgatctggatggaagttgatcactgggggctgcagcccagattgggtcaatacacacatggttgttctttttgttttcttttgttgggggatgatatgatctcaatttttttttttttttttttttgagacagggtctcacctgtcacccaggctggagtgcagtggtgtgatctcagctcgctgcaacctctgcctcctgggttcaagcgattctcctgcctcagcctcccaagtagctgggattacaggtgtgtgccaccacgcccggctaacttttgtatttttaatagagatggagtttcaccatgttggccaggctagtctcaaactcctgacctcaaatgatctgcccgccttggcctcccaaagtgctgagattacaggcatgagccaccacacctggccttcaatattttttaataggaattagttgacaacatttccatatcatgaaatttcacccgcatttatgggttctttttaaaaattcagacaactggctgggtgtggtggctcacacctttaatcctgacactttgggaggctgaggcagaggaatcacttgattccaggagttcaggaccagcccaggcaacatgatgaaaccccatctctactaaaaatacacaaaattagctgggtgtggtggtgaacacctgtagtcctagctacttgagaggctgaggtgggaggatcacctgagcctgggaggtcgaggctaccatgagccccgatcatgccactgcactcaacctggatgacagagtgagaccctgtttcaaaacaaaaaaaaaattttcaaacaattggcagctctagctctacatccctgcatggcagcaaagcactgggcctgtgctctagagctcaccataggccccagggcagccaacagccacgtcctgtgacttttaatggagagaaggaatgagagagatgagtgtgttactaataggtacttcatatgccccttttcatttcaggtatgatgagaagaataagcaatttgcaatattaatcatccagctgagtaacctttctgctctgttgcagcaacaagaccagaaagtgtgagtatgtagctggacaggtgtatttcataccctaaccctctggagttacccctgggggtcacttttctgccctgtcctgatccagttatgggccttgtcaaggcactgtgggtttgtactgcatatgactgtgatgctgaatgtcggtgctgtgcatgtgaatacaggcacaacggcaagcacaccaactgtaaagacaagcactctctagatgactgtgtgaattcctgccccattacgtgctgagcacctgctgcatgccagctctaggaatggggtggtgagcagatccttcctgggccctaccctcctggactttgagcctcatggagaagaatggtcacagtctgttttatcttctcctaagctcaagtgtttcttgcagagagagataggtcttctgtttccaagagtcaacaccagtcactgcttctcttggaggggtgtgactgcgtgttaccttgatgctggtaggatgcaaacacctgctctgtctgcctgtgggctcctcccatggtagatgggtttatcctttattgcactcatctgcctccaagttttctctgatcgtaaggcctggagggtggcaacagaagcttatgtgtctgtggtctacactcagccagcctgtgagggtggcacatgtgggaagaagaaagggcaggaaggcggacaaaacggaaggaagacaagatgggatgcttgggtcaatttcagtcttctgcccacacagacagtgccaggctgaatagcctcctccatagctcactggtactcatgcaggggcatctgtgggataatgcctagaagtgaagggtctggaccaaaggacaaatgcatctggaattttgttcgatttgtcaaagttccttccagtgtataggggcctgattccccagattcctcacttctacaaactctcatccactgttgtttgcttagggatttcagcagctgtttagtccaacattttagccccagacatgggctgacccaagatttcctgcggttctgtctccctctaggaatatccgcgtggctgtccttccttgctctgaaagcacaacctgcctgttccggacccggcctctggacgcctcagacactctagtgttcaatgaggtgttctgggtatccatgtcctatccagcccttcaccagaagaccttaagagtcgatgtctgtaccaccgacaggagccatctggaagagtgcctggtaagggccgtgtctggctggctggctggctggctggctggctggctggctggctggctgaccggccttctgtgtttatggggattggtctaccctgagcttcaggaagaaggttcgaaggagacgcaggttgtgctatcaatcaggctcatcttggattctaggcagcgaggcttccacaggtgaatgttgttctcagacttagggtgggagggaaggagctctttcacaagaggaagagtaatggacctgaaagtgccttttaaaactgccagaacctggaaaaagccacatactgcagctttactatacagcatgagagattagataagaagcacagactatggctgtgtggtggcttatatctgtaatcccaaccctttgggaggccaaggccagaggatcactcaagtgcaggagttcgaaagcagcctgggcaacacagcaagaccccatctctacaaaaaataaaattagccaggcatagtggtgcatgcttgtagtcctagctactctggaggttgagatgggaggatcccttgagctgcaatgagctgatcatgccgcagcattctggcctgggcaacagcagaaccctgtgtcaaaaaaaaaaaaaaaaaaagcacagagtaatgaaagcaaacacataggcattcacatcccacctttaccacttgctgtatagctggatgaccttgggcaaggtacttaacatctctgatcctcatttttcttatccctaaaatgcaaatgataatgcctccatcatgcccactggaagaatctttataaggattgagatagcacccgtaaaacacctattcaagtgtctgatccacagtgggttctcgtttagtggggccattgccagcctcctccctgaaactgaccttctccggcttccatctctcactgcattggcaggagtcaggactggggatgaagtagcccaagtacattttgtcctaagagacaggcagacccaagtgcagacagatactcagctttcccatctgtagaagggggatttatataatagctaactcgggcttgtgatgtacaagtgaattagaagaagtaaagggctttgttaaccctgatgccatttagtgttagaatattttaatgataactcaactgtgggcacaaaggagcccaagtgtgggcattatacctagaaggtcgctccactcatgctcagatctgtactgggagcttgttgtgtccccacccctgtgtctggggctggggattcaatggggaaccaaacagacaaggtgccagcattgatggctaagatgtaaacaaactgtgaggagggccgtgttggaaatggatgggttgaagtgatggaggaaaatgtggggtatgtgcaaaggggaaaaacaagatgtatacacctctccgagcctctcctgcctccatttctggaagctggaatgtagagcctctcactgccttcttggagggctcgcccctttctcctgctgtaaatcacagacctttgcccagagaagggaatctctttgctctccatccttgccttgatctgcatgcgctataaaacccttctctatcatggcattgtggggccacatccttggattgtggcctggggctgtcaccagccttgcccttccagctgtgtctcctcacagtcttcaattcttagtctcagttcccttatctgtaaaatctggctcatactgccttcctggaggtggttctctgaagactaactaaggcgctgaagcagcgcttcaaactgtgccatgcacacaagttacctggagctctggctaaatgcagattctgattcagcaagtctggagcagaacctgagattctgcatttctaataagctcccaggtgaggccaatgctgctggttcctggatcacactttgggtagcaagaatgtagagcagcaaagtgtttgcagtttgtgctcactggatatcggttcccatctctccttcttagctgggtacaacacagcatcactgctattgatgttgttactgacaataatgcagtagttaataccagtaggttgcagtttatatggcaggcactgagttaagctctttacatgcattatctgttttttttattttagactgagtcctgctctcagtctctggagtgcagtggcgtgatcttggctcactgaaaccttcacctcctagattcaagcaattctcctgccttagactccagagtagctgggactacaagcgcccaccaccacacccggctaatttttgtatttttagtagaggcggggttttgccatgttggccaggctgatcttgaactcctgacctcaagtgatccgcctgtctccacctcccaaagttctgggattacaggtgtgagccaccaccccagcccattatctctattgatcctcactccaaccttgcaaaataggtagcgtattccagtggagaaactgaggcacaaagaggtgaaagacctttcctgtcacagttaggaaagtggcagaagccgtatttgaaccccagcaggtctccctctgaagtccacacacgtcagcgcctctgtgttgtctctttgccagcacagggctccctggagcccagagatgggggtggtgacttgaaggggttggcaagcctgggctcctccagcgaagcattcccttggccctgggcattcctaagcgagaagaggctcaatcctattttcttctcctaattggatgccttttattcctccttcctaattgaagtctggtcattgctggttgccatggcagcagccaaagcgctcatctcactgtggcttgtctctgcctgcggccaatgggaaacctcctttcccatatacggtggggacatggagtgtcaggctgtcgtattctggtggctggaggaggagaggaagtgagatgggaggaaaaaggcctgtcctctcccacgcagagactccggacagcaggatgtgtggaatccccagtctgttttcagccaggcagcaacagcatctgtactgagttgagtctatgtgtctaccagtgggctaagaacttcatgtgcagtatctcatttaatcttcgtgatggccccaggaagataagggatcaaggcccagaaaggctaagtaagctgccaggtcatccaaggagaaaatggcaaagcctggatttgaacagagactccagcttccttatgtgtagccatctcaccatgctacttctcagggggttactatgagtgtctctcatgtccccagacccagattacaggtttggaggaatacacagcccaccttcccaatatcgcaggcaacagttccaccaaatgccctgcatggcatcacagggagcctagttgcccactgctctactgctgagctcaatgccacccagcccgggctctctcgagctagcctgcttctcaggccccactgacgtcccatggttcaccattacaaccgttcccttgcctcctctcactttggcatactaacttggcaaaacccagccctgtcaaagtgaactctccaccccctcctctccaactgagcaactggaaaaaaaaatgcacacaaccacgctgtatggtatcatttggaaatggtgatcactcacttcccatgagccctcaatgctgcccagaaattatactgtatctccctggaccatttactcacccactcatcacaatgactaattcatacttctctcagggagagaagagaggacagactcagaagagggcccccacaccatatctggctgttcttgtaggttctgccatttccctggcttctgagggtgggccttctgcactcctgtctgaggccaccacccccattttctcgcaaggacattactccagcagccattccgctctttcctctatcttcaattttccctcctccactggatccagcctatcagtatatcatcatgctgttatttctcccatgctcaaaacaaaacaaaaaaattttttttgacagaggatcttgctttgttgcccaggctggagtgcagtgctgtgaactcagctcacagcagccttgaccttctgggctcaagtgatcctcccacttcagcctctcccatagctgggactacaggcacatgccaccatggccggctaatttttgtattttttgtagagatggggtctcactatgttgcccaggctggtcttgaactcctgggctcaggcagtcctcccgcctcagcctctcaaagggctggggtttacaggcgtgagccaccacacccgacctaaaacttttttcaccccatttccacttccaactactacattgtttctttccctttctttatagaaaaacttgaaagaggtgttcccttcctctctgtaacccaatccatgtggactttggccctcatctttcttttttctttttttttatttttgagacagagtctgttgcccagactgaagggcaatggcgtgatcttggctcactgcaacctccgcttcccgggtccaaaccattctcctgcctcagcctcccaagtagctgggactataggcacgcgccaccacacctggctaatttttgtatttttattagagatggggtttccccatgttggccacgctggtctcaaacttctgacctcaagcgatccacccaccttttcctccgaaagtggtgggattacagacgtgagccaccgtgcctggcctggccctcatctttgtaccgagggtgtgctcttcatgttcctcagggagctccttgttaccagaccagaggccagctctccatcttccttctggacctgccagctacatttgccacagttgctgactccacctccttcaaaatcctttgcccttgcttggcctcctggttacctcgctcttccagtgttctcccctcacctctagcatgttggtctcctttgctgattcttcctcatttccctgacctccctatatcagagggcccagggctgggtccttgatcctccccttttctactcatttccttggtgatctcattttatctcccagctgcaaacccatcccaagtgcagggctccagcatgggcctccgcactcgcctcgaatcttgtatctccactgcctgttctgcatcttcacttaaacgtaaaataggacctcaaacgaacatggccacaagaatgcccctgacctttcatcctgtgtctccgctgtctcagccgatggcaatctcattcttccattgctcaggccagacaccttgcaatcatccttaacccctctctttccctcaccccatcctcttagctccaccttcaaaagaaccctagattccacttctcaccacttccccagacccaagccactgtcttcccttacctggatgatggcagccatctcctacttggtttcccggcttctgtccttttccccttcctcttttttcaacagagtagccagactaatcctgtttaaatgtaaatcagtgcatgccattcttttgctaaaaccttatgatggcatatgtctccacctagagtcaacacctgtgtcctttgcctggcctccaaggccccttgggatttggccacttattaaaatctctgggattatatccccaaaactcttcctccagcctcgtgttccttgaatacacacaccaacatgtgctcccctccgggcctttgcacttgctgtgtcctctgcctggcattctgtcctcccaggtgctccctcacctccttctggactttattcaaatgtcaccttctctgtgaggtcttccaccctatataaatcccattaccctctctgctgtcttatcccctcctagcccctttccctgtagtattttccctacagcaccttttatcacctaacatttcactgtacgtcatagattctagggtacatgttatctctacattttacttctgaaatcaagatgcactatgtactagatgacaggttatagtttcattggcaactatttctctttcttggtgcataaaataatggtacacttttaaatgatggcatcttagattcgatgaaacacagtgtggagtttacctatggagttgttatctgatccccctagatgcaaatataaggtcatggggcaggaatatttatctgccttcaattctgctctatctccagcacccagaacagtgcctggcacataagacttctcagcagatttttgtgtgttgaataaatgaatgaatgaatacgtaaatgccctcaaaagtgcatccagtttactgaggtagacaatactcacacctgtgagcccgccccagataaacagtatatcttgttagaattaataataatctgctggaggtgttacacctcaaagctgtgatcctggtcttttcccctcatacctcacacatggcctggcatgttctgaactgtaatatccaaatagctgtctatccccctaggaaaccacgagacccgttttggggaagaatcatgtcttacatgcttctgtggctccagagtctgcgaagggcttagggagtttttactgaatgaataaataagtattagacaaatatttgtatatatgtacatttattctgggtgtctgaagtgtgccaagcatttaattacctctgatcctcccaataggctggtaggtaggagtgattttccctgttttccagatgaggaagctggtgctaaacaagtgaagtgtcagcattgtgctttcttcctttccccactcaacaccgtgctctcagaaaccacctttcactgtcccagacctagcacagccctgccacgttccagtgcatcttgatgaattgtagcccccataatccccatgtgttgtgggagggacctggtgggaggtaattgaatcatgggggctgttacccccatgctgctgttctcatgatagtgagtgtgttctcatgagatctgatggttatataaggggcttttcccacttttgttcggcacttctctttgctgccaccatgtgaagaaggaagtgtttgcttccccttctgccatgattataagtttcctgaggcctccccagccatgctgaactgtgagtcaactaaacctctttcttttataaatgactcagtctcgggtatgcctttattagcagcatgagaacggattaatacacttggctacaggtccattttgcaaactggcatttggtatttctaccacccatcagcacagagtctggttccacccaccgacactggtgtgttaggggaaggtgagctgaccaccttcccaaacctgaccagggctcatttttgcacatgtcgaaacaataaagcctctgaggaatgattaattagtttgtagtaatttctaggaaggctgtaggggaaaaaaaaaacagtaaaaatattaagtcacttgaaataatccccttctctgtgagcttatagtcagtcaggttagtttgttatagtttgtttttattttaagggatatatttacataattcaaagaaaaattgtatggaaaggtttactgaagagaaatcatgctctttccccaccccagcctcaccatctatcctatataggtgaccactttgattaatttcttttgcatctttccattatttcttgtgcacatatgatcatggtcactccccctggcacctcaagcatggtgcaatatgtagatagactatagacacagatatacttaccccactctcttgcacaaaaggtagcatattatatattcttttctgcaccatgctattttcttcccttaacaatatagcctggccatctctctgcatcagtaaaaagagatcttcctcttttttacatgactatataatattccattgtatggatagattatagttcttttagtctgttccctgttgctggacctttgggtcatttaaaatctttcgctattggccgggtgcctcacacctgtaatcccagcactttgggaggctgaggtgggtggatcacctgagatcgggagttcgagaccagcctgaccgacatggagaaaccccgtctctactaaaaatacaaaaaaaaaaaaaaaggccaggcgtggtggcacttaatcccagctactccagaggctgaggcaggagaattgcttgaacctgggaggcagaggttgtggtgagccaagaccatgccattgcactccagcagcctcggcaacaagagcaaaactctgtctcaaaaaaaaaaaaaaaaatctttcgctattacaaagagggtcagaatgaagactcttgtttgtgggtcgttttgtacttgtgcaggtttctgcaggtgtatctgtgggatagacagctacaaggagaattattcggtcgaagggtaaaatgcatttatatttttgctagatatgactaaattccttccgtcgggtttctgccattttacatttccacgagcaaggtgagagagggcctatttccccataacctcaccaatggcatttgttgtcaattttttaaacttttgcaaatttagtggagaagaaatgatacacagttttctacctcacttggaattaattacttgttcagttcctgagttccttgggagagtgctggctcccagaaggtggaaccaggtggggaccatcattatcctcagtacctaacacagaacctagtgcttaatataagtaacacagaatgggtattcaacaacaaaaaaatcaacccaatttgaaaaggggaaaggacttgaatagacatttctccaaaattaatatacaaatggccaatatgcatgtgaaaagatgttcaacattactagttatcagagcaatgcaaatcaaaaccacaatgagataccacctcacacatatttggatgatggctatccaaaaaccacacaaaataactagtgttggtgaagatgtagagaaattggaactcgtgtgcattgttggtgggattataagcactcccttagcaagtcttaaggtaaacagtgtagtagttccactaaaaaattaaaaatgtaactaccatatgacctagcaattgtacttctgggcatatattcaggagaattgaaagcagggttttgttgttgttgttgttgttgttttgttttgttttgtttttgaggcagagttttgttcttgttgcccaggctggagtgcaatggcacgatctcatctcacctgcaacctccatctcctgagttcaaacaattctcctgccccagcctcccgagtagctgggattacaggcatacgccaccacgctcggctaattttgtatttttagtagaaatggggtttctccatgttggtcaggctggtctcgatctcccgacctcagatgatccacccacctcagcctcccaaagtgctgggattacaggcgtgagccaccgcgcccggcctgaaagcaggttcttaaagaattacttgtacactcatgttcatggcaacactgctcacaatagtgaagaggtagaagtaacccaaatgtccatcaacagatggctggataagcaaaatgtagcatacccatacagtggaatattattcagccttaaaaagaaagggggatctcttagcccaggagttcgagattacagtgaggtatgaccgcatcaccgcactccagcctgggcaacagagtgagaccctacctccaaaataacagcaacaaaaaaggaatacaattctgatacatgctgcgacacaggtggaccttgaaggcattgttaagttcaataagccagtcacaaaaagacaaatgctatatgattccaattatatgaggtatcgaaagtcatcaaattcatagaaacagaaaatatagtggtggttaccaggagctgtggggaaggggaaaaagaggttgttgcttagtaagtgtagagtttcagatttgcaagatgagaatgttcagtagatctcttttgcaacaatgtgcgtaatgtttaataccactgaactgtgcacttaaaagcggcaaagatggtaaactaaaggtttttttatcacagtttttttaattaaaaaaattcataggataagtcttcaataaagatttggcaaatgattaaaccaatcaatcaatgaatgaatgaacaaatgagctaattggaaatgttaacaacttggcctctcttcctgccgggatgcctacctctcatctggagtggtgttttttccatactgtcctcttgaaccaaattccctgacacctggtgtcccccccaccgccacttatgttctccttgtttccatccccaacagggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggtgagctgggaccaggtgtgccaccttcccacaaggccgcacccggatgttggaagggaaagcctctcccagaactggaggtgatcaggcgtcatgagaggagaacaatggggtggaggaagtaggagaagaagacagggaaggagagatctccactaaggggcaggcggctccctttctgcaacttgttcccttccacatctgtgtttcctccttctgtcctttgccctacctaataccacttggctaacgaaaaccttaattcatgattttttacaaatgaagtggagaagaaggtaaaaaactgtggaaggaaaaagattaacctttcttgggcccctactttgttcaaggtccatactggaggctttgtataagaggcagctagaaatcatgggaagagaatcagagggctaggtcagtcatatcacctctctgagctttcaatttttaatgtctaatatgagccttaaaaggttgttatgaggatgggcacggagcctcatgcctataatcccagccctttgggaggctgaggcaggaggatctcttgaggccaggaattcaagacaagcctgggcaacatggtgaggccttgtctctacaaaaaaaaaaaaaaaaaatttaattaaaaaaaaaagtttttatgatgctttgaagaaatatatgtaaagagcacttggtaactgttccattgtgactttgttatttgaaaatcttggccgggcgtggtgactcatgcctgtaatcccagcactttgggaggccaaggcaggaggatctcttgaggtcaggagtttgagaccaccctggccaacatggtgaaaccctgtctctactaaaattctaaaaattagccaagcatgatggcagtcatctgtaatcctagctactagggaggctgaggcaggagaattgcttaaacccgggaggcagaggttgcagtgagccaagattacactgtcgcactccagcccgggcagcagagcaagactccatctcagaaaaaaaaaaaaaagaaaagaaaaaaaagcttatatttgcttattttcagtgaaaaaatatgttctgttttcattttagcgcagtacgctttaatgtattaaaatatccttaaactgtctcccccgtttggaaagcccacacctactggccaggcagactagtcagaactcagttgagcagtgaagttagtcttacatatggggtattggactcctatgggatcccgaccacatcaaaaaagttaaatagagagtgttttggattcaggttttcttgtaatcatctgtaatgatccttccctctctgtaacggttgttccctctgtcgatacttggttagtttggacagccactgcctagaatttcaatggagcggatgggttgggacatacaggtaaagataagggtagcaaatagagaaattaagtctattttctttgtctctttctcctcctcctctcctttccctcccatccccaccttctttttcatcgtcatcatcatcatcatcattttctgtacttccttttgcatcaggcactgttctgtttattatgtgcagtttaccaaggctcagagagataaccaaattacattaagatgtacatctcatcagcaaagctaggtctcaaacccaggtctctcactccaaaaggagactgtgagctgataaaggtctcgaaaacaaactcctctcctttctagagcatgaccttgagtaagtaacatcaaccctagacacactagttctctccttcccatttctcaagtgagtcataataattcccacctgtcaggatggttgtaaagattaaataagatgctacacataaaccatctttcacagtgcctgctatataccaggccttcagttgattttagttccctctttcccttcttacaagaaaatgtcaggaatttttcaggctctggcccacactaccaagggtaaccacaaattaaccatgtgctcagaaaactacaggatccagtttttgctttggtattagctaccatttactgggtgccaattatgtgccaggtattcttctgtgttcctcatgtagagtctcaattaatcttcataacaaccctttctagcagttattagaggaaacagtctcagagagtttaaataatttcctcaagtcacatgggctttttcactgtagataccattcagtataaatgttcctctttcaggaagccctccctgaatgcaacttcccaagctttatcactgttccgctgttcccaaacagccagtacttatctcctttcacctctcttctatgtcatatccttactgtgttatgttactgatggttcacacattggtctgatgacactgtggtctgcttacagtcagagaccttaattctctctcacttcactgctaaacttggctatcttccatcacgatgctgagtaagttcatacatacaggagctattctctggagaactgctagttgaaggaattaaggacaatttttccagtttatcagtgaccttgggcaagacacttgaccactctggtctttggtttcaccatcaattcactgggagggtcacagctctgagatgctctgattcctggcaggtagggtggcacctacattgtacccaatgacccagcaacctttgtctctataggacgctgtgtctgctctgttggaacagacagcagtggagctggagaagaggcaggagggcaggagcagcacacagacactggaagacagctggtgagtgagcccgcccttgggccccaggagctgccctgcctggacctaggcccagcaatgagatcccccaatgccagtgcaactaagagaagggttccactgggaaggctgagaacccctctcctcatgggttctctacaggcaaaaaggcaatgtaacctagtacgatggttcccagaattcctttcgaatttgccatttcgtttcccatgaatcacctatgctagttcacacctaatgttattctttatcttgatatagtgacatttattttgctaaaaaaaaaaaaaagtaaagaaactttatgttactctaaatggaaaatttgtgtagtttgccataaattaaagagttcttgggaattgcatttgactttcaggaatggagagcagaaatattagacagaaataaattagaagtttacttcttcttcacttaagaagaagagggccaggcacggtggctcatgcctgtagtcccagcactttgggaagccgaggtgggtggatcacgacgtcaggagctcgagaccagcctgaccaacatgttgaaaccctgtctctactaaagatacaaaaattagctgggcatggtggggcacgcctgtaatcccagctactcaggagggtgaggcaggaaaatcacttgaacccaggatggggaggttgcagtgagccgagattgcaccactgcactccaacctgggtgatagagcaaaaaaacaaaagaaagaagaagaatgtaatcccagctattcgggaggctgaggcaggaggattgcttgaacccacagtgaaacctcatctcaaaaaatttttaaaataatgggagaggccaggcgtggtggctcacgcctgtaatcccagcactttgggaggccgaggcagatggatcacctgaggttaggagttcgagaccagcctggccaacatggtgaaaccccatttctactaaaaaatacaaaaattagccaggcatggtggtgggcacctgtaatcacagctacttaggaggctgaggtggggacaattgcttgaacccaggaggcagaggttgcagtgaaccgagattgcgccactgcactccatcctaggtgacagagtgagactctgtctcaaaaaaaaaaaaaaaaaaaaaaaagagtaagcagtccaaggctatccaattctgtcagccccatggtgttactgggaatccaggctcctttcctctgtctgctttgctgtctttactatgtgacctccatcaccgaggctgctttatagcccaagatggctgctggatcaccagccatcaggcaggtaaccatcaggaaagaggaaagacaaaagagagcatgcctgtgtacctgttaaccaagaagcattcctgaatgtcccacacagcaacttttgcttgcttttcattggccaagcttagccacttagcctgcctaactgcaaaggagactggagaatgaggtctgttatttgggtacaaaaatcaaatttctgttactaacggagaaagtggatactgggtagaccaagagccaagtctgcttcaaaaggtaactgtggaaaacacagtgtaatgaaaataaagcaatattattaaagtctagttagatatattgcttgctaagcctgagccttctctcccattattaaaaaaaaaaaaaaaaaaaaaaaaaaaaaggttagcaagtgtttcagcaatgttgaagacatgctattgccgaagagagactttctccctgatgtaatcaaaatgtctgaacattgaaaaggggacaactttctcactttgtgattcagtgttatttaattccttgtattatgagaaaggtctcatcatacactttaagaaacaatgacatagacgagggtttgaaacttggatttttcatgttttgtgtaaccttaggcaaagtattttttaaactttctattgcagtgtaaaatacatgcagaaaattcacctaagcatagagctgagtgaattttcagaaagcaaaactcctctgtaactagcaccaaatcaagaagcagaatgtgacgagcaccacagaagcccacaccttgtgtcactgttgggcaagtcgctctaaccttgtctgaacctcatctgaaaactgaggaaataatactgactatgtgaggttactgaaagagactcaagggaaaggcactaatgaagatcaggtgcaaagcacatagtagaccctcaatacatggttgaaatcattgttaggaaaaagagaaggaacgttcctcactactggctggaaacagggtaaatcccatgtaggaaatggccacagcctatgagtcttgccatttggaaggaaaaataagttggtcttaagtgcatgtgctttaaattcagacagatatggatctggagtctagctcagccaacttccttctgggatcctgtttctgaccggtaagaccttactgagcattagtaagatttaaaagctccctgggtgattctaatgtgcagcctgggctgaatatcacagctgtaaacttccgtctcctcgtctgtgaaatagagatttagaaaacagccactatgtcatggggtattttgcaaaattcagtaaaattatgcatgataagcacttaacacagaccctgacctggaggaaacattcaataactcttccgtattattattctcttagagcctcaaattatatatttagtctcaggcggcgccctcccgtaatatctgttactccacaggtcagcagatgatttctggagagggccagatggtaaatattctttgccttgtgagtcgtaagaattctgttgcatcccctcacctctgctgttgcagtgtgaaagcagccgtagacagtatgtaaaccaatgacactgtctgtgttccactgaaacgtcatttatggacactgaaatttgcattttatataatttgcaccttttcaccaagtattccccttttgatttttttttcagccattttaaaatataaaaaccattcatggcttagactgtccaaaacaaagcagcagacaggattgggcccactggctgtagtttgctggttcttgttttactcttctctcttactatttttttcatgtgataaagcagatggcaaggttcctggaatttttgtatgttcctttgttagtttagggttctctctaaattgtctcaatctctctctccccctccttttctctctctttctttctctctctctgtctgtttctccccactgacccctggccatctccctctctctttcctttcctctctgtttctctgcctctctctctctttctgcttggcacactgctgtgccacactctactacggatcacacaggcaaaggtctgatgccagaaataggcccaggacctatctcccaaaaccctggcacaagatcagtggtttccaccaaattccaagcttgtgctgagacttttcaagccatctcctagcaaccgccttctgtcccttctccctttttggcccctgtctccacaccccctgccattcaaacttcccccagacgctgtcttacaaagggggctggggatcccagagctgctgtagtggggcaaaccatctgcggccccctcccccaagactggaagcctctcttggtcctgggatgttaactggccttgccatgcctgctcatctctggagtcttgggttctggtctccaaaaggctgtccgtctgttccaatttacagtccttcctcggcacccaaaacccggcgtgtcactggtactccctctttttattttgtttttatatgtctttaaatgatataatcagaaaactggatttttttttaaaagatccacaagcaaaataaaactaagagtgttagaaaatacaggagaatataacaccaaacaatactatggggaaaaatctttgtatttgcctccttgggaactcgtatttgtctggggcagatgctgagaagtggcattgctggatcgcagggtgtgtgttttttatattttaatagacatcatagaatagttctcaaataagattttttttttttttttttttgagacggagtcttgttctgtcacccaggctggagtgcagtggcacgatctcagctcactgcaagctccgccacctgggttcacgccattctcatgcctcatcctcctgggtagctgggactacaggcacctgccgccatgcccagctaattttttgtgttttttagtagagatggggtttcaccgtgttagccaggatggtctcgatctcctgacctcgtgatctgcccacctccacctcccaaagtgctgggattacaggcatgagccaccgcacccagctataagattttattaataaatgctcccaccagcaatgattaagagtaccctaacctacagcctctctgacactcaatctaatcaaactgctgtaacttaattaagcatatgtacatttttttattttaacagataaggctaaatggccttcagaatgtaaattggctgctctccttttcacttcccacagggatatgcctgtttctgtaccttcaccagcacttgatattaccagatttttttccgctttgccactccagtaggtgaaaagatattgttgattttaattatttttctctttacaattaaaattaagttgggtttgtggtttttttttctcatcttggaatattgagatcagattcacagtcaaaaagaagagactcccgtaatggttgagcacttagtggatctagacaaacctgttttgcaatcctggctccacaactagcctgccacattgaacaaggcctcaggcctctgccgctcactttttgaatctgggaaatggagatcatctctttgagcactgttgtgaggtgtagcacctggagcttattgagccctcaataaatactggtcaatgtggcttctacagagggctttgtggaggggctccctgtctccctgtgtgttcacatgtttaacagctcttttttttttttttttttttttgagacagtttcactcttgttgcccaggctagagtgcaatggtgcgatctcggctcactgtgacctccacctcatgggttcaagtgattctcctgtctcagtctgccaagtggctgggattacaggcatgtgccaccacgcctggctacgtttgtatttttagtagagatggggtttttctccatgttggtcaggctgatctcgaactcccgacctcaggtgatccacctgcctcagcctcccaaagtgctgggattacaggcatgagccaccgcacccgccaacagctcttttatttgtagatagagaggctgctggggccaaggaggagagccaaggcccctccacagccgcagtcctcatctaagtacagaagaggttttaattgcagagttgcgagtagagatccaaaatgcattctccccattgggaaaatcctcagggagattttatgtttccccacactctcgccgagctagctagctggatgtcagattctctgcttttggctaggattcttttggctcagtatgataacactgtctcatgctgatcagaagccgggcagttctgtatgtctttcagaagtcaagatgggaatagagataaattactacttaacaaatgcagcctatttgtcacaccaaatccttccaaccttggagtccaagggaaatggaaagttttaaggactatcaccaaaagtcccttcagcaaatggtgttggaacaattagatattcatatggaaaaaaaaaacttgaacacttacatcatgtataaaaattaatctgtggctgggcacggtgactcacgcctgtaatttcagcactttgggaggccgaggtgggtggatcatgaggtcaggagatcaagaccatcctggccaacatggtgaaacaccatctctattaaaaatacaaaaatcagcttggcatggcggcacgtgcctgtaatcccagctactcgggaggctgaggcgggagaattgcttgaacccgggaggcagaggttgcagtgagctgaggtcgcaccactgcactccagcctgggcaacagagcgagactccatctcaaaaaaataaaataaaattaatctcaaatgggttatagagctacacataaaacctgaaattatagaagttctgaaagtgtaagaaagaaactattcacaactttgaggtaggcaaagatttcttaggacataaaaagtacaaactataaaagaaaaaaatcaataacttgggctttatcataatcaaaaacttatgatcttcggaagacaccactgagaaaatgaaaaggcaagccacagacttagagaaaatcgtgcagtccacataccagacaaaggattcatagcgcaaatatactaagatttcttacaactcaataataagacaacccaatttttatttttattttatttatttatttattttgagacagagttttgctcttgttgcccaggctgcgatctcggctcactgcaatctcggctcactgcaatctccacctcccggattcaagcgattctcctgtctcagcctcccgagtagctagaattacaggtgcatgccaccacacctggctaatttttgtatttttagtagaggcaactcggttttatcatattggtcaggctggtctcgaactcctgacctcaggtgatccacccacctcggcctcccaaactgttgggattataggcgtgagtcactgtgcctggccaaaaacctgatttttaaggggctggagattgtaacagacacttcacctgggaagatggtcataaatgcatgaagagtttctcaacaagaaaatgcaagttaggccaggctcagtggcttacaccagtaatgttcacactttgggaagctgaggcaggaagatttcttgaggccaggagttcaagatcagcctgggaaacaaaaccccatctctgcaaaagatttactaaattagccgggcatggtggcacgtgcctgtagtactagctacttgggaggctgaggcaggagaatcaatcacctgagcccaagagttcaaggcgacagtgagctatgatcacaccatggcactccagccttagccttggcgacagagcaagatgctgtctctaaaaacaaagaaagaaaaaagaagaaaatgcaaattaaaacccaacaagatgcaagtacacacccagtagtagagtgactaactataaagataaacaacaccaagtgtagtgaggaactagaactcttagaacattgctcaggggaaacttaaaatggcaaaatcactttggagaagccatttgttggtgtcttttttttttttttttttttgaggtggagtctcagtctgtcacccaggctgtagtgcagtggcactctctcgactcactgcaagctccacctcttgggttcaagcaattgtcctgcctcagcctcctgagtagctgggattacaggtgcccaccaccacgcctggctaatttttgtatttttagtagagacaaggttttaccacattggccaagatggtcttgaactcctgacctggggtgatccgcccaccttggccacccaaagtgctgggattacaggcgtgagctaccacgcctggcctgttggtgtttaaaagggtaaatttatacttaccgtatgacccagtaattctattatctgttaggggctgatttgtgtccccccaaaattcaaacattgaagccctaacccctagtacctcagaatgtgactgtatttggaggtagggcttttaaagaggtggttaacacgagaccattgaagttgggctgggacctcatacgaggatatttggacacacagacaccagggatgcgcatgcacagaggacagactgtgtgagcacgctgcaagaaggcagccatctgctagccagggaaaggggcctcaggtgaatcaaacctgctgacaccttgagcatggatttccagcctccaggactgccagaaatcagtttctgttgtttaacccacctagtaagtggtgttttagttttgcaaccctagcaatatccaacagaaatgaaaacctatattcatgcatagacttgtacatgaatgtacaagaagctttattcatacttgcttggaaatgtaagtaatccaaatgttcatcaactaaactctccttctctccctcttcctcctcctcctcctcctcctcttcttcctcatcttcctcctccttttcctcaaccacccgcctcgttccaacgtttggaagccctaccctgggtgcatttaaaggcaggtgaacagatctaaacatgttgcaatatagccatccaatggaatattaatgataaaaaggagtgaactgtctgggcgcggtggctcacgcctataatcccaacactttgggaggccaaggtgggtggatcgcttgagcccagtagtttgagaccagcctgggcaacataccaaaactctgtctctacaaaaaataggataattagccaggtgtggtggcacacacctgtagtcccaacaactcaggaggctgaggcaggaggatcacttgagcccactggtggaggctacagtgagccaagatggtcccactgcactccagcctgggtgacagagtgagactctgattcaaaaggaaaaaaaaaaaggaatgaaccgctgatgcatacagcattgtggataaacttcagaaatgttatgcagacacagagaagtcagagacaaaacagcatatattgtctgattccatttgcatgaaactctagaaaagtcaaatctaatctataataacagctaatcatggctgcctagtgggtgattaaactgggaaaaggtaggagagaattctggtggggaatggaatgttctacatctcaagtacagtggtggttacataggtgagtacattggccaaaactcatcaaactatacactgaaaatgcctcattaacaatctttttttttgttttgagacagagtttcactcttgttgcccaggctggagtgcagtggcgtgacctcggttcactgcaacctccacctcccgggttcaagcaattctcctgcctcagcctcccgagtagctgggactacaggtgtgcaccaccatgcctggctaatttttgtatttttagtagagatggggtttcaccatgttggccaggcttgtcttgaactcctgaactcaggcagtctgcctgcctcggcctcccaaagtgctgggattacaggtgtgagcctggccccccaaaactttttaaaatatatcttcaatcatcaaaaggattggaagccctaccttgggtgtattaaaggcaggtgaacagaggcagagcggcttctgggtgggtaaccaaagtgctttgtcatcacaggaggtatgaggagaccagtgagaatgaggcagtagccgaggaagaggaggaggaggtggaggaggaggagggagaagaggatgttttcaccgagaaagcctcacctgatatggatgggtacccagcattaaaggtaggaagggctggggggatagaagggctgtcgtggggaaggaaccttcaatccttgtgccgaggcagtcagaaaagactcagagctaagtcttggcttccagcatcagggcacaagccctcataatggagtggcctttgggtcattctggtgatagtaaaccaggagaggccaactcacccatctcttttcttctgccctctgcattttccatgacttctctggacataactcaagccttgcagtcagacggtttgggtttgaattctggctctgatactccctggctgtgtagtcttaggcagatgacttcatccttctcaagcttccattttctcatctctaaaatgggcacaataataccaaccttgcagatagcctctaaaaatatatttctttatgtgggtctgcccacagcgcgacaggaaaaaggccagactccctttgctccctgcttccctgctgcactagggtcacattacagcaggattcactctccacagacagctggctccaggactcctagagctagagcacctgccgtgtttgagcgaggctgcagctggagtaccgcacagaggtgcctggacacggcaggtgcagtaggacctgggccctcgttctaactcctccacaccaagggggcatcattttgcaatttctccagccagtgggcgtgccctttcttaaaattatataaaggtactatttaggctgacaaaggtcctgcatgtaggtgtttttgtttgtttatgttttcctgatgactactgtgcacgggcagtaaaaacctgatgggttggttttaaaaacaagatttgccaattgccttcagaattcgatgaaagcaaccgtagtactttgccagggctgtggaagccttgggtgtggtttttcaaaatgtacttggtttgtaagttttgggagtgtgacatccaggttgttggacatcacactttcaaaactttgagacagctctactgcccatgtgagtttgtttgggggctgaatgtgctcccaccagtccccaaccacacgtgccacggaggggtaggggtcggcacacctagccttgggtactgtcctggctgcaccaggctgagctcatctagcagggctaatgccaaggaaaccctggttgtgtctgtgggaaaaggtgaggtgacaggagggaagaggagcagctgagtggtctctggtgggtggctgagactctgtggacactggtggcttcaaggtgtgacttcttcctcaggtggacaaagagaccaacacggagaccccggccccatcccccacagtggtgcgacctaaggaccggagagtgggcaccccgtcccaggggccatttcttcgagggagcaccatcatccgctctaagaccttctccccaggaccccagagccagtacgtgtgccgggtaagtgagcgtgcggccctcttctgctcccctcagggtagccgagagcttcacacagggctgggtgcaaatcccattactctcatgttattgggtgacttcgggtatgttaacacctcagagcctcagtttcctcaggtggagttcacgggcctacttcataggattgttttagacaagcaatagaaaaggctttgtaattagtacttggtcaatgttattatcattccaaacaactcacttcctccttgttcacactctgccctgccctcctgcaaccacttgctgagatcagagggggacccgtcagtggcccctagatacacaggcatttccttcccaccttcagggcaattctagtgtacagcctgaggctgcaaaattacagcagatctggtaccagtttgttttgttttttttaattgaacctgttgctaccagtttgtattattttttaattgaacctgctgctaacatttaaaactttttaaaaaggcggccagatgcagtgtctcatgcctgtaagcccaacacttcgggaggctgaggcaggagggtcacttgaggccaggagtttaaaaccagcctgttcaacatagtgagaccctgtctccgcctaagaaaaagttaaaaattagctgggcatggtggcatgcacttgtagtcccagctagtggggaagctgagacaggagaattgcttgagcccaggagtccaacgctgcagtgagccatgattgcgccacagcactccagcctgggcaacagagtaagaccctatcttaaaaaaaaaattatttttaaattaaagggcagttaaaaataaaataaacctgggcgcagtggctcatgcctgtaatcccagcactttgggaggctgaggtgggcaaatcacttgaggccaggagttcgagaccagcctggcccacatggtgaaatcctgtctctgctaaaaatgcaaaaaattagtgcatggtggcacatgcttgtaatcccagctacttgggaggctgaggcaggagaatccttgaacccggggggcagaggttgcagtaagctgagatcgtaccatcgcactccagcctgggtgacaagagcaaaactctatctcaaaaagaaaacatgaataatttgaatgatttagaaaagcccttaagacaatggataatgctccgccaattttttttttttttgtaaaattactgccattatgaacgtgcagtagaaatcaaacacaaagagaagaatgtcactcatcagaaaaatcccaccaaaaaaaattagtgtttcattcgttctttttcatcaggatagaatgtggttgtaattttgttaaatgggagatataagatagaagaactttggtgaaatatttatcttttccacctatagactcaagcctcacgcatttttccccagtgttttttaagtgacccttttccaggattcgcatcttcaaataacagaaagcacctgtcccacttattaagcatctgtaacacaccaagcactatgcttccacttcccatattttattatttataccgtttctaagcctgcaaaatcacaaattaagagattcccagccaacggagatcacactccacaggtagaaagggcattttttttttttttttttttttagcaaagtcatatatttttccttctttgctttctagttggcccacttcagctcaagcttaggtctttttgtataaaacttactgaaggctacaagatgtagccaagagtacaacattgtgaaaattttcctatcatttcctctaaaactctgcaggcatggaggctgtctgctgagatatagcagggaacaatttaaccctttgttttgcacccacaagatgagcattaccaaattcccaacagagacatgctggggctgtgctgtgcctccaccctgccccctccacagccagctccgcgtgtctcagtctgtaactgatagcattccacttcctgcctgtaccggtcagggtttttcattgcaagcaatggaaatggacagtgagcagtatatgcaggaaaatttgggggaaaggaaagtgaggagctcacacactcatcataaggctatggaaccagcctcagaaatcaggcaggagcaaggaaggccagaccacagccaaaatcacaccacaaagccaattgggtgacaccttcaccgatgctgccacaaaacctggcccccaccggccccgttgctgcccctggcattcaatatttatgcctccaccaggttcctgccatggctggcatggaagctctggtcactgctgccactgccactacttaccattaatggcttttccctgagataaaaacaaacttggcacatttgtagaatgaaggagagaaagagtggcctgtttcaattcaagagacaatagtaatagacttgggtgcaagtcaccaggttgtgattcaaggcctggagcatttgcatccaattgacaggctagtcctgtgcctgcctctagctgcaagggaggcagtagaagcaaggttctgctactttcagcttcatcagtgggaggttggctttgtttcccaccaagtcataaggtggggttttctcacccacaggatgggatttcaaatgctaatcagcaacacttccagcccccacagccaaaaaatatattttctgtgtaatctaatcttacagccctgtaaggtgagttgtgtgaaccccattttatagacacagaagctaagactcaaaaactcaaagcactgtgctctaggtcacacagctgctaagtacaaagctgggagtccaactccaaagcctgcagcctctctgttgctcagagccacctcctgagggccttcctctggcctcctcgggtctgatcgtgagtagccccttccactggcctctgcacaaaaggcgtcctctgctgggtgcctcccttgttcgatcttcatcttcacctatgtcacttggttagttttgctgtcttgagttcccccactgaactcgaagtccatggatagggacaatgaattacccttcctacagctctcctcagcccccatgtattcatctgaagtgctaccacatttgtgggttgattgactttgaccaaatagacacagcccatcctaaattctcattcctgaactagcttcctgtgattctaaatgatttcactgctctctgcatcagtttctctagctattaaatgcaagtaataataaggtgacaacattctctaccatgtctgagattaaatgcattaaagtgtctttatattagagaaagctaaattcaaggacttaatgtagcttctgtctttcttttatataacatagtctttaacatgtaaacaactacaacttaaggatcaattatcctgatacccatttctggtcggtaggacacatatccttcaagtgccaccactggattaaaacaatgtagaataaaaggctgggcacagtggctcacatctgtaatcccaggacattgagaggctgagatgggaggatcacttgagcccaggagtttgagaccagcctgggcaacatggtgaaaccttgtctctacaaaaaatgcaaaaattatccgggcacagtggcacgtgcctttagtcccagctacttgagaggctgaggcgggagaatcacttgagcccgagaagtcaaggctgcagtgagacgagatagcaccattgcactccagcctgggcgaaaggagtgaaaccctgtctcaaaaaaaaaaaaaaaaaaaagaaagaaagaaagagaaagcccccttctggtaccacatgcaaccagtttatatgaatctaccccagttgtcaagatggcacacccttccacctgcacattagtttcatccctgagccctacttacaggctggagccaggagagctggtggccttggaaccaaacagactgggccttgaactctggttttgatgctccccagctgttcaactatacaagcttcttaatctctctgggcctcagttcccatcatgttaggattgtctgaggattaaatgaaactgtcactgaagcacctggcacgtagcaggtgctctatccatgtggcagtcattatttttactattcagcgtctggttctgttgaggccctgcctagcccagtggctatttcatcagtctgtccctggagttgctgtgtttgtcagcttagcaggactattaatatcattatcacaattaattatcaataaccacagaaacagcttctcaggagacctgcaacagtgaactgacagctgctagacacacaagcacaatagcatcggcctgtcacaaccccaccgattttggaaataggactcgagaaagaaatccccactctgctcccacctcccagggggtgctgtcatcctacccactctcccttgcgctccttaggggtgggacacattctcaatatagaagcttcccatcctgactacaggcctgatttctggtcttagatggggaatactagccctctggggggagtatagataactcagtgatcgagcggatgcccacggggagagttacgatctgccccatcatctctaaggatatggtccctgaggctttgcctttaagctgtctttttcttttttaaatatccatcttgacagtggctccatttgagtcagtaaaggcaggctccatagacaccagggaagagttgatgcaaatggccctttgtgtagaaggttaagagggcagtatactctgaagtcacgctggccagtgtccagccctgctgtgcggctgaccagctcgccaatcttgggccagttctgcaacccctaagcttctgtcacctcacttgtgaaaatggatttgctcctatcacatggggttgttggaaaggttcaatgggatattcgtggcatttagcatcgtgcagatactagcatggagatgaagcagtatgcatcatgcatagtacatgcttaacgaatgttcacttataaagaaaagaaaggtcagaatgaaacctgggtgtttgcagaaggagaggaaggactgtgccgagtggaggaacctgacctccctctaggcttcagtgcaccttccagaatgcactctgaccatgtttaagattccatgacttttctcttgcagctgaatcggagtgatagtgacagctccactctgtccaaaaagccaccttttgttcgaaactccctggagcgacgcagcgtccggatgaagcgggtaagagagtcacctcaaagctatttttctgcctgctcctccctcgttgccccaagccctgtgtcctgcacacacatctcctaatgtctggccatttctcctcagccactggctagaaaaatgttgctctctcaagcatttgcgaacagatgtttgtgaactatgaggcctgtgtagccacaggggaaggtgctgaagggtaaatgtatttgtcttattatgacaaataggttagatgaggagtgtgtacacttggccttgccttcctagatagaaatcaaagtcagtaagaactaaccaacccagccgggccccgtggctcacacctgtaatcccagcactctgggaggccgaggtaggaggatcacctgaggtctggggtttgagaccagcctggccaacacagtgaaaccccatctctactaaaaatacaaaaattagccgggcgtggtagcgtgtacctgtagtcccaggctgtacttgggaggctgaggcaggagaatcgcttaaacgcaggaggcagaggttgcagtgagctgagattgcgccactgcaccccagcctgggcaacagagtgagactctgtctcaggaaaaaaaaagaagaattaaccaacccaacagtcatcagttagagcgcgtcatctgacaggagtcttcctcatgcaagactctgctcagtgtgtctgtcgtccaggttctggtgacagagaagctgggtgcctctgagcaccagcctgaagcagggaagtgcaaatgggcttccctcagaccagcgggaagcccacagggaagaggctgcagacttgccttgcggaagtctcgcctttcctagtggagactgagctgagccatccggatggggtgggggtaggcaaaggagcgacccctgatttgtctttgaccattaagggctgcaggagatgcagggggccctcccgactttgggctttcaacacaactttaaagcagttctgtctaatgagtttgcagaaccagaagaaaccaggagccagaatgtcagaaagaaaaaaggggccaggcgtggtggctcacgcctgtaatcccagcactttgggaggccgaggcaggtggatcacctgaggtcaggagttcgagaccagcctcagcattgagaaactccgtctctactaaaaatacaaaattagctgggcgtggtggtgcatgcctgtaatcccagctactcgggaggctgaggcaggagaattgcttgaacctgggaggcggaggttgcagtgagccgagatcgcgccgttgcactccagctgggcaacaagagtgaaactacatctcaaaaaaaaaaaagaaagaaagaaaaaaggagagagaaagcaaaagagaacatggatggaaaagatagtgccaatagcccccagtaggggcaggccccccacctttcctgcactgcctgctgacagccagaatctggtcctttgcctaacatcctacaccttaacaagtctgagggggaactggagagaggagagagacagcaacacaggggaggctacacagggaaggcagagtgtgcgggtgtgggagaaagtggacatggcctcaggtgacagggacaaccaactgcccactctgggtcccccaccccaaccccctcttctgtagctggcttgtactgcagtctctggagcaccaaaagttacctggggagcttggtgacaatgcagattacaaggccacacttctgaccatttaattcaggcagctggcgtgggccctgaaaactgcattttaacaaagctccttaggggcttctggagcagatgttcatggtccactcctgcagaaatgccactgatctcctacttgctccccctgcgtttcccacagctcccttctaaggcaggccctacaggagcaggtccccttcatcatcccctgttccccttaaccaagagaatgacttaataagggagccccgatggtgggtctgagcccacatttccctcgggtcctgaggaacaggagaatccagaggctgggcctgggcccttgggcactgctccttgcttccacgcactacctgagctgtgttgtctctaccgcagcctgcccaacttctgagactggacagacgaagcaaaagaatctttatttgttgctctgagaacttgagccacgtagatcactcagctggatttccttgatcctgctcatttataagtgcagagcagaccatgttcaacctagaagagcattctagaaattcttcctagagctgtcttatattcctaatagtatgcttgccagccgtgcaaaatgagactaggtcttatggtaatgcttcttatactgtgtctgaaatctctgtattggtcattgtatttgttttctattgctgcataataaatcaccacaaacttagcagcctaaagtaatacaaatgccttacttcacagtttccgctggtcaggagcttaagcacaggttagctgagctctgcccagggttttagcaggctgaaacctctaagtgttaaatggccacatactcatctggaggcttgactaaggaaacatctgatccaggcactgcctccagatgttggcagaatttattactttgtattatcttgctagctgtcagctgggggtttaggggagcactttcagctcctagaggtcactctcaggtttttgccctgtgacggtctctacaacatgctttatttacttctttaaggccagcagaagagcccagccaggaaaagcccaggccatcttttaggggcttacctgatgaaaggagaggagattatacagggcgtgtatattagcaatgggatttgagaaaccattttagaattctgactcccacagtcatgaattattgttttttaatcgttagtgatttttgatgggaggagagttaatgattgtattaatcagggtcttttacgtatagataactgaagaacccaactcaaatacagcttaaaaatgaaagagggaatttattgtctcatttaatgaaaaaatccaggatgttggactaccttcaggcatggcttgatccagaggttgaaatgatgtcatcaggcctcagcccctttctcatggcattgctccctctgtacagcttaattctcaaacaggtcaccccacaagtaaagatgaccatgatcagtcccaggtttatatcttgaaggcttagcaacctctgtgtaaagacattgtctcttttccaagtagttcagcaaagtgccagaattgagtattaatggctgggctttgataacatgcttacctctgaacctgtcactgagatgcagactggccaggttcaggtcacattcctatccctgatgccccacacaaaccaggtggattgagtgcagaggaggaggtctccaagggaaggtgagggcattgttactctaaggctggggaaacaaatggtggacaagcagaaacaataggggcccattacaggaacacaaagtcaagaagacatgacttctgccctcaagcaggaacagacctgtattggggaaacaacttcagaacagtacagtgacaggaatcaataattgagaacgtacatatggagggtgctgagagtactgaagctggcacagtgtacagagagggcgggtggggactgcagccagcttcctggagtggagcttcagctttaccacacatatcctgtgggacttaacctctgcatgcctcatctgtgcagatgataaccctcgggacctcctaggtttgtgaaaatgaaacgaggttatggaaatgaagtgcttagtgccgttcctgggacataataaatgcccaataaacatgagctgagtgggagaattcaaaacaggcttcccagggaagggcaagccccattcggaaggagtggatgcctacaagagagggtatttgagggtcagaggaagaggctgggtgggctcactgggcagagctctaataacaagagaagccgtccccacccccacagccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacggggagaaggagctgccacagtggttgcgtgaggacgagcgtttccgcctgctgctgaggatgctggagaagcgggtgagttctgcctcgaaggcaggggagccctgcgctctgccccagagagtcggggggcactgccccggggaagagaggccagagctcatgatgcatcctacaattcccaccacaggttccactgagggtgttccacccatccctcgttcccatcaggagagggatccaggaatccctttgcacactcaactttatgaacctttcacctggctgcaaggcccatttactgcatttgttgttgtgattttgtgtgcaagcccttattattcacacatgtactcatcatgcagttcttcatgaaatacgtagggtacccagtctgtgccacagcacgcactttaaaagagtaacaataggacactgacctgcctcgatgcctgcccaggaagtcccacagggcagcccttgccaaagggggagaagggctggtcacaccagggccttctgctaacaaggatgccctggagtacaagtcggctggcacctctgccctgctataatgagtttaagggatttaggggttgatcaaggagaaagatataacctcaaaatggtgttagcacacaaagttttatatcagctgggcttttttttttttttttttttttttttttggagatgggttttctctctgtcgcccgggctggagtgtggtggcatgatggctcactgcaacctccacctcccaggctctaattgatcctcccaccttagcctcctgagtaactgtgttgacaggtgcataccaatatgcccggctaatttttgtattttttgtagagatggggtttcaccatgttgcccaggctggtctcgaactcctgggctcaaacattcaacctgcctcggcctcccaaagtgttgcgattacaggcatgagccagcgtgcctagcttgcactgcgctttgacaggtttgcatgcaggggaagtccctcacagcatgagaccttccaaaggtgctgggggctactgcccagtgtggaggaaggcaagggaactcctaggggagagctcgggaagagggaccatctaggttaggtagctctgcagcacgatggggagtctctgggtcagagaactccaaagcacagcagcagcttggggtctcttataggcccagggtttatctatctatggctaacaaatgttgggtacagtttcacagggtatgcaaaacaggaaggttgtatatggctttaaaagctgcttatttgagctatatttaaaacaactggaagggtaaaaatttgagtttggcaccagcaggcttttaagccaacaggtcccagactgccatgaagaaataaacaatatgggaccaatatgcaagggccaatataggaccaatataggaccaatatgaaaaatttcataaatttttcatttatgaaaaataatacctgccactctgtgatcgccacccacggcaaaaaagacttttgctagttctctgtgcacacagccagccttgctgagagcaccttacagagggtgcctacctgaactctcaggaccatcagctgaaatctcagtgctgaatacaggtggtgatgccctagggcaggaagatgacgccggacttcttaggcctggactgatatgggagcttcaaactgactctggcagttctaaagttccagaaaagtttatttctttcttatttataccctgtttacttataaacaggattataacaagaacattgaggggaaaacagaaaattggaaggcttgaaggaggagaggaaataaatatatcccaaatctaaagtagcctaattatagttagatattatgtttatctttgagcttcctggtaaccaaggcaaaaagagatcagaaaacaagtgcctatgtgccctaccttaacacttgatcttattcgaaagactgagaagtaatatgtgccctgacttaagaaaaacaaactagaaaacttgacctttcaaatagtaaaaaaaaaaaaaaattagcatctatgacttctaacaaagaaccattgatatgatggctttaggccggacgcggtggctcacgcctgtaatcccagcactttgggaggccgaggcgggcagatcacaaggtcaggagattgagaccatcctttgaatggtgaaaccccgtctctactaaagatacaaaaaattagccgggcatggtggcgggcgcctgtagtcccagctacttgggaggctgaggcaggagaatggcgtgaacccaggaggcggagcttgcagtgagccgagattgcgcccctacactccagcctgggcgacagagcgagactccgtctcaaaacaaacaaacaaaaaaaacgatggctttatttaccaaaattctgtctttgtgcaatgttttcaagtatatggtacgtggatattttagggctgtctgtggtttgttctcaaaagtgtttacatacgtttacattaggaggaaggggcatagtgttatacccaagcctcttaagaactactgcatggcttgggactgagtttccaccacttcttagtagtctgacattaaagaaatttcttactttgctggagcctaagttccctgggtaaaatagaggtaataacatctaccctcctaggtggcctgaggattagaggtagcgcacatttcaacaggcagccctcatctcctcaattcctcagatccacagttattccgtttcctggccccaaaaatctagtcactcaaacagatgatttgagcacttcccattatcgttctgaatgaagtggatcccacatggagcaagagtgagggtgccgtccctacagtagccccctctgttgtgatagcgagttctccttgcccctttctggaggccccctccactgactcagggccttgcttgctttgcccagcagatggaccgagcggagcacaagggtgagcttcagacagacaagatgatgagggcagctgccaaggatgtgcacaggctccgaggccagagctgtaaggaacccccagaagttcagtctttcaggtaagcagagggccccggcagccccccatccctttctcagccaacccacggccttagtcttctgtctgtggtcttactgctctcatcccttgctcacagagcactggctttccctgtaacagatgttcatcctccgccaagccatccctggcgatccatgagctctgcagcgctcttcccttggctgtctttatcagtccccacacaactcgagctaatttgttagatcctcttgtttaatgaatgagccacctgctccagcctttcctcgtagtgttttccttactggtaattgtggagggttggctgaatgataaataaacctaggggtgatggatgctcgctgggcctccctggctctgcctgccacctgctaggatctcagggaggtgctatcttgccatgctggacccgggtgtattctcggagggtcccgaatgccatttggcctgggcctcccatccacagaggccctagcgtttagacttctgatgtcctctcaaacaaggtacacatgtttgtgtatgtgctttaaaaaaaaaaaaattcctttgtggaatataaacatttaaaatgtatatttgtacaactatctttgggcatctcttaactttttaacaaattgagaatctgaaacaaacaaacattagaagtggcccaagggtccttttaaactgagaagcctctgactggatttgaactaagagtcatcgttcatgctaatggtcttttaaagcagtggttctcaaccaggggtgatttctccccttccccctggaacatttggcaatgagcttacgttttgggttgtcataactggaggtcaaggatacagccagcatctagagggtaagaggccaaggacgttgctaaacattctgcagcgaatgtataggacagctcccacgacaaagaattatcctgcccagaatctctgtagagcgaggttgaaaacccctgctctaaagggatggcctctcttatagggagaagatggcatttttcacccggcctcggatgaatatcccagctctctctgcagatgacgtctaatcgccagaaaagtatttcctttgttccactgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttttttggtttgtacagctccaccttttagaggtcttactgcaataagaagtaatgcctgggggacggtaatcctaataggacgtcccgcacttgtcacagtacagctaatttttcctagttaacatattttgtacaatattaaaaaaatgcacagaaaccattgggggggattcagaggtgcatccacggatcttcttgagctgtgacgtgtttttatgtggctgcccaacgtggagcgggcagtgtgataggctgggtgggctaagcagcctagtctatgtgggtgacaggccacgctggtctcagatgcccagtgaagccactaacatgagtgaggggagggctgtggggaactccattcagttttatctccatcaataaagtggcctttcaaaaag

SEQ ID NO: 38114 - DNA, 91904 bp, Homo sapiens; identical to SEQ ID NO: 36569

SEQ ID NO: 38115 - DNA, 6684 bp, Homo sapiens; identical to SEQ ID NO: 35778

SEQ ID NO: 38116 - DNA, 38035 bp, Homo sapiens; identical to SEQ ID NO: 37698

SEQ ID NO: 38117 - DNA, 20325 bp, Homo sapiens
ggcctgcagtggacgagcatcgcatagcctgcggggctggatgctgaccgcccgggccagcacctaggcggacgcggagctgtgcagaccagggttcgcgcgggccgggtggaggctcaagcggggaccccggagcgtgagccccggagtcggcggcgctggggccagaggggccgggagggagtcggctgaggtggcggcggaggcgaagtggcggcggaggcgaaggggcggcgggacccgggcctggcccgtatgtgtccttggcggcctagactaggccgtcgctgtatggtgagccccagggaggcggatctgggcccccagaaggacacccgcctggatttgccccgtaggcccggcccgggcccctcgggagcagaacagccttggtgaggtggacaggaggggacctcgcgagcagacgcgcgcgccagcgacagcagccccgccccggcctctcgggagccggggggcagaggctgcggagccccaggagggtaagtctgggattttcgggcccagagcgagaagggcctgggtgaagtcaccgtgtgttggggacctttgagtgtggggcagggggagggtcccgatcgcttgcaggagagacgtgtgtttgggttcgagggcagggtccggctgcacggaacaggcgctgcatgggaagatctgggaggacgaggcttacgggggcgtggagggtgtcaccaccctcagctgcggacgtcgtctccactccccgctaacccctaacagcccttcctcctcctctccgtgctccagatttcgaccgcctctaaacgtccctcagcacctctgttctctcatttaagtgtctgctgattcgccccttagatctgccctgggagaatcgtagtaatgcaggaacagcctgcagggattctctcctgctgcctcagttgctaggggaagagactgggccttagcaggtgggtgacttgaccaggtcactggctttgtggatggaattactcatagtagaactcaggagtcttatctcccaggccagtgctctttctcccgtatcctagttttcttaatagaagattattaggtgcagcaataaccaagttcagttagataatttagaaacaaaaccatattttatacacattcatttcatttctgagagctcacatattcaattcctatggcttctttgattttaagcagtttagagagacaataagaaaacgcgggccggatgcagtggctcatacctgtaatcccagcactttgcgggcctagagcaggagtatcccttgagaccaggagttagagaccagcctaggcaacatagggagaccctgactctacaaaaaatataaaagcagccaggcatgctgggatgcacctgtggtcctaactactcaggaggctgaagtgggaggatggatggagcccaggaggtcgaggctgcagagagccgtgaatgcaccactgcactccagcctgggtggcagattgagaccctgtctcagcaaacaaaccacaaaaatcatgagctgtataatgggaaatttttttctttttgcacgttgtacttgatggcagaccatgttacccatgagagtcttaactcacctaattactatctgattatcttagagttacaaagttacacgtgcatgcttcccctatcactttttttttttttttttttttttttttgagacagtatctctcacccagtctggagtgcaacagcgtggtctccgctcactgcaacctccacctcccagattcaaatgattcttgtgcctcagcctcctgagtagctgggactacaggcatgtgacactatgcctggctaatttttttgctatttttaagtagagacggggttttgccatgttggcccgaggcaggtggatcacttgaggccagaattcgagaccagcctggccaatgtggtgaaaccctgtatcactcttttaggcccttctgagtgtttgcagctgagtgttcacagggtgttaacctatttgagctttcttttgtggttcgtaatgcaggagatttctgcctttgcaggccggagccctcatgacttcagtgacctgcttctgcccctctaggtctatcagccacagtctctgcatgtttccaagagcaacaggaaatgaacacattgcaggtgagttttcctgcttgtatatatgttcctcaactttattttatgatgcattttaagaggcttgtaaggattcatactttttttttttttcttgagatgcagtcttgctctattgcccagcctgcagtgcagtggcatgatcttgcttcactgccacctccacctcctgggttcaagcgattctcctgtctcagcctccagagtagctgggattacaggcatgcgccaccatgcccagctaatttttttttttttttgagacggagtctcactctgttgcccaggctggagtgcagtggcgtgatctcggctcactgcaagctccgcctcctgggttcacgccattctcctgcctcagcctcctgagcagctgggactataggtgcccgccactgcgcctggctaattttttttttttttgtatttttagtagagacggggtttcatcgtggtcttgatctgctgaccttgtgatccacccgcctcggcctcccaaagtgctgggattacaggcgtgagccaccgtgcgcagccaattttttgtatttttagaagagacggggtttcaccgtgttggccaggctggtctcaaactcctgacctcaggtgatcctcccacctcagcctcccaaagttctgggattacaggcatgagccaccacgcccagccaggattcatactttaaaatgggaatgtggaaatagacattatcctgtaaaatatagttagtgtggcagatcagcaccaaaaatgatttgtgaagcttgtatgtatgggtagtatattttaaggctgttgaaattgagccgcacccaggactgacattcttggcagtcatcacaaaaggaaaatgccatctgtattagtccattctcacactgctatagagaaataaccaagactgggtaatttataaagaaaagaggtttaattggctcacacctgcaggctctatcatgggaagcatggctggggaggcctcaggaaacttacagtcatggtggaaggcgaaggaaaagcgggtacatcttcatcaccagaggagaaggaagaaggagggggaggcgctacacacttttaaacaaccacatcttgtgataactcactcagtatcagcaccaaaagggaaattgtccccatgatccaatcacctcccaccaggtcccacctccaacattggggattacaattgaatatgagatttgggaggcgacacaaactgaaaccatatcaccatccatgacatgatttgcattgattataaggagaaaccaattttgttacttgtggatttaaaagattttctaggacttggaaaaatttcttcattcaagttgatataattgtggatagctttcctaacaacaaccattaaattactgacttatggcttattattggtgcttatgtaagcagagggcctgctgcccaaggagaacttggtgcatataatttttccagggacggaaatatcgtgatccaagtaaacagaattctgtttttactgttgagtcctagatcatggggggaatgaatgacatgatcatccttcagatatttgttcgtctttttgtttgggttgcacagcaaacaatacaaacagttactctcttgtgaagatttcctcatttctgtttctcatttcagttctcagtgttttcgttttgtccttttcactttgctgagtcagtcagtaaagatgaccagtgatttaattgcagtcaaatccagcgggcaattcctagccccttcctcacaggaccctttgtctgcctttgacatccgttacttcgaaactgatattttctccatggagtctctcttttcttggctcttaaaaagattcatctgtaagtatttctgtttgtctttaaatggtgaagtcttttgttttgtttctttttttctttttttgagatagggtcttgctgtgtcatccaggctggagtgtagatgtgatcaaaactcactgcagcctcaatctcctgggctcatgcgatcctcctgcctcagcctcccacgtagctgggactacagatgcacgctgccacacctggctaattttttttgtattttagtagagactggctttcactgtgtcacacaggctggtgtcgaactcctgagctcaggcagtctgcctgcctcggcctcccaaagtgctaggattacaggcgtgagccactgctcctggcctagagatgtattctcactgtattgctcaggctggtctcaaactcctggcctcaagttatcctttcactttggcctcccaaagtgctaggattacaggtgtaagccaccacacgtggccaataaagaatttttttaaaggggctaggaataacccataatactctcttaatacatgtggcagttgcgttaaatcttttaatagttcccatagtatgtctcttgcgtgctcattgttttgaagaaactgtgttggttatcctcagtttggattgtgttacccttgtttcacctttagcaaatttttaaaaaatatctcatatgccttgtaaaattggtagtttgatctagaagtctaatcaagtttatgttcagttcttttcacacaactataccatatgtggcatttgtctacttctggaggcacgtgttaccttctttgtttttgtgaagttaagaactattgactgttgattattgctgtgatttactagttcattaggggaggcaaaatggtgatctgctaattctaccatttattctttatttactagccaaaatacgtttcttttcttttctctttttggagacagagtctcactctgtcgcccaggctggcgcatttatggctcactgcagcctcaaactcctgtgctcaagtgatcctcccacttcagcctcccaagtagctgggagtatagtcatatgccacaatgcccagctgattttttaatttttagtagagacaggtttctctttgttgcccaggctggtcttgaactgggctcaagtgatcctcttctttgacctcccagtgttgggataataggcatgagccaccacagctggcctagaatacttttctaaagataaatttctattctttatttgtttatgtaattcatgcaggaaagacagtttctataatattgagtaggcttctaagcaggaaggtttttttgttttgttaccatcatgagctcatgggtttaaacagatagtaaatatttcagtacatagaagttgtgattctttttgaaaattaagtggttccatctttggccagacggaatccctttaagttggtttctgagtccttttgaaatatatttgatatatttgatagcaaatgtatacatataatatatatttgatagcattattttctatttagcattttattttgaaatcatttcaaattttcagaaaaattgcaaggattttacaaagaaatcccagacacttccttttgttcagacacttcattcttaacattttcccacattaatcatttatatgcatatatacatatgtgtctatatatattttctgaactatttgagagtgggtatgtcatgcctctttaccctataaagttttagattatatctcataaaatcaagaacattctgttaaatatccatagcacagtaattgaattcaggaaatttatcattgatttaatacttttatctgtagttcattttccagtttggccaatttcccaataatttcccttatagcaatttttaatttttggtagaagattcagtctaggactgttaattgcctttagttttcatgctttttaagtctgtttaatatggatttgttcctcagtgccattataatatttgaagaatacaggccagtgattttatagaagtctttaaatttaggtttccctgatctttcttcatgattagatttagactgaatttttgtctggaatactacatggaacctcttaaatttatggctcataataggatctgtcttgggaaaattctgtgcatgcctgagaagatggcttgttctgctctggttgggtggagtgtttgataaatgttaatgagatcaagttggtttgttgtgttgttcaggtgtactatatccttgttgattgtgtgcccacttgtatcaattgtgggggagaggggattgaaatctgctgcagttgtggttctgtttctctttgcaattttaccactttttgctttatgtgttatattagatacataaatgttcaaggttattacgtcctgttgattaattaaccactttgtaaaatggccttccttatccctgctaatattccaggctgtgaaatgtactttgttatttatgaagcattcttttgagtaatgcatgcatgctatatcttattccatccttttacttttaacctatttgcatctttatatctaaagtattatttcttgtaggcagcaagatttggatcttgcttgttttcatcagtctgtttctgtctcataattggggatgtataaaccgtttacatgtaatgtgattattgataaaacgagttaggttatagtccactgtctttgctttcttttagtgtcatcttctttgtttctttttaaaatgtctctgtttgtcttccttccttttgattagttgagaattttttatgattctactttatatcttttgttgggtttttggctatcacactgttattattttagtgagttagaatttatagtatgcagccttaattatcatagtttattcttaagtaatataccatttttcttagagtaagagaagcttacaataggacacttccatttctctcctcttggtctttacaccgttgttcatttcatttttacaggtggtatcagtgccacacactatctattacgttgttgttaattaaacagttatcttttatttgtttatttatttatttatttattttgagacagagtctcactctgtcccccaggctggagtgcaggggtgcgatctcggctcactgcaacctctacctcctgggttcaagtgattctcctgcctcagcctccctcagctgggattacagacacctaccaccacgcccggctaatttttgtatttttagtagagatgaggtttcgccatgttggccaggctggtttcgaactcctgacctcaggtgacctgtctgcctcagcctcccaaagtgctgggattacaggtgtgagccaccacacttggcccaggtatcttttaaagagatttaagtaatgagagaaaatacacagttaccatttctggtactcttcattcctttatgtaaatctaaatttttattttctgtcattttacttctgcctgaaggactttctttaacatttcttctagttgatgatgaattcttgtaggtctgcaaatgtcttcattgtgtctttgcttttaaaggtgtttttgctggatttttctccacagtgctttaaatatgtttctctgttgtcttcctgcttacatttttttctaagagaaatctgatctcatactcatgtttgttcccctatatataacatgtctttttttcttccccccttattgttttaaactttttatcactagttttggacaatttgattgcaatatgtcatggtatctttttttcatgtttctgttttggggatcattgaacttcttggatcttgggtttatggtgtcatcacttggggaacatttttatcattatttcttcaagtacccaccacctcccctccattgattcttgttgcctgtatattaggccacttgaaattttcccacaacatactgttgctctttatttgcttttaattcttctttctctgtttcattttatgtaacttctgttgctgtctttatattcactaatctcttttttccacgatgctgttcatcttgtccagtataattttcatctcagatattgtagtttctatctgtagaaggttagcatgggtctttttcacatcttgcctgtctcaatttttttgaacatttggaatagaatgatgaactctctcagtgctctgtgccagttgtaaactctgtgtcaattctgggccagttttgatggactgattgttttccttatgggttgtagtttcctgcccattttcccgactcgcagctctttctcctcacatctgcctctgttcttcttccctgctccgtggcctggagtcactcaaggcagaagttgattggttcaccttgtttatttcccatcactcatagataactctactgcctgataatcagtgccttgaaagccattgcttcagcccaggcgtggtggctcatacctgtaatcacagcactttgggaggccaaggcaggcggatcatgaggtcaggagttcaagaccagcctggccaacatggtgaaaccccgtctctactaaaaatacaaaaattagccgggcgtgctggtgcatgcttgtaatcccagctacttgggaggctgaggcaggtgaatcgctggaactcgggagacagaggttgcagtgagccaagattgtgccatcgcactccagcctggaagacaagagtgagactttgtctcataaaaaacaaaaacaaaaacaaacaaaccattgcttcatatatgttctccattttatttttctttctgtttttgattttgttgttgttctttggtgtgtgctgtttcaggttggagggtatatgcagtacctgttagtttatcacacctgagggcagaagtcctcatgtctctctctctctattttttctaatatatatatttttttctttgtagagacagggtcttgctatgttgccaaggctggtctcaagctcctggcctcaagcagtccttctggctcagctttccagagtgctgggattacaggcatgagccaccacacctggcctgggtccagttttatccatgtccaaatattttttttccctgagctgtttttgattttcttccacctcatatgaactgtagtgtcggcttatctagttccaggaaaaagctttttggtatttttattgggattgtatatttataaagtaatttagggtaactgatatctttgtattattacgttgaccttaataatacaactaattttttttttttggatttttagtagagatggggtttcaccatgttgaccaggctggtcttaaactcctgacctcaggtgatctgcccgcctcagcctcccaaagtgttgggattacaggcgtgagccaccgtgcccgagcactttttttttttttttttttgagatggcgtctcacttgtcgcccaggctggagtgcagtggcacaatctcagctcactgcaaactccgcctcctgggttcacgtcattctcctgcctcagcttcccgagtagctgggaccacaggcacccgccgccatgcccggctaatgttttgtatttttagtagagacggggtttcaccatgttagccaggatggtctcgatctcctgaccttgtgatccgcccgccttggcctcccaaagtgctgggattacaggcgtgagccaccgcgcctggccgcccgagcacttttacttttccttagttatattcctctaattgttttctcttctctagttgtagataatgagcattttattaataccttgttcttgatcttagtgggaaggtatgtagtttttccctgttaagtaaaatcctgacttttggaccaagaagactgaggcataagagtttatgtgtgtccgtgtgtgtgcacgtacatgtgtctgtgtgtgtatacacacaaactatatatatgcttgtgtgtaattgaaatacatatgtcacatatatatcatatgtactactgcatattagggtgtaatatttatatttgtatatatacataatattgatgttaatgaagcatccatcagtttctgttttctttagtttttttaaatcaggtttttctgtcaagctttttcaagtatcttcatggatacaagatttttcttctttgctgtgttatagtggcctatcatattaatagatttccaaatactaaactagtctatattattggaataagtcctatttgtctgttgtatattatgtttttaatctggtactggattttgtttggttatgtttcattttgagtatttgtattgatataagtggtattgtagtggcatgtaattttatgttatttattggctgatccatcttctaacccctccacctccttgccttttggactaacttaacctagaaggttattactctctctcggtgattttatcaactcctttggcctgcctgtggataagcttggatgttctgctttagtttctcagcccaccagcctagcggctctgactctgctatctcttgggatctacatggtcctagctatatcactgggtttgaaccccttgttgatatcttctttataaataacaggataatgtaacttgcttactgggcacttcctttttctaaactacaagtttgggcggggtatgctggcccaagactgtaatcccaacactttgggaggccaaagcaggtggattgctggagcccaggagttttgcatttttcttttctttttcttgagacaaggtctcgctctgttgcctaggctggagtgcagtgttgcattcacagctcactgcagccttgacctcccaggctcaagccatcctcctgccttagcctcccaggtagctggaactacaggcatgtgccatgatgcccagccaattttttaaaaaatttttatttttagtagagatgaggttcttactatgttgcccaacctggtctcgaactcctgagctcaaatgatcctcccatctcggcctcccaaagtgctaggactataggcatgagccaccatgcccagccccaacctcttaaaaattgaagctgcttcatgtttgccattggtactttttacacctcatcatattcttcttccccttcatcccatagaatacacaattcatctttaaggacttcaagttaactgagtctgtgaagcctaactgatggcataaagttaaaataatttgatcctcttttgttaaatcattctgcaccttgtctgcattactctaataacagctttgggcattcattcatttaacgaatatttattgctgtgagattgagatgtttgagataaaactcagccatgcagatagccagaggccactggctatgagaataaaaaagacaaaagaacaaggagctgaaactaggtgagagccccagagcagtgagttaggaagaagaagaccaggaactgagtggtgggcactccaacatgaagaggtccaggagaaggggagggcctggcagcaaagaagtgacaaggagtaaaatgcttgtgtttgtttacatgtttatctccttattaggttgtctgctttctgagagcaggcatggtgtttcactcatctcatatccccaaaactcagttcagttgcaaaataggagttcagttgtgttttgggtttttatttttgtggggtaatatatattttatatatatatatccccaaaggatatatgtttcctctatgatttccaatatgatttcccttccataatctgtaacataaaataaggtatacaatgttcatggttaactttacgagtgaactttgtaaaatgatatccccctatcccttttccatatctcccaattctgatcatgttgccattacaggggccagtgtcattcaaagatgtggctgtggatttcacccaggaggagtggcggcaactggaccctgatgagaagatagcatacggggatgtgatgttggagaactacagccatctagtttctgtgggtgaggatagcttgctttctgaatgctctcagttgaatggggttttatccttgagtttgaagaaataagtgatgacaccatttaattccttgtgggcactagctggagtgtttatattattcttcattgaaaggttctaactttgataaggttaaaaaaaaatggagcacttctgttatgcagctaatgaggtggcaacatcttgtactttggagattctgaagccaagcagcttgcccaagtccttcttcttttcccattaacagggtatgattatcaccaagccaaacatcatcatggagtggaggtgaaggaagtggagcagggagaggagccgtggataatggaaggtgaatttccatgtcaacatagtccaggtaagttagtagattatcacatgttaaaaaacactcatcccagacctttgggagtgactaaagagttgtttatatgtactcggtaccctcagtaacacctcccaacccccaaatatcactttccttcccacacacataccacatacatgaactcttttgttgattttacatttgatttacattggtagggattttttcattctaacctgtactggggacccagtcacttcctctttctccagcattatcggtcacttacttactccctcgccattagagaattgttgtgagttttttgtttgtttgtttgtttgtttgttttttggagacagagtcttgttctatcacccaggctggtgtgcactggtatgctctcgctcactgcaaccactatctctcaggttcaagcgattctccttcctcagcctcctgagtagctgggtttataggcgcccaccatgatgcctgcctaattttttgtatttttagtagagacagggtttcaccatgttggccaggatggtctccaactcctgacctcaagtgatccgcctgcctctgcctcccaaagtgctgggattacaggcatgagccaccccaccaggccatgctttcagttttcaagaaagaagacaccattgttgccaaagattttggtaatttgagagatacaatgtagttttctccatgtggatcctagatagtaaggatctgttgaatttgaagtatctatccagaagtattttgggtacatgtttaaggattgtaaaacagtgtttctatttctggatataataaatgtatttgttaatataataactgaacagattagacccataaactatttacagtgttgagtcatttcccacagttaaaatcaggatgaaaatatatagctgaatacttgctttgtttcttgtaacatttctttagtacagaacctgctaaggccatcaaacctattgatcggaagtcagtccatcagatttgctctgggccagtggtactgagtctaagcactgcagtgaaggagttagtagaaaacagtctggatgctggtgccactaatattggtaagtttgggagagttttaagccacaagaaatgattagtgtgtgttgttgtagtcaagaaacatttgttattgaaataagactatcaagtgttgatgtagtaataaattattatttttaagttaaagttagcacctattatgtgcctagtacttagctaggtagtaataataataacaacagcttttcttgtgttcttatggtgtgccaggcaggtgttatgctaagaattacacagaaatatctcatttaatttgcagaatagctgggcgtggtgtttcacgcctgtaatcctagccctttgagaggccaaggtggggggattgcttgaggccagagttcaagaccaacctggccaacatggtgagacctcatctctattaaaaaaataaagcaggccgggtgtggtggctcacacctgtaatcccagcactttgggaggccaaggtgggtggatacctgaggtcagcagtttgagaccagcctgtccaaaatggtgaaactctgtctctactaaaaatataaaaattagccagacttggtggcagaagcctgtaatcccagctacttgggaggctgaggcatgagaatggcttgaacccgggaggcagaggttgcagtgagccgagatcgtgccactgcacaccagcctgggacagagcaagactctgtctcaataaaaataaaataggcatggagtagtggctcacatctataatcccagcactttgggaggcagagcagggctgatcatttgaggtcaggagttcaagaccagcctaaccaacatggtaaaaccctgtctctactaaaaatacaaaaattagccagatgtgatggtgcatggctgtaatctcagctcctcgggaggctgagggaggagaattgcttgaacctcggaggtggaggttgcagtgagccaagatcagatcatgccactgcattccagcctcggtgacaagagcaaaactccatctcaaaaaaaaacaagaaaaaaaaaaaataacaaaataaaataaacctgaaaaattattaatcagctgagtaactttatgagatagaacttattatcttcattttacagatgaggaaattaaggaacaggaaatttcctttttttgagattataaagctaataaaataggatccaggaagtctgattccagaagcagttgcctttttttttttttttgagatggagtttcactcttgttgcccagggtatagtgcaacggcacgatctcggctcaccgcaacctccgcctcccgggttcaagcaattctgcctcagccttatgagcagctgggattacaggcatgcaccaccacacctggctaattttgtatttttagtagagacagggtttctccacgttggtcaggctagtctggaactcctgacctcaggtgatctgctcactttggcctcccaaagtgctgggattacaggcatgaacaaccgcgcctgcccccctttctccttactgggtatgttaaaattatttctttcaaaagaaaaggctggtcaaagtgcaacggtgttaaccactaattgatcacaaccagttacagatttttttgtaccttctccactccaactgcttcatttgactagcctatggacaaaaaaaaaaaaaaaagaggaaagaaaaagctaaactatttaatctgggctagtaaatggccagaaagggctttataaaaatgaaatatacaaaatgatactcgtacttttaactaaaggtatagttatgactcttcaatttgcacatgttataaataatatcaatataaaagcttatagcatgggtccattttttttttttttctttttgagacggagtctcactgtctcccaggctggagtgcagtggcgcgatctcggctcactgcaagctccgccccccgggttcatgccattctagcatgggtccatttttaataaatacataaatatttaaactttctagatctaaagcttaaggactatggagtggatctcattgaagtttcagacaatggatgtggggtagaagaagaaaactttgaaggcttaagtaagttgactttttctaatcctattataaaataattgggccacatgtctcagaattttgagtaacactgtcttgggaaacgcaaaaacagttttttaagccagttactagatatcatgtatatccgttgttttggcacttgaggtatcttagtccttactttacagtctctttcagctctgaaacatcacacatgtaagattcaagagtttgccgacctaactgaagttgaaactttcggttttcagggggaagctctgagctcactgtgtgcactgaggtgatacaatgtttttatccattcacttgaccccttagaaaaacctctcagaaagttaattggaatcgttatttacaattttctatctcggtatctcagcttctagcttctgaattctgttttgtctcactgccaatctaagtcctagtacttctgaaatgtgggaaataaatgaatgaaatgaagcaaatagtattgttaaaaaaaaatggttacccttattagaacagtaacttctcaattttaacataacatataggtaataaatgatagttaccactgcttttcatcatcaaattttagggaaacatttcaccaaagcactatttaattatagaacagatactaaatttttataattatatttaaatatatatatacatatatatgtgtgtatatatatacatatatatgtgtgtatatatatatatacacatatatgtgtgtgtgtatatatgtatgtgtatatatataatttttttttgtttgtttgtttttttagacagagtctcactctgtcacccaggctggagtgcagtggcacagtctcagctcactgcaatctctgcctcccaggttcaagtgattctcatgcctcagcctcctgaagagctgggactatagcgtgcaccaccactcctggctaatttttgtatttttagtagagatggggttttgccatgttgcccaggctggtctggaactccaggcctcaagtgatctgcgctcctcggcctcccaaagtgctggaattacaggcatgagccaccgtaccctgccctacatatacattttaattataatatctcttggattctttaaaaatttaaaaaaattttttaattctttaaaaaattctttaaaacaattttatttgaagagtaataacaaaacaaatctctatttgtgaataaataaaccttgagatcatttatggttttgcaattcaacctgaaaaatgaaatcaaagcttttatcaaaacaaagcatgtttagtgctctctgtctcactgtcttttagatgccaaaccttagattttataatgactcctcaaccgtttagatcttggttatctcagagggatcatcagctttttaagaaagttttgagagaaaagcaagtgaagaaaagcatagtcaatgctcaacatcacgggtctctcactgaacacaccacgcctggtattctctcacagcgatgtcaccatttctacctgccacgcgtcggtgaaggttgggactcgactggtgtttgatcacgatgggaaaatcatccaggaaaccccctacccccaccccagagggaccacagtcagcgtgaagcagttattttctacgctacctgtgcgccataaggaatttcaaaggaatattaagaaggtacagtaaattaatcttggttttcaagagtattggttaatgcacatgagcaaaagatttactaaagatgtttattcttcagttgattctcttgccataatctattgagaaatgctttatttgcatttctcgttaaagacttaacattaaagacttaactttagggtgatttacttttttcttttcatcacatagtgtttattaggactgggcaacatagtgagactctgtttctatgaaaaattaaaaaaaaaattgactgggcatggtggcatccacctgtagttccagctacttgggaagctgaagtgggagattcacttgagcccagaaacttgaggctgcagtgagctatgattgtgccactgtatttcagactgggagacagagtaagactctgtctggaaaaatatatatacatatatatattttatttttattttttatttttatctttttttgagatggagtctcactttggcgccctggctggagtgcagtggcacgatctcgattcactgcaacctccacctcccgagtttaagcgattcacctgcctcagccttctgaatagctgggattacaggcgcgcaccaccacacctggctcatttttgtatttttagcagagacggggtttcaccacgttgtccaggctggccaggctggtctcaaattcctgacctcaggtgatccgcccacctcggcctctcaaagtgctgggattataggcgtgagccaccatgcctgccttatgtacttatattttaatgagactatttctcttggttttctgataaatgagttactggaacccttatgaatctgaatgcaaaagaaacagctaaatgttatgtaattgttgtgtttaaaaaccagattataaaactatctgtattatatgattacggttttataaaaacaaaacaacggcctaaatgtgtatagtataaaggctggaagagtcagcactttcatgttctcagcggttatccttggatgtgagatctcatgcactttttgctctcttctttgtgcctttccattttgtatgtgtattttttacaatctaaaaagttacttaaacatatgcagctacaaactttttttacttgtaaagcgtttggtgctaattttaacttttttttttagacggagtcttctcactctgtcgcccaggctggagtgcagtggtgtgatcttggctcactgcaacctccgcctcctgggttcaagtgattctcctacctcagcctcccaagtagctgggattataggtgtgtgtcaccacacccagctaatttttgtatttttagtagagatggggtttcaccatgttggccaggctggtcttgcacccctgacctcaagtgatctgcccacctcagcctcccaaagtgctgggattacaggcgtgagccaccacgcctggcttttttttttaaagcttttttgaaagtcagctagcaagaacacaggaagaaatactcaaatctcccttacccagctgggggctatgtcaggttttataagcatagggtaatgagttgtgatttgattggatcttgcaataaagtaatgctgggaggtgtgatctgactggatcctgccatggggtgacagcaaaactcaatctgattggatcctggctcctgccatggagtgtccagttcttaaatcagtctcagctcttcaggccgagcttttagtttccactccgtggttgcatgcttggttaacctgggcatgcacagggtacatgcccttcaacctgtgggtccatggcaattgaaaaacaactgacaacctcattacataaaagttgaactgagccgggtgcagtgactcacgcctgtaatcccagcactttgggaggccaaggcaggtggaggtcaggacttcaagaccagcctggccaaaatggtaaaaccccgtctctactaaaaatataaatattagccaggtgtggtggtgcacccttataatcccagctatctggaggctgaggcagcagaatcacttgaacctaggaggtggaggttgcagtgagctgagttcataccattgcactccagcctgggtgacaagagtgaaactccgtcaaaaaaaaaaaaaaaagttgaaccagatttggtctgatgcagttacagatctacaaacctcacccccaccctcctgccaacaccttccactcctcattcttgagggattagggatggaggtcatgcttctgcttcgacttcatgctgagcagggcactgagtcccctaaagtgaaaggaatgaaactcttgggcttctgagttcagatgagttctggggtcacccagagtagcttgaaaggctggtattgttgtaatacaagctgaaggtggaagtgttggagcctggaggacaaacagctcaccatccatttaaataaataggaccaaaaagtaacagaacagtggccacgaggggccccaacagaggaagaaaccaggtgaggtgcggtatagtggactcgactgccttctaaatctcagttgttggccgggtgcagtggctcacgcctgtaattccagcaaaaggatagccgaggcagggtgatcacgaggtcaggagttcaagaccagcctggcaaacatggtgaagccctgtctctactaaaaatacaaaaattagctaggcatggtggcatgtgctgtagtcccagctactcgggaggctgaggcaggagaatcgcttgaacccgggaggcggaggttgcagtgagccgagattgtgccactgcactccagcctaggtaacagagcaggactccatctcagtcaatcaatcaatcaatctcagcggttgaactacccttgacatggttcagctctgtatccacacccaaatctcatgtcaaattgtaattcccagtgttgtgggagggacctggtgggaggtgattggctcatgggggccgacttcccccttgctgttctcgtgatattgagtgagcgcttgtgggatctggttgtttaaaagcgtgcagccctcccacttcactctctctgtctctcctgctccaacatggccagacgtgcctgcttccccttcgccttctgccgtgattgtcagtttcctgaggcctccccagccatgcttcctgtacagcctgcagaactgtgagtcaattaaacctcttttcttcataaatt

SEQ ID NO: 38118 - DNA, 33199 bp, Homo sapiens; identical to SEQ ID NO: 35798

SEQ ID NO: 38119 - DNA, 284903 bp, Homo sapiens; identical to SEQ ID NO: 37619

SEQ ID NO: 38120 - DNA, 4571 bp, Homo sapiens; identical to SEQ ID NO: 37232

SEQ ID NO: 38121 - DNA, 6673 bp, Homo sapiens; identical to SEQ ID NO: 36005

SEQ ID NO: 38122 - DNA, 63981 bp, Homo sapiens; identical to SEQ ID NO: 36612

SEQ ID NO: 38123 - DNA, 60380 bp, Homo sapiens
ggctgcaggcggggccggcgggggcgcagcggcccgggaggtgcgtggttgagcgaagccgcggggcccaaccgcagtcgcggggtctgggaggtgggtgcgccgcgccgtccctgcggccggggggtgcgggaatgaggacctgagctggggtagaggtggccgagctagagtagaggtgggcggctactcggaggtgggccgggctaagaaagaagagagctgcggctctgggaaactagccttggagccttggagaagagatttgtgatttactgagcacctactatgtcctgggctccgctctaggtgctgggatcccacagcaaacgaagccaccccagcccttgccttgctggactgtatattctagggaagagacagacaagaaaatgtatagatacgtaacaaaatgccgtaaatcttcatgaataaaaatgtagtagggctaggggagtggactgtgaagttgggagtggggaaggggtcggtctgagaggcctttgtgaggaagtgtcttttggcaggagacctgaatgaaatgagggagccttgggagcatgatccaggcggagggaactggattcgggaggaggaactgccttggccttgaaagatacctaccaggagttcaagtgctgtgcgggtgcatcagctttgtagatttgtgcaagatgaaaattggaattgtcttaggaaattatggatcattcatttattcagtgctggattcattcagtgatttatgtctgaagtgtgacagaaggggagtaaggccaagtgtccttggtaaaatactgttattagttttgtcccagtttaatacacagactaaatttagaatttccattgatttttaagaagaattaatctgagttaattttacagataaataaatagtaccttactttttttttctttttcttttttttgttttttttccatgctcagccctctattggagattctgcctcccctgggacagatggcttcttgagcacactcccacgatgggtggctgctctgggtgggtgtgcgctggtgtctcaacagggtgtaggggaggagtctagtgtcctgtcctctgagaggggactttggtgaacttgtgtttgggtggggatgcatgtgaaatggtattggatctcaggactaagggtcccttcctcctgggggcacacaggttcccttcctccttggggagcagcccaggaatggctgtcttgggggctttctctcagtacctccaggtcctggaggcccatctcttcataaggcggtctttccctggaggggtcagagactccagcccagggccctagggtcacagtgagaacacctgcctcagtcctgcactgcacttctcttggcgtgatttctccactgggagctgggacccgaagccctcaaagggaggatcccctgagagaaggtcgtgggcagagagctggtacagaccagtgtgtgccgggggtggggagatgactggcgggggggccagggtgtcgcgagggctggggtggcctagtcatctttgcccttggcgccatgtatgaggatgcaggtgaactccacctagttgaacttgtctttttttatcaatgggtgcctcccagtacatctcatccacttcttcatctgtgaagctgtcacccatggtggtgagcagctcctggaggtggtcctcatgaatgaaacctgaggattcctcgttgaagcaggtgaaggcgttttggatcacatcctgggggtctgttccattcagcttctccccaaacatggtgagggaagtggtgaagttgatgggccctggggcctcgctcatcatgccctgcaggtattcatccatggggttcttccgcggtgaagccagcttgtcgtgctgtcccccttgtcattgaagccatcatggttctggtcaatcatgttgaaagcctccttaaactcctggatgtggaactggtcgaacatcacgaagacattggatgtggccccttgtgctgtggtcgcttcttggtggtcttggctttggtccacttgctgaacattttggcttcaggtgggtgggggcttcactgggttcttggagctgggctgaccatactactttactttttttgaaaagtatatttatttgagttaaaagagttctgaggttttttttggtttgactttatttgttttttccaagtgtgaatgacctagaagataagaactagctgatacaggaacaaaaacagtgaggcgcagggtggggaaggtagcagagagaaatgaaaatgaaataaggaggatgtggaatagtggaagggacagtctgtcctaattctcctcctcctaatagactcaggaaataacacaggtgttcaacataacgtatctcagcagaccttcagaactatcagtccaagtcagcagagctggtagaggaggaaacagactcacatttggtaactggttaagcagaatcacgacttccaacttcactgtggctcactgaagcagtttaggctaaggtgatgctatgaggagaggtggcttgttctaagtgttttaaattttatatggcaaggtaaaccacattaaatcacagaattttatgacagcaagattacctaatccaatccttgctcattttgcagatggggaaactgctagttggtgacagagaaacaactcaaaatataggagagacatttttaccttaccttcagctgtctctccccagaacccttatttgaaaaaatgcttctcaatggctactgaatgagtagaataaactttgttgaggatcccagaattgagttaatctaaaacatcaatagaattatataaattttcacttttcttccagaagtatttattggagtgtccattggcgagggggctaaatcacagcctcttccctcaaggagcttaagtagatggagtaaatgaataactagacaattacaatttacaggaagcagtaccttgaagagaaattggagagggagtcaattcctaggatagcagagagatggacaacagacagaatgtgagtattaaaactgatgtcagatatcaaattggtttgtcagagttatgttgataatcacagtacctatcatcttcctaaacttttcatgtcttgataatgtgtaatatacgtaagtggtggtgggagagactgttacagccaacagacttggtacattcccaaaatctttttattcataagcaattactctttgccatttgcagccttttgtgctttaatattatcaagaacaagacgaatgataaaatatttatgatcagcattgtaattgcaaacaggcctccgtaataatcatatgcaactggttttgcgggaatttccttggaaagaaccatggctatatacgcgtgaagagtaacatagagtaatatatgaatgtacacagtaataataactttttctagagcagactatagagtgtaactgagtcattgtacttgcatactgtgataaagatcaagaaaatgtattcagcaacatatgagcctttggattgggctggagggtaggataggcagcatctggtggttaagttacgtaatgcctaatttgccacatgtgctcacctctggaaagactcactaaacttattttctgggaacttacccgcatcttgaatgctttgcatctccaactcccagattttttctgaacattttaatgtgacacttagagaagcagagcatacttagtcaacactgttttttttttttttgagatggagtttcactcttgttgcccaggctagagcgcaatggtgtgatctcggctcaccgcaacctccgcctcctgggttcaaacgattcttctgcctcagcctcccgagtagctgggattacaggcatgagccaccatgcccggctaattttgtatttttagtagagatggggtttctccatgttggtcaggctggtcttgaactcccgacctcaggtgatctgcccgcctcggcctcccaaagtgctgggattacaggcttgagccaacgagcccggcataatttttttgtatttttgtagagacagggtttcgccatgttggccagactggtcttgaactcctgatctctggtgatccacctgcctcggcctcccaaaatgctgggattacagccatgagcgagccactgtgcctgaccagacatattcttttattcaagtattttttctctaacaaaacaagttacaggctaatatgtagcttttttctgggaagatgtagtagttcttcatgactcatttattcactgaaatatttctcgagtagctattatactacaggcactcttggtgcctatgactaccctgatagagaaggaagtgataaattctaagaagaaaaataaagcaagataaagggatagaaaatggtggaatggacggggaggattttgattattctaaatacaggcatacctcagagatagtgcaggtttggttccagactgctgagagaaagctaatatccaataaagtgagtcagaaatactttggcttcccagtgcatataaaagttatgttacattatactgttgtgtatttcctgtacaatagcattgtgtctaaacaaaatgtatataccttaatttaaaaataccttcttgctaaaaaatgctaacaatcatctgagccttcagcatgtcataatctttttgcctctggagggtcttgcctcagcattgatggctgccgactgatcagggttgtggttactaaaggctggggttggctgtagcaatttatttaagtaagacaacaatgaagtttgctgcatctattatagactcttattttcacgaaggagttctctgtagcatgtgatgctgtttgatagcattttagccaagtagaacttctttcataattcgagtcagttctctcacactttgttactgctttattaactaaatttacgtaatatttgaaatcctttgctgtcatttcaacaatattcacaacacgtttactaggagtagattccatgtctagaaacacttcctttttttttttttttttgagacagagtctcactctgtcacccagtctggagtgcagtggaacgatctcggctcactgcaacctccacctcccaggttcaagtgattcttctgcctcagcctcccgagtagctgggactacaggcgcacgccaccacacccagctaatttttgtatttttagtagagatggggtttcaccatattggccaggctggtctcaaactcctgaccttgtgatctgcctgcctcagcctcccaaagtgctgggattacaggtgtgagccactgagcccagccaagaaccactttctttgcttatgcataagcagcacctcctcatccattcaagttttcttatgagattgcaacaattcagtctcatcttcgggttccacttctaattctagttctcttgctatttctaccacatctacagttacttcctccacttaagtcttgaacccatcaaagtcatccatgatggttggaatcaacttcttccaaagttctgttaatgttgacattttgacctcctcccatgaatcacgaatgttttttttgttttttttttttttttttttgagacggagtctccctctgtcgcccaggctggagtgcagtggcacgagatctccgctcactgcaagctccgcctcctgggttcaagccattctcctgcctcagcctccagagtagctggggctacaggcccccgccaccacgcccggctaattttttgtgtttttagtagagacggggtttcaccgtgttagccaggatggtctcaatctcctgaccttgtgatccacccgcctcggcctcccaaagtgctgggattacaggcgtgagccgagattgagcaattgcactccagcatgggcgacaaaagtgaaactctgtctcaaaaaaaaaaaaaaccatgaaagtcctagatggcatcttcctccaatgtaaggctttttcatctacactgaaaatctgttgtatagtgttgccacttttatcaattatcttagctaaatctggataactagttgtagcttctgtatcagcacttgctgcttcacctaccttgtacttttaagttatagggacagcttctttccttaaacctcatgaaccaacttctgctaccttctaacatttcttctacagcttcctcacctttctcagccttcataaaatgaaagaaagttggctgggcccagtagcttatgcctgtaatcccagcactttgggaggctgaggcgggtggatcacctgaggccaggatttctagatcagcctggccaacatagtgaaaccctgtctctactaaaaaatataaaaattagctgggcgtggtggcaggcgcctatagttccagctacttgggaggctgaggcaggacaatagcttgaacccaggaggtggaggttgcagtgagctgagatcatgccactgcactcactccagcctaggcgacagagcaagactccatctcaaagtaaaaagaaaaaattaaagaaagttagggccttgctctggattaggctttggcttaagaaaatgtttagtggtctatctagaccactaaaactttctccatatcagcaatacatctgtttcactttcttttcttttttttttttttttttgagacagagtcttggtctgtcacccaggctggagtgcagtggtgcaatctcagctcactgcagcctctgcccactgggttccagcgattctcctgccacagcctcctgggtagctgggattagctgggtacaagcgcacgccaccatgcctggctaatttttgtatttttggtagagacagggttttgccatgttggccaggatggtctcgaactcctgacctcagatgatccacccgcctcggcctcccaaagtgttgggattacaggcgtgagctaccatgcccggcccctgtcacactttcagtgtgttcactggagtagcacttttaattttcctcaagaacttttccttggtatttatagcttggctaactgtttggtgcaacaggccttgcttttggcttctcttggcttttgacatgcctttatcactaatcttaatcatttctagcttttgatttaaagtgagatatgtttgactctttcacttgaattcttagatgccatttagggtttttaattggcctaattttcaatattattgtctcaggaaatagggaggcctgagaagagagagaaggagagagaaatggggaatggccagttagtggagcagtcagaatgcatacagtatttattaattagatttattgtctttttttatttttattttcatttttttttttgagacagagtctcactctgccgcccaggctggagtgcagtggcacgatctcggctcactgtaacctccgcctcccaggttcaagagattctcctgcttcagcctcccgagtagctgggactacaggcatgtgccaccacgcccggcgaatattttgtgtttttagtagagatggggttccaccatgttagccaggatggtctcgatctcctgacctcgtgatccgcccaccttggcctcccaaagtgctgggattacaggtgggagccaccgtgcccagcctgcctggctaatttttgtatattcattgtcttatataggtatggttcatgccaaaacaatgacaatagtaatatcaaagatcactgatcacagatcactataacagatataataataacgaaatgtttgaaatattacaagaattaccagaatgtggcacagagactcaaagtgagctcatgctgttggaaaaatgaggccaatagacttgcttaacataggattgccacaaaccttcaatttgtaaaaaagcgcaataggagcaaaatgcaataaagcgagatatacctgtagtgtggtcagggaaggcctctttacggtaaatttgagcagaaaccagagtgacataaagagccggccatgaggagatctgaagaaagagtgtttcagatagagggaaaggcatatgaaaataccctaagagtatggaggcttatctgattagagcctgggtcggctgactctttttgtgcagatagaggctttgtgggccatagcggctcagtcaccactacagctactcagttccaacgtcatagcatttaagcagccacgttcattacataaacaagtgagcatgcctgtgttatagtaaaagagacttaacagtaaaagctcagccgggcacggtggctcacgcctgtaatcccaacactttgggaggccgaggccggcggatgatgaggtccggagatcgagaccatcctggctaacatggtgaaaccccgtctctactaaaaatacaaaaaattagccaggcatggtggtgcgcacctgcagtcccagctagttggaaggctgaggcaggagaatggcttcaatccgggaggcggaggttgcagtgagctgagattgcaccactgcactcagcctgggcgacagagcgagactccatctcaaacaacaataacaacaacaacaaaagacgttaaaagctcaaaccacaagaggaaaaattgataaatttgggcttatcaaaatgaaaagcttttgctctgcaaaaggccccatgtatatggtgaaaagataggctacattcagagaagatatttgcaaaccacatatcccaaaggatttgtttctagagaatgtaaagcactctcaaaattcagcagtaagctgtaatcaaaacaatgtggtggccgggcgcgggggctgacacctgtaatcccagcactttgtgaggccgaggcgtgcagatcacgaggttaggagatcaagaccatcctggctaccacagtgaaaccctggctctactaaaaaacacaaaaaattagccaggcatggtggcacatgcctgtagtgccagctactcgggaggctgacgcgggagaatcgcttgaacccgggtggtggaggttgcagtgagccaagatcatgccactgcaccccagcctgggcaacagtgagactccgtctcaaaaaaaaaaaagaaaaaaagaaaaaaaaggaagatggttgatatagggagataagttttcatctgaaataaaaggaagttaggcttttggcttccaaagccaaaagatgtggctcacaggtttctccataaacagtatgtttgtcatttagtttatatgtcaatgaattgaatgagctatgtccgtattccaaggtttattttttatttttttttaagatggagtcactctgtcacccaggcgggagtgcagtggcacaatctcagctcactgcaacctctgtgtcctgggttcattctcctgcctcagcctcccaggtagctgggactacaggcatgcaccagcacacccagctaatttttttgtatttttaatagagatggagtttcacaatggtggccatgtgtctggaattggtgggttcttggtctcactgacttcaagaatgaagccgcacaccctcgcagtgagtgttacagcccttaaagtggtgcgtctggagtccctcccttctgatgttcagatgcgttcggagtgttttccttctggtgggttcgtggtcttgctggctcaggagtgaagctgcagacttccgccgtgagtgtcgcagctcttaaggcagcgcgtcaggagtcgttcgttccttccggtggcctcgtagtctcgctgggctcaaaaatgaagctgcagacctttgcggtgagagttacagctcataaaagcaacgtggacataaaaagtgagcagtagcaagatttattgcaaagagtgaaacaacaaagcttcaacagtttgaaaggacacccaagctggttgccaatgcgggcttgggcagcctgcttttattctcttatctggccccacccacatcctgctgattggtagagccgagtggcctgttttgtcagggggctgattggtgcgtttacaatccctgagccagatacaaatgttctccacgtgcccatcagattagttagatacagagtttccacacacagattctccaaggccccaccagagcagctagataaagagtgtcaattggtgcactcacaaaccttgagctaaacacagggtgctgactggtgtatttacaaaccttgagctagatacagagtgccgattggtgtatttacaatccctgagctagacataaaggttctccaagtgcccaccagactcaggagcccagctggcttcacctagtggatcacgcaccggtgctgcaggtggagctgcctgccagtcccgcgccatgtgctcgcattccttagctcttgggtggtcgatgggactgggcgccgtggagcagggggcggcattcgtcggggaggctcgtccgcacaggaggccacagagggggtgggaaggctcaggcatggcgggctgcaggtcccgagccctgccccgtgggaaggcagctaaggcccggcgagaaatcgagcgcagcgccggtgggctggcactgctgggggaccctgtctcggccttccaaagtgctggtattacagacatgtgccaccgcatgcagtttggtgtcttcttttttttttttttttttttttttgagagacaagtctggctctgtagcccaggctggagtgcagtggcgtgatctcggctcactgcaacctccgcctcctgggttcaagcaattctgctgcctcagccacctgagtagctgggattacaggcatgcgcgaccatgcccagataatttttgtatttttagtagagacggggtttcaccatgttggtcaagctggtctcaaactcctcacctcgtgatccacctgacttggcctcccaaagtgctgggattgcagacctgagtcaccacactggcctttgtttttgtttttttttttttgaaatggagtctcgctctgtcgcccaggctggagtgcagtggcgtaatctcagctcattgcaacctctgcctcccgggttccagcatttctcctgcgtcagcctcccgagtaggtgggattgcaggtgtgcgccaccatacctggctaatttttgtatttttagtatagatggggattcaccatgttggccaggctggtctggaattcctgacctcaggagatctgctgcctcagcccctcaaagtgctgggattacaagggtgagcctccgcgcatggcctgttttttttcagttaaagtttacaaagcttttatgtatggtttgtatggttttcgggacaagtgaagggctgaaacttagttgtgcggttttgtgggataagtagaggctgaaatacagcctgcaatccactggccaggctctcctcctcatccagaggaaggggcacattttttctttacacaagagtaccgttcctagaaaacctgctttttcccaaaagggcacctttgcctaatttgcacaaaagcaatggaaaagctagcagtggtactgaaagcatgtataccagataatagacagcagaaattaatccctggaagctacttaaacataaaaaaattttcttagatgtcaacttaaaaatgtgtaggggaaatacatagtttttgaaaattattatggggaataaacaagcctcccccccaccaaaaaaaagactattgctccaaactctcttccaatgttgctctggtgccttttcctcaccttgcactacagatcttcacatctcccctctctctttggttcttccttttggctgcttctttctttaaacaactgataattaatttatgaaaacagttgatgccgggcgaggtggctcacgcctgtaatcccagcactttgagagaccgaggtgggtggatcacttgtggtctggagtttgagaccagcccgaccaacatggagaaaccccgtctctactaaaaataaaaaattagctgggcatggtggtgcatgcctctaatcctagctactcgggaggctgaggcaggagaatcgcttgaacccaggaggcagaggttgcagtgagctgagattgcgccattgcacttcagcctgggccacaagagtgaaactctgtctcaggaaaaaaaaaaaaagttgacaagtaagtgcagtggggagcagcctcaattcctgactcaatactgatggaaacaatctgtttaacaacctcagaaggactgtgtgaggcagtgagtcatctgtggattctcatctggaaatgatcccaaatcccagaaccctcaccataaggcgtttttcttgcagtgatttatggagtcttggcattccaactggtccttcatgctgggattcttttcctttgtgcctctgatccaatcagcgcacaccttctccaaggatttcccgctgtggctggttggggtaatcctcattcagtgaattatcacctctggttccaagagtgtatttccggagttttgtaaagcctagggcagcgtggctatcctgaccaactagttcctaaaggaatggccaggaggacatggctgtccctccaagagccccctactactttttagacctcattatactctcgccctgaggcaatttcctttccttttatcttctgcctgatattttccctaaatgttcccaaatttatcctcttctctgagggctttgcttcttcaggcctaactaaatacacaatccacaagccactgatctcacctcagctgtacctgtgctaattctcacttccagtttttctccagggccagtactgggagggatggcgcaaagatatacactgccacctggtggccaactgctaaccagctctggtaataccaaggatgttactagcaccacagcaacgggctctggaggcggatttgcaaaagcaccaggcgtgggtggagcagtgtcagctctttggttggtaatagcatctctctgcctggaattatctttccaagtctatttctctcaaaattcttttcatctttcaaggtccatataaatgccacgtttcccatgatccccttcttgatctttcaagttagaggatctcacttctctgaaagtactacagggtaggttcagcatttcgtttgtaactcttatgatgctgctctttgcctacttcaaactgttgctaatcccttaaaaactcagcttcttttcagtgcatgccatcaggatattgtaataatctactgaactcctgggtcacttcccccacattctctgaaaatttagaagcctgattcattctcttggttttcaccattcctactgtcatcagtcctggctattccatgatgtatggagacaactggccctcagtttcttgtccactcatttccaatcatcttgttttccagtccacctcagtcatttattcccatggttaataccctagccctggtcatgtataataaatgggctccttgcaaaacctgtatattttgcacctcacattgactatcacttcctttccaaaatttatttcctttttttttttattttttgagacagcggagtcttgctctgtcacccaggttggagtgcagtggcaccatcttggctcatcgcaaccactgcctcctgggttcaagtgattctcctgcctcagcctcctgagtagctgggattacaggcatgcgccactacgcctagctaactttttgtatttttagtacagacagggtttcaccgtgttcgtcaggctgatctccaactcctgacctcaggtgatccgccctcctcagcctttcaaagtgctgggattacaggcaccagccatcacgcccagcctgttcaactgatttttgacaagggtgccaagattattcaatgggggaaagaatagtcttttcaacaaatggtgaagggagaagaggataactgtatgccaaaaaatgcaactggacctttacctcatactgtatacaaaaattaactcagaatggatgaaagtgctacaaccataaaactcttagaagaaaacataaatgttaatgtttgtgatcttggattgggtaatgatttcttagctatgacaacaaaagcatgagcaaatgaaaaactgggtatattggatatattcaaaatttaaaatttggggctgggcagggtggttcacgcctgtaatcccagcactttgggaggctgaggcaggcagatcacctgaggttgggagtttgagatcagcctgaccaacatggagaaactccatctctactaaaaatacaaaattagcagggtgtggtggcacatgcctggaatcccagctactcgggaggctgaggcaggagaatcgcttgaacccgggaggcggaagttgtggtgagctgaggtcatgccattgcactccagccttggcaataggagcgaaactccatctcaaaaagaaaaagaaaagaaaattaaaatttttgtgtttcaaaggatacccaagaaagtgaaaagacaacccacagaatgggagacaattatagcaaatcatgtgtatgataaggggcttgtatctagaatatgtaaagtccttttacaactcagtaataaaatacaacccatttatatgaacaaggagagaatgataggttttgtcagatgttgagtggttgagtaagaaggctcgagaattgaccattggatttcataagatagtgtttgttgatgactgacaggaatggttcaaatagagaaatggggcaaatgccttactggtataggttcaatagggaattatttaaggaaatggagaaattttgtttttgttttttttcagataagagttttgctgtgtcacccaggctggagtgcagtggcacgatctcggctcattccagcctccacttcctgggctcaaacagtacttattgcctcagcctcccaagtggtgggattaaaggtgcaagccaccacaccaggctaattttaatttttttgttgtttttagtaaagacggggtttcaccatgttggccaggttggtctcaacctcctggcctcaagtgatcctcctgccttggcctcccaaagtgttcatgtcaccatgcctggcctggaattttgctttaaaaaggaccatatgggccaggcccagcagcacctgcctgtaatcccagctacttgggaagctgaggcaggagaattgcttgagcccaggagttcaagaccagcctgggcaacatagggagactctctgtcaaaaataaataaaagggagcgcagatatagggtactgttctatcctctcaagctgaaggtaagatcaagagaactatttaatttttagaaaggaatatatgtgtttgttttgttttgttttgagatggagtttcactcttgttgcccaggctggagtgcaatggcgcgatcttggctcgctgcaacctttacctcccagcttcaagtgattctcctacctcagcctcccaggtagctgggattacaggtgtgcaccactgcgctcgggtaattttgtatttttaatagagacggggtttcaccattttggtcaggccggtctcaaacttctgacctcaagtcatccacccaccttggcctcccaaaatgctaggattacaggcgtgagccaccgtgcctggcctatatgtgttttatgaatggtttttgtttatgttttttgtttgtttgtttgttttttgagacggattcttgctctgtcacccaggctggagtatagtagcaagatttcggctcactgcaacctccacctcctgggtttgagcgattctcctgcctcagcctcccgagtagctggaactacaggcacgtgccaccacacccagctaatttttgtatttttagtagagatggggtttcaccatgttggccaagatggtctcaatctcttgacctcgtgatccgcccgccttggcctcccaaagtgctgggattacaggcgtgagccaccgtgcctggcccaaccatcttcttaattctaagacaaatatactctggaaattagggtttgtttaccaattgatccttctaaaactttgcattccaacctgagcgacagggcgagactctgtctcaaaaaaaaaaaaaaaattagcattcattaatacccacttcaaaggcttgttaatacagatttcctgatcccactctgctgaaattgtgactcagcaggcctggggtggagccgagaatttgtatgtctaacagcctccctgaagatactgatgtcattcatccatggataatcacacttggataaagtagggtggtgctccgtttaatcatctccatcgatgccgtcaatagtgctcttcctcagcagctatgcactcttaaattgtgcatcttgcaccacagtaaaagtttaacatgggttagagatagcttttcttttgcaaagtagaagaaagtagcgaaaagtagaaaagaaaaatgagcaaaccacacacattagtttttgagacaggatcttgctatgttgttctggctggagtgcaataactggctattcacaggcgccatcccactgcggatcagcacgggacttatatgggccatgctctgtggagaagctagttcacttctccttaggtaactttgtggtcccccgctcgtgggagattatcatactgatgccaaacttagtgtcaacacctgatgtgcaaagcacacttcagcccagaactgctggcctcaagtgatcctctcgcctaagcctcccaactacctgggattataggcacgcaccactacgactgggcaggcacattcttaagaaaaccagttttaggaaacaaaacccatgaaagctgaagttttggaaaatgactttgttaaatacgtgtaatcaacttagtcagaattttacatgtctggttttgcattaaaaatataaaaatttttacaatatgatatggctaattataattataaaatgattttttaaaagtctacttcatgttgtgaggctggtgcattgagagggagcttttgtaagccaggcgcggtggctcacacctgtaatcccagcactttgggaggctgaggcgggcagatcacgaggtcaggagatcaagaccatcctggctaacatggtgaaaccccgtttctactaaaaatacaaaaattagccgggctggtggagtgagcctgtaatcccagctactcaggaggctgagacaggagaatcatttcaacctgggaggcggaggttgcagtgagctgaagccgtgcaactgcactccagcctgggcatcagagtgagaccctgtctcaacaaaaacaaagaaaaagaaaaaaaaaggagcatttgtggaagaagcagtggtacatgtgtaaacgtttcgggtaagggtggcatcacactggttgaggagaacaggcagctgcaggggtagtaatggcctgtttagatttcttcttaagctcccaactttgctgatacagccatttggggagcaagggggtggtcatcaaaaaacaaacagagagttgggcgcagtggctcatgcttgtaatcccagcacttttggaggctgaggcaggaagatggcttgagctcaggagtttgagaccagtctatgggcaacatagggagaccccatctccaagaaataaaaatgaaaacaaatagaggaagcatgcttttgttttacctgccctccctgaaaagaaattgaaattgacataactgtcttaagaggatgtaaagatggaatgcctaatgtccagagtgggaatcaaggggttactctgggaagtgatgaagactggacagatgatgctcattgatttcccaagctatatataaagtgcgatacctggctggatgcggtggctcatgcctgtaatcccagccctttgggaggccgaggtgggtggatcacgaggtcaggagttcaagaccagcctcgccaacatggtgaaaccctgtttctactaaaaatacaaaaattagctggtcgtggtggcagacacccgttatcccagctactcgggaggctgaggcagagaattgcttgaacacgggaggcggaggttgcattgagctgagatcgcgccactacactccagactgggtgacagagcgagactccatctcaaaaaataaaaaataaaataataaagtgagatgcctgtaatcccagaatttcgggaggtcgaggtgggcagatcagctgaggccaggagtttgagaccagcctgaccaacatggagaaaccccatctttactaaaaatacaaaattagccgggtgtggtggtacatgcctgtaatcccagctactcaggaggctgaggcaggagaattgtttgaacccgggaggcggaggttgccatgagccgagatcgcactccattgtgagccattgcactcgtgggccattgcactccagcctgggcaaccagagtgaaactccatctcaaaaagcaaacaaacaaacaaaaaacaaaagaaaagagaggaatcagtgagactcattaggagactacttcagtagatcaagggacagtttataatggctttgacaagtatggtgtagcagacatgtgcgagtggaaggaatctaagagtattttggagataaaggtaacagtttttgttggtggattagatatggaaggtgtgggaaagagaaaaatcctgaataactcctagcttttgcaatttggtgaacagtgataaaatatttactgagatgtaaaagactagagaaggaaaagatttgggagtttgaaagataaacaggacttctcctttggctatgcttaatttgagaggctttttgaccacccagatacaaataagacaggctatagatatatgactctaatcacttctcagtcttttggccaagatcaagtgatattgactctggaagtcagggggaaagccatcattgaaaaacttaactaacttacgagacaacccattatattttggatagctctagttatcagaaagttcttgcagttacactaaggtgactataaatgttatataaatttgatgctcatttccattcagggttcctgaaaagtacacacttttctaagcacattcaatattggaagaaagttatcacattctccatcttttattttctgagctaaacaatcaattctagtttctccagctgttcttcatgacctgtttctagacatgtcatcatcctggttggtcatatgccatataaggtaggatgccaaggactaacgtgaccagaataatcatatacaaaatgtaagactgtcatccctcggatttgccattctttcagaaatatgtttgccttttataattcatctgttttctttctttttcttttcttgagacagcatcttgctctgtcacccaggctgcagtgtagtggtgagatcttggctcactgcaacctctgtctcctgggttcaagagattctcctgcctcagcctcccaagtagctgggactacaggtgcgccaccacgcctggctaatttttttttttttttttttttttgaaatggagtctctctctgttgctctggctggagtgcaatggcatgatctgcaacctccacctcccgggttcaagcgattctcctgcctcagcctcctgagtagctgggattacaggcgcgcaccaccatgcctagctaatttttgtaattttagtagagacaaggtttcaccatgttggtcaggctgctctcaaactcctgacctcatgatccatccacctcagcctcccaaagttctgggattacaggcatgagccaccatgcccagccctgttttctttcttattgtcattagtgtgtcagtgttcctacctgtggcatacaatgtctcttcttattttcatctaatccgttgttggattcggaaatcaaataaccaattgaagctatcagatattaacattttgctttgtatgtttgggatattttgtaataatttaaaaggagagagagagtatgtgcttcctgagagagaccaaagcctttctatgagttgtgctttgaattttagtgagaaaacctttcttttttctctgtttcctcctgcctatatacaaaataaatgagtttcccaaacagttgagtgtcagatgggtgaggtatttcagccttttgcacaggatctcattggagattttctgagatgtcttgctgaaatcaaggtgcatggtgtctaaggcagtggttctcaaacagtggtgacttgctcccagtggacatttggcaatatctggagatatttttgttgtcatgattacaagaaagggattacatatttctagtggggagaggccagggattctgctaaccattctgtaatgcatgggacaagcctctgtaacaaagaattgtctggccccaaatgtcagtaatacctatatttgggactatggtatttctctgattttattaactttatgggaaaaagttagaaaagttttaaacttactgaaataattctacttccaactaatcactgctctcttcttttattacatagaaatcatctgtgaataatctttctagatggggaaaaaatgaagcactgcttttttccacttttgtaaaatggaaaagtttacatttttctgtcaccattctcaatctacataatttttttaatattaacagtgcccgatgattaaatttggacactatgttcatatactgttatttaaagaaaaattatactttcaccatatctcattttcctttctggccttctgtttctcttccccacgtttattcatttgttacagttgtaaggtttttcttgaggaggtaagtaatcctgtttttcttctgtcatctctaaaaactaagtaaatacaatacaacttaaactagaagctctgttcttatcttttaggacccctagtgagacatgtagctattttggaatgaggctatactaatcatgttgactagctacttattagtgagagagatgggggcagaagtcactgtcccgtcaccaggtagataagaatgtgggagacaaagaatgatgctgtctctgcacgtcctccacgtggggacattggaatcttttcctggggctgtggcatttcttttgtattgactgcagctgtcaggatcaaagaagagctaatgagacaaaagtaaatagcttcattctcaggctacctgagaggagcaatgtctaatggagattaaaagatgaaaggggagaaaaattctttctcagccatacccagatacaactaagtcactgttttcacatgcttctgattcttcaaattctatgttaaccacttagaatctagtggcaaaaataatcttttcctaatgcttttttacttattacattttcattattttaaagatagaggacagtaatgtttcctgatctcaatgcttttatatttagagctagagatttattcagtcagctagtcatttattaaattattattgactatgtctatatgttccagacccaaacatgaaccagggaaaggctccaaaaacttggcagtttcaagtatatatttgaaagaggattgataagtgaacacctgatttgtagttgaaatatttatataatttttcacctttcttccggggtgatgactacttcagatgcattggtcaggaagtatttgttagggctgtgtatttgtagaacccttgagactgcacagaataaaatagctagtatccttcttcagccataagaccaccttctagaattagagaactgagacacaggtttaatgacttaagttttcagcacagtctgtagcgtagtctgtaccacagtctgtgctgatacttacgttttctaacttccaaccttgtctttgttctaaaaacacaggtgagggaagattgcttgcagaaaatgctttctgctgttgtaccaagggtgtttctctccagaaagcctctgaagcaaccaaattggggttcagggttgaggtcgaggaaaacaatggaaaagcaagagtgaaaaaagcacagaccaagaaaaaacattttaactgaggcaaagcatctaggataaaagagacacatttgatgtatgtggaacacaagtagtatgtaggtgctgtgacagagaaaaaaagccctaagattttccttcatagctggtctaaatgcagtggtccttacaaccaactgatcacaaccagtaacaattttctttgttccttctccactctcacagcttcacttgactagccttaaaaataaataaataataaataaatggcctggcctggcggctcacgcctgtaatcccagcactttgggaggccgaggtgggtggatcacgaggtcaaaagatcgagaccatcctggccaacatggcgaaaccccgtctctactaaaaatacaaacattagccgggtgtggtggtgcacgcctgtaatcccagctacttgggaggctgaggcaggagaatggcttgaacccaggagacggatgttgcagtgagccgagatcacaccactgcactccaagcctggtgacagagcgagactccgtctcaaaaaaataataataataaataaattagttcattcctcacctgagggcttacacttgaagtagaactactggtattcaaagactgctgcagcatccccgaacttgcttttccagcattatctcttcctagactcctgtaagtgccttattcctcagctaaactggactaagcaccattccccagccttcccacaaactgcccaccaccagacatgtgcccaggccattccaccttactgaaatgctcttgtctaatctttatctcttatctcttagtctacccatcttccaagatcccttccaaataccaacttcaagaagcctttctgggtgtttccacgtgaataaaatctcgtgattcttggctcttttttttttttttagcactttcttgtcttgtcccctccagcaccacattgtaacttttgaggtcagggactttgggttccctgcatcgtacagcagagtgttgtgcattttgtagactttttccttttttttttttttttgagatggagtctcgctctgtcacccaggctggagttcagtgccctgatctcggctcactgcaacctctacctcccaggttcaagcgattctcctgcctcaaggcctcccgagtagctgggactacaggtgcccgccgccacacccggctaatttttttttgcatttttagtagagacggggttttaccaggttggccaggctggtctccatttccctacctcgtgatccgcctgcctcagcctcccaaattgctgggattacaggcatgagccactgcacccagcccagactttttcaatatatatccacatacattttaatttttttcatcacctttaaaaaaaagctcattcaattctttctgggtttagaaagctgttctttcttgatttacttatgtgtgtaacagtcttgctgtcttgcccaggctagagtgtagtggcatgatcatggctcactgcaacctcaacctccagagcttgaatgatcctcccacttcagcctcccaagtagctaggaccacaggtgggcgccaccacacctggctaattatttgtattgtttgtagagatgaagttttgccatgttgcccagggtggtcttgaactcctggactcaagcaatcctcccacctcgatcttccaaagtgctgggattacaggcatgagccaccacgcccaatgtatggatgtttttatcaagatgttatcttgcccgaagattgagaggtccaaataagaactcagtgaaagcgggcgcagtgtctcagaccagtaatcccagcactttgggagacggaggtgggctgactaccctgaggtcaggagtgccagaccagcctggccaacatggcaaaaccctgtctctactaaaaatacaaaaattagccgggcgaggtggcaggttcctgtaatgccagctacttggaggctgaggcaggagaatcacttgaacccgggaagcggagtccagtgagcccagatcgcaccactgcactccagcctggaaaacagagcaagactctgtctcaaaaaaagaaaaaaaaagaggccgggcgcggtggctcatgcttgtaatcccagcactttgggaggtcgaagcgggtggatcacctgaggtcaggagttcgagaccatcctggccaacatggtgaaaccccatctctactaaaaatacaaaaattagccgggcatggtggcgggcacctgtaatcccagctactcgggaggctgaggcaggagaattgcttgaacgcaggaggtggaggttgcggtgagctgagactgcgccattgcactccagcctgggcgacaagagcaaaaactctgtctcaaaaaaaaaaaaaaatggaattggaaaaagcagaatttgtggctaggatgggcggggacaaggatgactaggtaatagagactggaaaagagaatggaatagacgtaaggagcattaagttagtggctacctggggtaaatggaaaaagaaaaacaaagaacaagaaagggaattgtaaaaaataataataaaaaaaagacaatctgagatacaaatattgaagagatggcaggagaacagtcaagacataagagctgtgtctaagggacatattcctggcttttggttgtcctagggaggttcctttctgtgcacgtcagaagatgacaggcaagaaaacaaagtggaaaacaataaggaagtgaaggtaacccctttataacctcccactgcttcattccttggaaatagaaatgactcagggaggcagatgaggataaataaaacgctgccttgaaacagtctctatgcttagctagattctgtctgcagctgctttctgcagaatcctgcaaattgggtttgtcatctgaccgtgtctctctcctcctgtgtctctacatctatttcaggtccctgggtttgctcgtgtctgttgccttggttcctctgctgtgttcctctaactgtgggcaatgcctccatccatttctagaagtaaatgtgttgatggcattttatcacctgtgtagttcctcttttgactctctcaattctcacctatgtctgcgcctgttgtttttaccttcgtcttttatttttctttctgcacccttttgtttctgcttctgtcactgcttctctctaccagctggctttctatgatgatgacatccccatagcaacctctctctggggaagaatgaggggaaggaaaagagagagctagaatagatgggctaagagaagccagattggagctggaaggtgaccttttggattgagtcctagaacagagtacagagaaactatgaagactgataccagccaagttacacaaaaccctaagaaaacacaaattgggagcccaaatccagtccctgctggcaaaactcattcagcaaatcctttctgttgtaaattaacctgtcatctgttttcccttccttgtgattcagatgaactattcttcctttctttgtttctaggtctcatgattcttaaacatgtatagttctttttttcttcttaaagctagtcaagtgaagcagtgtgagtggaaaaggaacaaagaaattcataattggtacagtggtacaaacaccactgtactcagatcagccacatgtatattttctttccttttcttttcttttttgagacagagtttctctcttggtgcccaggctggagtgcaatggcacaatcttgggtcactgcaacctctgcctcccaggttcaagtgattctcctgcctcagcctcctgagtagctgggattacaggcatgcaccaccacacttggttaattttgtatttttagtagagacagggtttctctatgttggtcaggctggccttgaactcccaacctcaggtgatccacccacctcggcctcccaaagtgctgggattacaggtgtggccactgcgcccggccgccacaggtatattttcttttaaaatttatgaatattcaggaccagacgtggtggctcacacctgtaatcccagcacttcgggaggccagggcaggtggatcatgaggtcaggagttcgagaccagcctggccaacacagtgaaaccctgtctctactaaaaatacaaaaaaattaggcgggtgtagtggcgggcgcttgtaatcccagctactccagaggctgaggcaggagaatcgcttgaacccaggaggcagaggttggagtgagccaagatcacgccattacactccagcctgggtgacagagcgagactccatctcaaaaaaaaaaaaaattatgaatattcacattgtaaccacaaggtctttcttttgatatactatagttttttcactaagattagttctggacaccatactttaagtgatacatgaaatacacttggaatgcccttagaaaaagaccaataaagaaaaaaaccaacatgaaatgatattatccactcttatttaggaccagaatgttagataagagatttaataaggataaagttttttttttttttaaccaataatgagatttgtttcatgtagggaagggttgttgagtgagttaaagcaatggaataattctgctcagagatctttaaattatataaatatccaaatatctgtaaataaaattggttagatcagttttccctcaaactttagcttcctttttccaccgtttcctttgacctccacctggagagctggttagacacaaattcctgagctctactctcagtaattctgattctgtaggtctggggggataggaggggcttgagtttgcatttctagttctttttctttctttctttcttttttttgtttagacaaggtctccctttgtcaccctggctggagtgcagtggcaccatctcagctctctgcagcctcgacctcccaggctcaagctattcttctgccttagcttcctgggtagctgggtttacaggcatgcaccaccacgcccagctaattttttgtatttttgatagagatggggttttgccaggttgcccccactggtctcaaactcctcagatcaggaaatccacccgccttggcatcccaaagtgctgcgattacaggcgtgagccaccacgcctggccttgagtttgcatttcttttttttttttttttgagatggagtctcgctgtgtcgcccaggctggagtgcagtggcgcgatctcagctcactgcaagctctgcctcccgggttcatgccattctcctgcctcagcctcccaagtagctgggactacaggcgcctgccaccacgcccggctaattttttgtatttgtagtagagatggggtttcaccatgttaggcaggatggtctcaatctactgacctcatgatccacccgcctcggcctcccaaagtactgggattacaggcgtaagccaccacgcctggccttgagtttgcatttctaacaggatcctgggagattctgatgttgctggtccccggaccacaatttgagtagcactagtctagatgatttccgaagtcaagcaatacagttgacatacatagtacataaatgtgtggttattttattgttccttgattaaaaataactttcctttgggaatggaggagcatgaatagactaaatcaagttggttttgtttttctctgccatttgcaagctgtgatatccattgacccctttctttgttttgtaaaatgaccaaccatagaggtttgcccaggtactttcagtgctaaaactgagatagtcctgggcaaacgggatgattgggtgacctctccattcacgaggctagtgaaatagaaagaatgtataaggaaaaatgaacgtggctagggatcagaaaatgcagtttctagtcgtaattcacaacttattaatattctgaccttaaattgatcatttaaattctctttcagtttttgcacctataaaatggtgataatgttaactactttacttacttaccacaaaagttttgaggatcaattgaaataatggataaaaagattattaaaataccatatacatattaagacaaagatgtagctcacttgtttttgcttagaatttacgatttacagcccggtgcggtggctcacacctgtaatcccagcactttgggaggccaaggcgggtggatcagctgaagtcaggggttcgagaccagcctggccaatatggtgaaacccctctttactaaaaatgtaaaaattagctggatgtggtggcatttgcctgtaatcccagctactcgggaggctgaggcacgaaaactgcttgaacctgggaggtggaggctgcaatgagccgagattgtgccactgaactccagcctgggtgacagagtgagaccctgtctaaaaaaaaaaaaggagtttactatttactggcaaaaaatagcaacccagcaatctcattcctaagcatacaacaagtatacaatcgagagaaaagaattcatacattcagcaaatatcaggaatgtttataatagctcgaactggaaacaatgatgcatacatcagtgggagaatagataagtaaatgttgtcatagccaaaagtggaatactactcagcagtaagaaggaatgaactaccaacaccaccacatagtactcgtagacacgatgctcagtgaaaaaacatctgagcacaaaagagtacatactgtatggttccatttaaaggtcaagaacaacaaaattcattgatgatggcggaagtaaaaatagcaatttcttctggagaaggaggctatagactggaaccagcactaggaaactttttgaggagcaagaaatgttaaagaatctagatcttgatctggttaatggttatgcctgtgaatacagatataaatattcacccaactgtaaactccagattagtgcatttttatctgctttattgcatgtgcccttcagtaaagtagaaaaaaataaaagaaaagacaacaataaaggaaggaagaactcaccctcaattctatcaccactagaaaacaatgtgtttttttcttgaaatgtttgcattctaaccgccccagcactaagaagaggttcagttttgtaattggaacgtctgatgagcatctgatgagtggatccagaggttatcccctcatgtcgagttgatgatgatatttcagcttctagacttgagcaagatgacagcaaagggaagcggaaaccctgggtcactggttcaggaagacggccaggtttacatcaacgttgcaacaaatctggtggctttttttttcgtttcgtgttgctgtttcttttcttcctcttcatctttgggtccgtttgctacttttcttggattgattttccactctaccccactacacaacgtactctttggggaggaggggggtctttacattttcttccactctccgactttcccatattttctcatgtgtctcagtgaattcaatggtatgtgctaacattttcttttatgagtctattccaggggctcacatcctgtcccctgcccgaggagccttccagtagcctttacagccgcattctcaggctttcatccactctttttgaaacagcgcctgtgacattcccactcattacagcgtgcccctcccatgcctccaggaaattctctgttttcccaccggctttctactcagcagctattctcagtctaatgcgcttcattcaccgtcagccttcctcaggaagacataaaaaagggtgaaaaagaacatttatttctcaggaaggattggtcagctgactaagttgtctgagggtctaaaaagatgagggggtaactcaaagcataaatgcttgaggagatggataccccattctccatgaggtgattattttacattgcatgcctatattaaaacatttatgtggccaggcgcggtggctcacacctgtaatcccagcactttgggaggctgaggcgggcggatcacctgaggtcgggagttcgagaccagcctgatcaacatgtagaaaccctatctctactaaaaatataaaattagctgggtgtggtggcacatggctgtaatcacagctactcgggaggctgaggcaggagaatcacttgaacgcgggaggcggaggttgcgatgagccgagatcgcaccattgcaccccagcctgggcaacaagagcgaaactccatcacaaaaaaaacaaaaaaaaaaaaaagagaaaaagaaagagtagatgtgagtcagctaagcacttcagtcatcatgtagctgttttcctgtgagtggggggaggggggtggtagcctggtgattgtgtcccactgatagctacacagagaaagaaggacatttatagctttagagcactgctagagaaaagttaaggaactcaaagaactgtcttcacttcatgcaagcaattatctgtgttgcttatatattggcacttgtatagaagaagtcttttcccgcttctcggccttttggctaagatcaagtgaagatgacttttaaaacccttgtctgtgatcctgcaatcaccctccttggtacttacataaatgagttgaaatcatgcatctacatgaaaacctgcaaacgaatgtttagagcagttttattcgtagttgctaaaacttaccaagatgtccttcagtaggtgaagggataaactgtggtgcatccaaataatggaatattatccagtgataaaaagaaatgagccacgaaaagacatgcagggaccttcaatgaatatcactaagtgaaataagccaatctgaaaaggctacataatgtatgactccaactgtatgacattctggaaaaggcaaaactatgcaaaaagacagcaaaaagatcagtgattgccaggggttggaggagtagggaagggaggtggaacatgggatcttttttttttttttcttttgagacagagtttcgctcttgttgcccaggctggagtgcaatggtgcaatctcggctcactgtaacctctgcctcctgggttcagtcaattctcctgcctcagcctcctgagtaattgggattacaagcatgcaccactacgcccggctaattttatatttttagtagagatggggtttcaccatgttggttgggctggtgtcgaactcctgacctcgtgatctgcccaccttggcctcccaaagttctgggattacaggcgttagccactgcacccagcctggaacatgggatttttagggcagtaaagctgttccgtatgatatcatacatttatcaaacctatagaatatacaacacaaagaatgaacttgaatataaactatggactttatgtaataataatatatcaatattagcccatcaattattaacatgacagatgtggctcggcgagctggctcacgcctgtaatcctagcactttggaaggccaagtcaggcagatcttctgaggtcaggagttcaacaccagcctggccaacatggcaaaaccccgtctctactaaaaatacaaaaattagccgggcatggtgatgggtgcctgtaatcccagctgcttgggaggctgaggcaggagaatcgcttaaacgtgggaggtggaggttgcagtgagccgagatcatggcactgaactccagcctgggtgacagagtgcaagaaaaaaataataacaataaataataatgataataatataagagatgtatcacactaatgcaaatgttagtattaggggtgttaagggagtacatgggaactctgtgtactttctgctcaatttttctgtaaacctaaaactgcccacccccaataaatcctattaattaaaaaacaaagcgaaacacttgtttatatgtctctctccatccgcttcaccaccatgagaacttaaagggaggaacatgttttttatctttatgttcccggcctctgggatgaaagagaaagggaacactatttttagtgcattaccctagcatcatcgccgacttagcgcatctaaaataaaagtcttgatttgaccctcaggtctctgtctgctttcctgactgaggtaaatggcaactccagttctccagttgctccagccaaaacctttaggatcattcttgactcctttttttcttttgtgctcaacgtctagaccgccagtaggttgcaccttgaaaatatatttcaaatccaacagcaacccactctatgctcctatccctaccctctgtctaagtttgttcatgctgctataacaaaacaacacaggcaaggcgcagtgcctcacgcccgtaatcccagcaccttgggaggcccaggtgggcggatcacctgaggttaggagtttgagaccagcctgaccaacatggtgaaaccctgtctctactaaaaatacaaaaattagctgggtgtgggtgtggtggcgggtgcctgtagtcccagctactctggaggctgaggcaggagaatcgcttgaacccaggaggcggaggttgcagtgagccgaaatcacgccattgcactccagactaggcgacaagagcgaaattctgtctcaaaaaaacaaaaacaaaaacaaaaacaaaactgagtaatctataaacagtagaaatgtatttctcacagttctgaatgctgggaagttcaaggtacccgcaggtttgatgtttggtgagggcagctctctgcttctaagatggcgactgttgctccgtcctcattagggggacgagtgatgtgtcctcacatggtggaaggcagaagggcaaaaaaaaaaaaaaaaaaaaaaaaaaggagcaaactctctgaagtccccccaccgcactttttttttttttttttgagacagggtctggctctgtctcccaggctggagttcagtggtgcaatcatagctcactgcaggcttgacctcccgggctcaagtgatcctcccacctcagccacccgagtagctgggactacaagtgcaaaccaccatgcctcactaattttttgtatttttttttttttttttttttttttttttgtagagacagggtctccttgtgtcgcccaggctggtccaaaagggggaaataagaactcctggactcaagcgatcctcccgccttgacctccaaaagtgctgagattacaggcatgagccatcgagcctggcctccgaagccccttctgtatgggtattactccctccatggaggcagagccctcatgactcagtcacttcccaaaaggtcctgcctcttaatatcactacaattaggattaagtttctgcattaattttggagggaacacacatttaaaccacagcaccctccttcagcatcttctccattcaacagcacatacttttttaaaaacacgaatcaactgatgtcatgcttctgctcaaaaaactaaaatggcttcgtagcttcctggctgtctgtcacattcggaatataaaccagaacgttcatgactgcttacagcgtcctgcatgagcagactcctagctgtcttcaacatcatttctcctgccactctgcccccgcttcactccactcctgccaaatccgccttttgacaccctgccaagcacgagtcctccttttggtgtctgcgtttgaaatgccttctgtttgaaatgctgttttcagatactcccaaggttgactttctcgtgtgattcaggtttctgtgcaagtatcatctctactgagagaggaaccctaaccactctatcttaatcttccccagccccaaccctttatcgccttaccttgatattttcttcttcaaaatgctcccttattacttgacagtatatatttattgtctgctaaggctgccataacaaaataccacaaacaggtggcttaaacaacaggaatttgttttctcaaagttctagatgctggacatccaagatcaaggtgccagcaggcttagtttctcctgagacctctcccttcagtagcagatggctgtcttctcagtgtcttcacatggccttttctctattcacaggcctaatgcctcttcctcttctcataaggacacctgtcctattggactagagccccaccctagtgacttcatgtaatcttaattacctccttaaaggctccatctccaaatacagttccattctaagttactaggggttagggcttcaacatatgaattttaggacacaatttagtccataacactttgccctctggccccccaaaatgtatgtcctcacatccaaaatacatttatctctatccctgtaggccctaaagtcttaacccattccagcatgagttccaaatccaaaatttcatctgaatatcatctaaatttggtatgggtgagaaaagaggtatgattaatcctgaggcaaatttttttccaaactgagcctgggaaaccagacaagttatgtgctttcataatataattgtgggacaggcataggctagacattcccattgcaaaagggggaaatgggggaaataagaaagaagaaaggggtacctggtcttccaagttcaaaattctagtaaggcaaattccattttttaaaaaaaattgtggaccgggcacgttggctcacacctgtaatcccagcactttgggaggccgaggcaggtggatcgcaaggtcaggagttcaagaccagcctggccaatatggtgaaaccctgtctctactaaaaatgcagaaattaaccaggcatggtggcaggcgcctgtagtcccagctactctggaggctgaggcaggagaatcacttgaacgtgggaggtggaggttgcagtaagccaagatctcggcactgcactcctgcatgggtgacagagcgagattctgtctcgaaaaaaaaaaattgtggtaaaaacacataacaacaacaaaaaaggtaggctgggcatggtggctcacacctataatcccagcactttgggaggccgaggtgggtggatcatctgaggtcaggaattcaagaccagactgaccaatatggtaaaaccccacctctactaaaaacacaacaattaaccaggcgtggtggcgtgcacctgtagtcccagctatttgggaggctgagacaggagaattgcttgaacgcaggaggtggaggttgcagtgagccaagactgtgctactgcactctagcctggacaacagagtgagactccatctcgaaaaaaataaaaataaaaaattagccagtcgtggtggtgtatgccagtaatcccagccagagtgagacttcatctcaaaaaaaaaaaaagaagaaaaatggttaccatgtgaaccatcttttttttttttttttttgagacgaagtttcactcttgttgcccaagttggagtgcaatggtgcaagctcggctgactgcaacctccgcccccaggttcaagagattctcttgcctcagcctccaaagtagctgggattacaggcttgcgccactatggctggctagttttgtatttttagtagagatgttgtttctccatgttggtcaggctggtcttgaactcccaacttcaggtgatcctcctgccttggcctcccaaagattacaagtgtgagccactgcgcctggcccatgttaaccatcttttattactttatcttacatttattttattacagtttttaaaatatcttttcagcttcactgaagtataattgacaaataaaattgtatacatttaaagtatgtgcacatgatgttttgatatacatgtatattgtgaaattattaccacaagttagttaacacgttaacttttttttttttttgagatggagtctcactctgtcacccagggtggagtgcagtggcgtgattttggctcactgtaacctctgcctcccaggttcaagcgattctcttgcctcagcctcccgaatagctgggattacaggcatgtgccaccatgctcggataatttttgtatttttattagagatggggtttcactatattggcccggctggtcttgaactcctgatcttgtgatccacctgcctcagcctcctaaaatgctgggattataggcatgagccacggtgcctggccaatatgtttctttttatttttttaatgtggctactgaaattttcttttttttgtaaaattgaacacttggtcacccaggctggtgtgcagtggcatgatctaggctcactgtaatgtccgcctcccgggttcaagtgattctggtgcctcaggctcccaaatagctgggattacaggcgtgtgccaccacgcctggctaatttttttgtgtctttagtagagatggggattggtgatattggccaggctggtattgaattcctgaactgaagtgatccatccgccctcctcagcctcccaaagtgctgggcttacaggtgtgagccaccatacccagcagaaaaatttttaattacatctgtggttgggctgggctcagtggctcacgcctgtaatcccagcagtttgggaggccgagacaggcagatcacaaggtcaggagttcgagaccagcctggctaacatgatgaaaccctgtctctactaaaaatacaaaaaattagctgggcgtggtggcacacgcttgtagtcccagctactcaggaggctgaggcaggagaactgcttgaaccggggaggcagaggttgcagtgagctgagatcatgccactgcacaccagcctgggtgaccaagtgagactgcgtctcaaaaaaaaaaaaaaagttatatctgtggctcacattatatttgtattggacagtactggccaggctttattcaataatcattgaagatatttgagtaggactctgacacgattcaaattttgatttaggataattcacctagccctgatgtggaacggattcatttttgaagaagggagaggaaagaggaaggaagaccttcgtgaaagtgggacaggcctgagagctgggattaggcccttcaggatcaacgggagtgatggatggatgatttaaacccagtttagacaggaaaatcaacatttctcaaatgttttctttcttaatcctgaggacttattttctacagtgttatcaaattcaaagtgaactctgcctacactaacctaacaaaggaagattaaaaagttgctttaacaaaagtcgttctttatgaggactattacagatgcaagcaaagttttagagcagttactagctttttgtgtgtgtcttgaaatgccatttacattgttttatgaaagagacagttttccctgtctttacctcaatgcgtttaaaggcttgtgttccctgactttagattttatgtttgttttccacctggttatcatactagcaagcacccatcccacaaagctgcatgaaactaggattgagatttacattctgcagatttagattctaggattgagatttacattctgcagatttagattctagaattgaaatttacattctgcagataactgcatctggaactaagcgacctcagacaattattctattcattcctttttttctaggcagacctacattaaagtattaggtgtaaattttgtttgtttgtttgtttgagacagtctcgctggcacccaggctggagtgcagtgacgcaatctcggctgactgcaacctctgcctcccagtttcaagcaattctcctgtctcagtctcctgagtagctgggactacaggcgcacgccatcacggctggctaatttttgtatttttagtagagacgggctttcaccatactggtcaggctgtaggtgtaaattttataacattctcactaacttactctgttttgaaatttacccatcgcacctcacatttcctctttttttttttttttaatagagctacagaaagatttcaaaaggaatcaaatgacacagcataggtgtctgagggcagctagcctcactggcccatcctgacatacttaatccctcatgcctcatcaccagagctgtgactgtgactgagccaggctcctcccaaagtacactgaagacccagctcaaccaaccagtctctcgaagcacatcaacaaacagttatattgagcaactcttctctagtggccagggtgaaggactatctaagcttggacatctctgttgctttgggggccagcccagtgcagaactggtttttgagcatcaggttcctcctaggtgccatttgcccaaggaacacttgtctcaatatgctcaacacactttttttttcttttttgaggcagggtctcactctgttgcccaggctgcatagctcactgcagcttctatctcctgggctcaagtgatcctcccaccccagcctcccaagtagctgggtctataggcacctgccattaccatacccagctaattttttttttttttttgatagagaaggggtctcaaaaaaaaaaaaaaaagagagagagaaggggtctcactgtgttgtccaggctggtctctcaaactgctaggctcaagtgatccttctgcctcgacctcccaaagggctgggattatagatgtgagccactgtgcccaggtcaacacattttttagattctcaagactcagtttaattccaattgtaacctttaaaaataatcccagcatttgggagctaaggcatgaggatcacttgaggctgggagtttgagaccagccttgggcaatacagtgagatcccatctctacaaaaaagaaagaaaatgaaggaaaataagagaagggatggaaagttatgagactaatgaaaaaaaaaaggctctcaaagatagtgaatgatgagaggagaaagaaaggacttttactaaaaagaaaaagatttaacagagagcattgtactggcagggccctccagggtatcgatgcttagttgtgactgagacatctgagaggccgcaggcaaggtcagttctactgaagctttcagcctgtggtctaccctgtctgacctgaaaggaaaggaatttaagataggaaaggttgaagggattggtgggggtgcgggaaaggacatagaagatggcttcaggtatagaaattgagctgccccaaggtggaaatctaaaataatatccacttgcccagctgaattattccaggcaaggtgaagacgactggttctccccactaagaaatgtctctctctctctttttttttttttttgagacagagtcttgctctgttgcccaggttggagtgcagtggcacggtctcggctcactgcaacctccgcctctcagggtcaagcgatcctcctgcttcagcccctcctagtagctgggattacaggcacaccccaccatgccctgctaatttttgtatttttagtagagatggggtttcaccatgttggccaggctggtctcgaactcctgatctcaggtgatccacctgccttggcccacctgccttggcctcccaaagtgctgggatgacaggcatgagccaccgtgcccggccagaaatgtcttatttgttaggtttgtagtgagccgagtgttctttcttcccccacccgggggttaggttagggatagcagaacagtatttaataaaccagaagactgaaatggggccaggatgcagtgagtagatccagtaggttacatggtcctgagagataagagactcaaagagccacccagcagtgaagacacaaactactaccacctccccctaccaccaccactgggcttccgtggagtctggggtacagatcagactgcactgtatttgtttccaaaatgatcaattcttagtaatcctacccaaggctgtgttgtcctctttcctcccagttcgtgagtggaattctatgcctaccttcacctgatgcaggtttttaaatatttccaaactgaccaacccagtttctcttaacttcttccttctccaattttcttttccacttttaccaagttaacttcacattcttatctccagataagttctttagtataatctattactttgtcttcccgattaattacctaaatctcgtttgatgtttgtccttttcataccactcataggtcagattctcctaatacagctccataattaataagaaacagtcatcaattacaagttttaaggactattctctcctccctgtcctctgtctctccaggtcaccccagctctgatctttgccatcacagttgctacaatcggctctttccagtttggctacaacactggggtcatcaatgctcctgagacggtgagtgccaggccacaagaattagaatctggaatagggaaattattcctttaagtagggtttcaagaattcagaatttaaggccaggcatggtggcacctgcctggagtcccagctactccggaggctgaggcttaaagatcacttgagcccaggagttaaacaccatcctgagcaacacagttagtgagggtccctcccccaactaggggaattaaactttgtatctatcctgtccaagactgaagatggagacaatattggtggggaaaattagtggggtcatttaatcaaaggaaaaaggtcatttactccttataccctgggcagtgctgttcttcctcccactctttcaccctatagtaatacacttcctgtattatcccttaggggttagttaccaagctggccaggttcgcttagcagagggctggggtgaacatcagtgctgccacctactgggatattcaggacaaatgaaaaattactattccagggagagttaacattaattccaatatgttatctgcctcttcaattcccgtctatttattcccttgattctctagggaggaaatgatccctaatatttgttttgtttgtttgtttgttttgagatgtagtctcgctctgtcacccaggccggagtgcaatggcgctatctcggctcatcgcaaactccgccccacgggttcaagcgattctcctacctcagcctcccgagtagctgggattacaggcatgcgccaccacaactggctaattttgtatttttagtagagacggggtttcaccatgttggtcaggttggtctgcaactcctgacctcaggtgatccacccgcctcggccttccaaagtgctgggattacaggcgtgagccactgcacccagcatatttgtatcttttgttctcatccaactgtaatagtctgtcctcccaccttttattttgcagatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggtattgactagaaactgggcaaggaagtgggctctaccagatgcattggggacaagtgtggagagttagggcagggaggtgatgatgcctttgaataagaacaccttgaattctaatcaagggaaactagcccaactggccccgaatatgactgcccttgcttggagctctactaccctggagagctcccacccagctgtgcaagagatgaactgtgtgagtgattggcctttgcagtccagttagggatagttcagaattattccctagtaagctcaactatggggtttccaggaacatacttaatttacaaggtccaaagttgattacttttctcaaaaaaaaaaaaaacaaaactggggtctcatataaatgtttttgttacctctacacaggattggtaggaattatctttagtctatggcaaatgtggataatggccaaaaaaagaaaactgaatcgtctttttttttttttttgagatggagtcttgctcttgtcacctaggctggagtgcaatggtgcaatctcagctcactgcaacctctgcctcccgggttcaagtaattatcctgcctcagcctcccaagtagctgggattacaggtgcccgccaccacgctcggctaatttttgtatttttagtagagatggggtttcaccatattggccatgctagtctcgaactcctgaccttacgtgatccgcccacctcagcctcctaaagtgctaagcttacaggcatgagccactgtgcctggctgaaaactgaatcttcttattttatactagcttagtaatctattttagaaggtagaatatattttcagttatgactgacaaaggaactgttttaatttgccaattagatattctagaaatgcaagaatgtaattcacatttaaaaattgataaggcaacctattttacttgctaatgttcttccccctctgccctccctctgcccaagaagcagggtcttgctctgtcacccaggctggagtgcagtggcccaatcatagctcactatagcctcgacctcccagtctcaagcaatcctcacacctcagctccctgagtagctgggactaccagtgggcaccatcatgcctggctcccaactagaaacgttctgataatagaaagtaaaaaagggctgggcgtggtggctcacacctgcaatcccaacactttgggaggccgaggtgggtggatcatgaggtcaggagttaaagaccagcctggtcaagatggtgaaaccccatctctactaaaatacaaaaaaattagccaggcatggtggcaggcgcctgttatcccagctactcgggagtatgaggcagagaattgcttgaacctgggagtcagaggttgcagtgagcggagatcgcgccactgcactccagcctgggcaacagagcgagactctgtctcaaaaaaaaaaaaagaaagaaaagaaaagaaagtgaaaaagaaaagttagaccaaaaaaggagttgatataagcctggagaagagcagaataatgagtacagaagaggagaagttaggagcctctcactttgctaattccatgttgtctttgattaaccttacaggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtggcccaggtactctagaacttctcatacttaatgagtgttagtttcatgggtcattaaaaaagttaacataggtaaagcactgaagaatatctggcacatgttcaattacatatggaagttttagataatagatagtagctgaagaagcaggttgagtagagaaaggaaaagaagcacaatttcttttttccttttttctttttctttttttttttttgagagggagtttcactctgtcacccaggctggagtgcagtggaatgatctcggcccaacctctgcctcctgggttaaagtgattctcatgcctcagcctcccgagtagctgggattacaggtgtgcaccaccacgtccagctaatttttgtatttttagtagagacaggatttcaccatgttggccaggcttttctcaaactcctgacctcaggtgatccacccgcctcggcctcccaaaattctgggttataggtgtgagccactgtgcccggcaatttttaaatttttttcaatggtaaaataatgtatgattttctgaacttttgttttgttttgtttctgagacggagtctcactctgtcgcccagtctggagggcagtggcgcgatctcggctcactgcaacctccgcctcctgggttcaagtaattctctgcctcagcctcctgagtagctgggattgcaggtgcccaccatcacgcctggctaatttttgtatttttagtagagacggggtttcaccatcttggccaggctggtcttcaactcctgatccacctgcctcagccttccaaagtgctggaattacaggcgtaagctactgcgcccagccaactttttgtgtttcaatgaacttgtggcctgtgaagtatggggtttatagcattatctttgtgtggtttctagatctttggtctggaactcatccttgggtctgaagagctatggccggtgctattaggctttaccatccttccagctatcctgcaaagtgcagcccttccatgttgccctgaaagtcccagatttttgctcattaacagaaaaaaagaggagaatgctacgcggagtgagtatctttcactctttagtatacaaagtatatggttgtggtttgttttaagggtgagggtactggatctattttctgtcgtaccctttccctgcccgtcagaatccaagtgaagatggttctgattactctactttgttttttctttttttgagacagaatctcatgctgttgcccatgctggagtgcagtggtgcgatctcggttcactgcaacctccgcctcctgggttctaagcgattctcctgcatcagcctccggagtaggtgggattataggcatgtgccaccaccaccacaccacgcctggctacttttgtactttttttttttttttgagacagagtcttgctctgttgcccaggctgtagtgcagtggcgcaatctcggttcactgcaacctctgcctcccaggttcaagtgattctcctgccttagcctcccgagtagctgggactacaggtgcgcgcgacaccacgccagctaatgtttttgtgtttttattagagatggagtttcaccatgttgaccaggctggtctcaaactcctgaccttgtgattcgcctgccttggcctcccaaagtgatgggattacaggtgtgagccaccgcgcccaacccatctaatttgtattttttttttaagtgaaagcaagtttattaagaaagtaaaggaataaaagaatggctactcgatagacaaagcagcgactaatttgtatttttattagagatgggctttcaccatgttggccaggctggtctcaaactcacctcaggtgatccacaagcctcggcctcacaaaatgctgggattacaggcacgagccaccgcactgggctctgattactcttgagtaaaattttcagcccctaaagaatgaggtgagagggcaggttcaggaatggatgctacccatcacctcacctcgtgcggccctttcctggctgccttacaggaagaatgaatttggggcagcacattctctttatcctttcctctttcttcttttcaccagtcctccagcggttgtggggcacccaggatgtatcccaagacatccaggagatgaaagatgagagtgcaaggatgtcacaagaaaagcaagtcaccgtgctggagctctttagagtgtccagctaccgacagcccatcatcatttccattgtgctccagctctctcagcagctctctgggatcaatgctgtgagtgtgatactttagggtcaaacgtgtcttacaatatttcacttaaaatgccaggcatggtggcggtgtgcctctgtagtcccagctactcaggaggctgaggcaggagaatcgcttgaacccgggaggcgaaggttgcagtgagctgagattgcgccattgcactctagcctgggtgacagagtgagaaacttcgtctaaaaaaaaaaaaaaaaaaaaaagacaaaaattagctggacgtggtggtgcgctactcaggaggctgaggccggagaatttcttggatctgggaggcggaggttgcagtgagtggagattgcgccattgcactccagccggagcaaccagggcagaactccttatagaaagaaataaaaagaaagaaagaaagaaagagaaagaaagaaagaaagaaagagagagagagaaagaaagagagagagagaaaggagagaaagagagagaaaggagagaaagagagagagagaaaggagagaaagagagaaaggagagaaagagagagagaaagagagagaagaaaggaaagaaaggaaaggaaaggaaagaaaaaggaaaaagaaagaaagaaagaaagaaagaaagaaagaaagaaagaaagaaagaaagaaaaaagaaaggaaggaaggaaggaaggaaagaaagaaagaaagaaaaaagagcgagcctggaagtacactggcaacttcagactgagctgactttaccagtctctatgtttttacaagtagaatagggagcatgatagtttaaagagggcggcaaaacagaagctagcatttgacaggtaacccttgtattccatgcaaatatcagcttcctgctattgagtgtggattgtgggaagagagtactcctgtgccttctagtcaattgtggataaaatacggatatgaagagcacccttgtacttcatcccctgagggttttccattagtctttgatcaatgggattaaatcattttgtaacaaagcattttgcaaaacttagtattttgagcattttaatactaagttggttcttggccttttctcctacctaacacaccagatatttgtatttgaagtggcagtgcttcttgtgaggggttagaagctgttttatcagaatgtacaaggagccaggtgtggtggctgctcatgcctgtagtcccagttactactcagaggttgaggtgggaatatcacttaagccaaggagtcaagcctgggcaatatagcatgaccctgtcttaaaaaaaaaaaaaacttgggaggaaatacacagtagttagaaaaagcctcctaggtgattttgatgaatcccagtctcaaatttcctcatttggaaatgataatgtaggccacacgtattactggagaaaaatgtgctcccgagactttccagagcagcagagctgggactaggcaggtgaggcagctacgtgcaagtgtagccctgagaatgagcacctctttaaagaatgtaccttgcgttagttctgtgcctgtttaaaaaaaaaaagaaagaataaaagaatgcacctgaggcaactccctagctgcctcaccacagtctgggccctgcaaaacagggtcagaaaaaaatcacctgtgggaaattacagatgatccatgagcattctgaggaacagactcctcccacttcagagtggtatgtgcatactttctttctttcttttcttttctttctttttttttttttttgtgagacagaggagtctcactttgtcacccaggctagagtgcagtgatgcaatcttggctcactgcaacctctgcctccgggttcaagcgattcttctgcctcagcctcccaagtagctgggactacaggcacgtgccaccatgcccagctaattttttgcatttttagtagagattgggtttctgtgtgttagccaagatagtctcaatctcctgactttgtgatctgcccgcctcggcctcccaaagtgctgggattacaggcatgagccaccgcgcctggcttgctctttctttttttttttttgagaggtagtcttgctctgtcgcccaggctagagtgcagtagcgcaatatcagctcatagcaacctctacctcctgggttcaagtgattctcctgcctcagcctcccaagtagctggaattacaggcggccgacaccacacacagctaattttgtatttttagtagagacgggctttcaccatgttgaccagtctggtcttgaactcctggcttcaagtgatccacccgcctcggcctcccaaagtgctaggattacaggcatgagccaccatgcccagcctataccttaattattgttggactaaagtggctcccaatttagtcaatgagcagattttgctccacatataatcatcacccaaagttagctgcaccggaattatgggggatgggattcctgagtcagctgaatccagagtctccgtgtaagagggctggaaattgcctgtaaaaaaataaatctgggccggggacagtggctcatgcctctaatcccagcactgtgggaggctgaggctggcagatcacctgagatcaggagttcgagaccagcctgaccaacatggcaaaagcctgtctctactaaaaatataaaaattagccgggcgtggtggatgcaccatctaaaaatcaatcaatcaatcaatcagtctgatgcatagcaggcttggaaatcacttttccaacctacttttgtgcaaacaatgtattcttttttttttttttttttgagacagagtctctgtcaccccggctggagtgtagtggcacaatctcggctcactgcaacttccacctcctgggttcaagtgattctcctgcctcagccttctgagtagctgggattacaggcgtgcaccacttcgcctggctaattttgtgtttttagtagagacagggtttttccaggttagtcaggctggtctcgaactcctgacctcaagtgatctgcccgcctatgcctcccagagtgctgggattacaggtgtgagccacctcacctggcccaagaagttttattgagatgtgtacatgtacattaggtttttgatgtgtagacattgtgataaggtagataattgtgataactatttattgcttgtttaaactgctcaagtaattacttttgtaccaacctaatatctttccccacaagcttgacgtcatcatataatatgttgaggttttgttttgttttgttttgagacagagtcttactccgttgcccaggctggagtgcagtggctcgatctcggctcactgcaacctctgcctcccaggttcaagcaattctcctgtctcagcctcctgagtagctgggactacaggcacctgccaccacacccggctgatttttgtatttttaatagagacagggtttcaccttgttggtcagcctggccttgaactcctgacctcagatgatccactcacctcagcctcccaatgtgctgggattacagtcgtgagcaactgcgcctggccaattataatcttattttagaaaatataagtatacatagtttacatcttacatcttagggatttaaatagttatttcttgagaaggtaaatcccaatgtagaggtccatattatcaaaaagactaataaatattgctatggaggcaactactctgggtgaaataaactgaagtgaacctgggtaacctagataatgttcccttgttaacttgaggtctgagtccaatatttcaatatttcttttctttttttttgagacggagtttcgctcttattgcccaggctggggtgcactggtgcgatctcggctcaccgcaacctccacctcccgggttcaattgattctcctgcctcagcttcccgagtagctgggattacaggcatgcgccaccatgccctactaattttgtatttttaatagagacggggtttctccatgttgtcagggtggtcttgaactccaacctaaggtgatctgcccgccttggcctcccaaattgctgggattagaggcgtgagccactgcgcatggccagtttctcatagctgtgatagttgtagcaaccttactttttttttcttttttttttttgatatggagtctcgctctgttgcccaggctagagtgcagtggcacaatctcagttcactgcaacctccacctcccaggctcaagcgattctcctgcctcagcctcccaagcagctgggattataggtacccaccaccacacccagctaatttttttatttttattacagacagggtttcaccatgttggctaggctggtcttgaactcctgacctcaggttatccaccagccttgggctcccaaattgctgggattacaggaatgaaccactgtgctcggccagcaaccttacattttagcgcagtgcctagtaaataacaaacatagtaatttatttaatatatattaaattgcaatagtagctggtattatttcataaaacacttcaaaagggcctaggcctaggaaatacagcccaatctctgcttattcaaggagcaggataaggttattcaattagttcactatcaaattgagacatcaatgtgcctatcagtgttttgagggtttggggaagagtcaattaaaaaagcatttagctgggcctgatggcacatgcctataatcccagcaacttgggaggctgagaggcaggaggatcacttggagaccaagagtttaggaccagcctgggcaacatagtgagttgctgtctcaacttataaaaaagaaaccagttagtaggaattacactttcttttttttttttttttgagatggagtctcgctctgttgcccaggctggagtgcagtggcaccatctcggctcactgcaagctctgcctcccaggttcacgccattctcctgcctcagcctccccagtagctgggactacaggcgcccgccaccacgcctggctaattttgtttttgtatttttagtagagacggtttcaccacgttagccaggatggtctcgatctcctgacctcgtgatctgcccgcctcggcctcccaaagtgctgggattgcaggcgtgagccactgcacccagcctacaccttcatataagttggtgaagtagacataagcaagaggaaatggaacagtgggaataagcatagttagaagcaacaatggacattagtagctaaaattgagaacatttaaaaagagaaaggagggcgaggtgcagtggctcacgcctgtaatcctagcgctttgggaggctgaggtgggtggatcacaaggtcaggagttcaagaccaacctggccaacatggcgaaaccatgtctctactaaaaaaatacaaaaattggccaggcgtggtggctcacgcctgtaatcccagcactttgggaggccgaggcgggcggatcatgaggtcaggagatcaagaacatcctggctaacatggtgaaaccctgcctctactaaaaatacaaaaaattagccaggcctggtggcacatgcctgtaatcccagctacttgggaggctgaggcaggagaatcgcttgaacccgggaggtagaggttgcagtgagccgagatcgtgccactgcattccagcctgggcaacagagagagactccatctcaaaaaaaaaaaaaaaaagaaagaaatacaaaaattagctgggcgcggtggcaggagcctgtaatcgtgccactgcactccagcctgggtgacagattgagactccgtcaaaaaagaaaaagagaaaggagataagattcagaagataattcagggatattaggattgaacaaaaattgtagtaaaaggacttcttacctcctgggacttttaagtattttttaaattttattttatggtgacagagtcttgttctgtctggcctcccaagtagctgggactacaggtgtgtgccaccatgcctagctaatttttatatttttagtagaaacagggtttcaccatattggccaggctggtctcaaactcctgacctcaggcgatctgcttgccttggcctcccaaagtgctgggattacaggcctgtgcaaccacgctcagccttaagtattttttgagggttctgtgtaagtggtgtgcagaattttatcaaagctgcatgttttcttttctcctaggtgttctattactcaacaggaatcttcaaggatgcaggtgttcaacagcccatctatgccaccatcagcgcgggtgtggttaatactatcttcactttactttctgtaagttggatggtttgataattttggggggagaaatgaatccttgctacagatgttcaaagatggattgcatggctccaccgttatttagttacaccttttttgttatttatttttatttttttaaattttttgagacagagtcttgctctgttgcccaggctggagtgcagtggtgcaatctcggctcactgcaacctcagcctcctgggttcaagtgattctcctgcctcagccttccgaagtagctcggatacaggtgtgcgccaccacgcccaactcatttttgtatttttagtagagacggggtttcgccatgttggccaggctggtcttgaactcctgacctctggtgatccacctgcctaggcctcccaaagtactgggattacaggtgtgagccagcgtgcccggactgttgtttaattttcctttggaaaaaagagatacattcaatgctgaatgtagtcttcattcttcaagcaaatatggatggatgggaaaagaggaagtatagaagggactatacagtatgttttgaacttggaattggaggagaggtgtttggaaaaactttcaaactgttattcctctgtttttacactaaaacaacaataataacagaagatttctgtgacccccaaaatatataaggatttgtccccatcaagtaagcaatcagttccgtagtggacactatctaggtgtcctgtgatttaattctgacactacctggagatagcatcagagctcacaggttggtggccgatttcccaagactgcccccaactcctgatgccagtcacaagctccaggttgttttacctgtgcttctgactcaccagctgtagatcaggattcccacgacatcctctttgggtttgattaatttgctacagtggctcacagtactcaggaaaattgtttcctagtttgatttaaaggatattttaaagcacagaaatacacaaccagatgaagagattcacagggcgaggtctggagggatcctgagcatgggagcttctgtctctgtggggttggggtgcactcctagcacatagatgagttgttgctgaccttcctgtcagcttccacgggttcagatatctggaagctccccataccctaccttttgggccttttatgcagacttaattggttctccatgattgaagcatggacaactgttctgacctgtgattggacaaaaagggaatgatctgaacccagctgggcctgtctgcttagatgatttgttggcctctctgtagcgtttcttcctctagggtgtggggcaggaccctctctgaaatgagggttttatgacccacagtcagattagcgtcctgccaagtgggagggcaggagaaagtcagagaagaattctgttatctgaggcctgctcctgaggcctgaagcatcccaacattatgacaaaagactctaccaagggctatggggattttgagccaggacctgtgaatggcacacaatatgtatgtatataaaatcataaatcacaggaggggtatccataacaagtgtcctgctgttggtaaggcagatttcaagtagctcagatgctgttttcatggaaaggaaaactgaagtttcatgtcatattcttcttccagctatttctggtggaaagggcaggaagaaggactctgcatatgataggccttggagggatggctttttgttccacgctcatgactgtttctttgttattaaaggtaagtgctctttgggtgaaaaaaaagggagggggaaagaagagaggttacagttgacttctgtgacacaaggggtgggttgttaaggttgcagtttgtcaataaagtcagaggagagaagcaagatgcccagagtttttaagaaacatgggtcatcagagaactggaggtaaactgttagaatctttacatttagagaacattattatggtttataaaataagttatctaatttaattcttttgtttgtttgtttgtttgtttgagacggagttttgctcttgttgcccaggctggagtgcagtggtgcaatctcagctcaccacaacctctacctcctgggttcaagtgattctcctgcatcagcctcccgagtagctgtgattacaggcatgcacctccacgcccagctaattttttatttttagtagagacagggtttctccatgttggtcagactggtctcgaactcccaacctcaggtgatccacctgcctcagcctcccaaagtgctgggattacaggcatgagccactgtgccctgcctaatttaattcttaaaataatatcaaggtaatcacactttatggatgatgacggggtctcagtacaaagtgacatatatgagatcacatagatgggattcaaaaatccaagcctggctgggtgcagtgcttcattcctgtcatcttaacactttgggaggccaaggtgagaggattgcttgagcccagaagttcaagaccagcctaggcaacatggcaagaaactgtctctaaaaaaaaaaaaagtatttttttgtttttgttttttgttttttgagacagggtcttgctgtgtcacccagttgggagtgcaatgtcgccatcttggctcactgcaatctctgcctcccaggcttcattgattctcctgcctcagcctccctggtagctgggattacaggcatgcgccaccacacccagctaatttttgtgttttttagtagagacagggtttcaccatgttggccaggctggtctccaactcctgacctcaaataatccactcacttcaccctcccaaagtgctgggactataggcgtgagccacagtgcccagccaaaaaaacaacgaaaaccttttgtttaattagccaggtgtggtggcacatgcctcaagtcccagctatttgagaggctgaggtgggaggattgcttaagcccaggaggtcgatgatgcagtgagctgttatagcaccactgcactctagcctgggcaacagagtaagaccccgtctcaaaaaataaatataaaaataaaaataaatccaagccttttgattccacagccactctttgtattgtacgtcaggacaggaggagcttgccattagttgcctctgggaacctagatcctgggttacactgtctttaaatttaatcttctgtgttccttcctcttacagaatcactataatgggatgagctttgtctgtattggggctatcttggtctttgtggcctgttttgaaattggaccaggccccattccctggtttattgtggccgaactcttcagccagggcccccgcccagctgcgatggcagtggccggctgctccaactggacctccaacttcctagtcggattgctcttcccctctgctgctgtaagtaaactcaccttatctatgtatctatgtatctatctatgtatctgtctatctatctatctatctatctatctatatatatatatatttttgagactgagtctcgccctggtgtgcagttgcccgatctcagctcactgacaagcgattcttctgcctcagcctcctgagtagctgggactacaggcacccgccaccgtgcccagctaatttttgtatgtttagtagagatggggtttccccatgttggccaggatggtcatgatctcttgacctggtaatctgcccgccttggcctcccaaagtgctgggattacaggcgtgagccaccatgcccggccaactcaccttatcttaaaaccagcctacgtaggctgacatattgaagatacaccttaataatacagtagtcaggctgggcgaggtggctcactcctgtaatcccagcactttgggcggctgaggcaggcagatcacctgaggtcgggaggtagagaccactctgaccaacatggagaaaccctgtctctactaaaaatgcaaaattagccgggcatggtggcgcatgcctgtaatccaaactacttgggaggctgaggcaggagaatcgcttgagcccaggaggcagaggttgcggtgagctgagatcgggccattgcactccagcctgggcaacaagacagaaactccgtctcaaaaaatatatataataataatagtaatacagtagtccctcctcatctgcagtttcagttacctgcagtctaaaaatattaaatggaaaattccagaaataaacaaatcataagttttaaattgcacccgggagcagtggctcaaagccggtaatcctaggactttgggaggtggaggtgggcggatcacttgcagtcaagagttcgagattagcctgaccatctggtgaaacaccatctctgctaaacatacaaaaattagccaggcgtggtggcacaaacctgtagtcctagctactcgggaggctgaggcaggagaatcgcttgaaaccaggaggtggagttcgtggtgagccaagatcttgccatgacactccagcctgggtgacagagctagactccatctcaaaaacaaaacaaaacaatttacgaatagagacaggggcttgctatgttggccaggctggtctcaaactcctgggttcaagtgatcctcccacctcagcctcccaaagtgctgggattacaggcaggcaccatggtgcccagtttaagaatatatcttttgtccataaaattgtgaagaagaaaaaagaagatgggtgagatggctcacgcctgtaatcccagcactttgggaggctgaggtgggaggatcatgaggtcaggagttcgagaccagcctggccaatatcgagaaaccccgtctctactaaaaattcaagaaatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggagcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaataaaaaaaataaaaaaaataaaaaataaaaattcaagaaattagctgggtgtggtggcaggcgcctgtaatctcaggtacttgggaggctgaggcaggagaattgcttgaacatgggaggcagaggttgcagtgagccaagcttgcaccattgcactcaagcctgggcaataagagcaaaactccatctcaaaaacaaaaacaaaaacaaaaaaacaaaaaaaaacaaaactggccaggcacggtggctcacacctgtaatcccagcactttgggagaccaaggcgagaggatcacctgaggttgggagtgcaagaccagcctgaccaacatggaaaatccccacctctactaaaaatacaaaatttgccaggtttggtggtgcatacctgtaatcccagctactcaggaggctgaggcaggagaatcgcttgaacctgggaggcggaggatgctgtgagcggagctcatgccattgcactccagcctgggcaacaagagcgaaactccgtctcaaaaaaaacaaaacaaaacaaaactggataactggggactactgtaattactgacgctatgaaagattagacatcaaaggctataaaccagattttcaacaatacatagaaaaaaaatgacggcagaaaagattgaaatgggatggcaaaactgggaaccattcattttttattatttgagacggagtctcactttgttgcccacggtggaatgcagtggctcactctcggctcactgcaacctctgcctcctgggatcaagtggttctcttgcctcagcctcctgagtagctaggattacaggcacgtgccaccactcccagcaatttttttttttgtatttttagtagagacggggttttgccatgttggccaggctggtctcaaactcctggcctcaagggatccacctgcctcagcctctaaaagtgctgggattacaggcatgagccaccacacccagctcagcaacacagattttaaaaataatactcaaggccaggtgcagtggctcacgcctgtaatcccagcactttgggaggccaaggcaggcagattacaaggtcaggagtttgagaccagcctggccaatatggtgaaaccccatctctgctaaaaatacaaaaattagccaggcgtgctggtgggcacctgtagtcccagctactcaggaggctgagacaggagaatcgcttgaacccaagaggaggaggttgcagtgagccgagatcctgccattgcgctccagcctgggtgacagagtgagactccatctccaaataataataataataataatactcaaaagtccaaaaatactcagtagacatttggaagcatctaactttaatgaaaaaaaatgacagaaagaaaaatacagagaaatatagtaagttagcaatagaatcataagtaaatctctgaagaaacctttatgttttcattaaatatggaagggttatagcttgaagcctattggaaatatgaatgtgaaggaaattgtatttgtcaatgaccagatttttatatcaaccttccttttttctgtcctttcactagtactatttaggagcctacgtttttattatcttcaccggcttcctcattaccttcttggcctttaccttcttcaaagtccctgagacccgtggcaggacttttgaggatatcacacgggcctttgaagggcaggcacacggtgcagatagatctgggaaggacggcgtcatggggatgaacagcatcgagcctgctaaggagaccaccaccaatgtctaagtcatgcctccttccacctccctcccggcatgggaaagccacctctccctcaacaagggagagactttatcaggatgaacccaggactgcttctgaatgctgctacttgatttctttctcatcccacgcactccatgagcaccccaaggctgcagtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactagaggatataggagaggaaaagtaaggtgcagttgccccaacctcagacttaccaggaagcagatacatatgagtgtggaagccggagggtgtttatgtaagagcaccttcctcacttccatacagctctacgcggcaaattaacttgagttttatttatcttatcctctggtttaattacataaatatttattttttaagtgtaattttgccaaataataaaaacagaaggaaattgagattagagggaggtgtttaaagagaggttatagagtaaaagatttgatgctggagaggttaaggtgcaataagaattcagggagaaatgttgttcattattggagggtaaatgatgtggtgcctgaggtctgtacattacctcttaacaatttctgtccttcagatggaaactctttgatttctcagaaaagttgtatgcctatttaataaagctactcatttcctttggaactttatctttaagataatagtttacatgtagtagtacttgaaatctaggattattaactaatatgggcattgtagttaatggcggttgatgggttctaattttggatggagtccagggaagagaaagtgatttctagaaagcctgttcccctcactggacgaaataactccttgtagtagtctcattacttttgaagtaatcccgccacctatctagtgggagagccatccaaatgagaaacctaaaataattggttcttggtagagattcattatttctccactttgttctttaggagattttaggtgttgattttctgttttattttaactcatacctttaaaggaattccccaaagaatgtttacagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgcagcccacacttgagaggatgaatgtatgtgcactgtcactttgctctgggtggaagtatgttattgttgacttattttctctgtgtttgttcctacagcccctttttcatatgttgctcagtctccctttcccttcttggtgcttacacatctcagaccctttagccaaacccttgccagtgacagtattttggttctcagttctcactgttccctctgctcctggagcctttgaataaaaatgcacgtagctatggagtggggtttagctggaaaggtggccttccaacttcacgtcaacttctggctcctcagtttggcagtaaggcagggaagttgttttcctatttctcactgagaagattgtgaatatttccatatggattttccattattgtttgtttgattctttgttttaaaataaaaattctgaatgt

SEQ ID NO: 38124 - DNA, 20474 bp, Homo sapiens
ctggagtcggcgcgggtgctggcgccatggaggccgagcggggtcccgagcgccggcctgcggagcgtagcagcccgggccagacgccggaggagggcgcgcaggccttggccgagttcgcggcgctgcacggcccggcgctgcgcgcttcgggggtccccgaacgttactggggccgcctcctgcacaagctggagcacgaggtgcggggaagggcggcgggcacgtgcggcggccggggtgggagcgcggcgggagcccgcggcgcgggacagggaagagcgctcccgggcggcgggagccgcggtgagccacccagagcgcgtcctgggcagctctggagcggcgtggagttgggggccgaagagtgacagcaggagaccggggtacctgcggccctgatctgcccgggcccgagaccggctgagggctgcgttgggaactttaggtcctccacacacccgagcctgacacagccctgcgaggagtgaaactcatcacccccacttcacagatgagaacactgcggctccgagagtcccttcagagggattctttcagccgctgcctcacagggacaacgggaaccccgtgaatttgtgtagctgtaactgttgggttcacagaattcggtgttttttcatttgatttgagcctcggggtcccctcatcttgcaggttaaagaaaacaggctgtgagaggtggaggagaaatctaaagaaaaatggaaaagattgagaagcctctaggttctctccctttttgtgaggacggcccatccggctcacctgcctcctccactccaaagcgttccccactgtcctggctggggatgagccctggatttttattgcgtgcccagaggctgaggccacagcaccttcccgggctggcgggggggggggtgttttctttagctgggacccgacatctcctccaggtgctgtctcccggacggagatgagcctagtggcgcaggtgatgaagtggaaaccccagagccaagaacagggacccgggccgggaactaggagtccctgagcctggctgctggccagactctacggtctctgagccagtttttctctgtgtaatcctgattggactaggaaccttcctgctggaaacgtgcagtgagtggcacctccttatgctacagtgtaacagagagtttcctctgcccctcacttctgccatatgctttccgaggaccactctggtcccaggcctgtgctgggtggaagggaccttggtttgttcatgaggacaaaaaggttcccatgggctgcgtggaaggagcacagtgggaatgaccagctcctgcccagccagcctccacggcagcacgccctccctcgggcggtcactcgcccgtctgagacctgttctccatctgggaaggggatggtgagacaccatctggctcccacagtattggaaggatgggaggtggcatgagaaatatgcctggcacacagagggtggtcgccaccgtgccacgtcccctgcccaggccgccttgcctgctgttgccctactaaggggcagccagtgtttttccgtgacccttccccagccgttaaggacagagctgaatcactgctttaccattcacaaacttgcagctcttcctgagtgaagcctcctgctgctactggcccaggtgtggaggaggccgccagcagcagcagcacctgccagcgctgtgggcccttacacccctggccatcagccctcctgcctcaccttaggccggctgccctggaaaggatggggaaacttgaagatacatacatatatatatatatatatatatatatatatatatatatatatatatatatataatttttttctttttttaattgagacggagtcttgctctgtcacacaggctggagtgcagtggcatgatctcggctcactgcaagctctgcctcccgggttcaaatgattctcctgcctcagcctcccgagtagctgggattacagacgtgcgccaccacacccagctaatttttgtatttttagtagagatggggcttcaccatgttggtcaggctgatctcgaattcctgacctcgtgatccgcccgctttggcctcccgaagtgttgggattacagacgtgagccgccacggccggccgaagagatgtttttaaaatgtctactcttctgtctgcacaagcttcccagttgcaaaaccactccccttatctcctggggagctcttccagtcctgccatgaaggggttgtggtgaaggagaaacccagcaccccatttcacagctgggttgaatccaggccaggcttgagacaggctctctgaccctcagcctcacgctgtcccctagggatttggagtactggggcggaagcccgaggtctggattccagccctctgagcctccccccagccctaaactggagaaggcagtagcctccccagacccaccttgagggctaaaggagaactggatggctcttgtctcaggtgccttgtctctcatgtgacccctggtttgctccaccctgggctatctgcctccaggccttcgctcttactcttccctctgcgtggagttcctttccatcctcaccccgtagcctcatgtttaaatcttccccttcttcaaagctggcctctggttatggttcctcatccataaagtcttcccaggccctccaggccccagagcaatttacctgatactcttaggtggcctagaccttactcagcctgagcttcctgagcgagaccttgagtgattcatcctcacgccaccaaagggcaagtcctgcccagtgcacaaaagctgcctgcacctgagtacttagctagtttccaactgccgtttttaatcgagtagtgggaaatacgttttagggaggaactggcctttgttgagcctccactgtgcgccaggactttatgcacgctgtttgatttcattccatcagtgtcctgaaaggtggatgacaccccctctcacaagtgaagaaacagtctcagaagtgtaacaatggcgccacgtgtttatagagcatttgctgtggccaggctccactctgagttctgggtatgaatcacctaatcctcccagtagccctcagagggaggttctgttattcccattgtgtggatgaggaaacacgcatgggatagttaagtaacttgttcaaggtcacttgtctaggaagtggtgaaaccaagatttgaacccacacagcctggctccagaatctgcccagaagccccccttgccggcttgtggcagacagggcgtgagtgtggctgtgccagggacccctctgctccacacacaccagaagaggtcacttgcctgcttgactagccgcacaaggcaggaccaaggcccttatctccccatcccaccttgacctggggcctcgcttcctgttggcctggattgggtggggctgggctggaggaggcttctctgtgagttgactcagctgtcctagtgttgaggggttcttctggtgaggggggcattggggtgtgcccccagccaccaagatcctgactcttccattgacctccagtgtaattggagccaccctctctgcctttggggcctctctttctgtgtaatgtgagtggggtggactacagatacctccagcaagtcctcaaggtcccatctccatgcacagcatcctgtgggacgaggctctggatgacagctcaggtgacggtggggtacattaggtccctgttccgagcctgaaatctccaggagcttcagtctccccgcccgtaagactgtgtggttgcattaaacaggtcccacacctctgaaggagacaagtttgtccttgaggcctgggtgtggcacctcgggtggctttctggagtggtgaaggcattggggtggggtctcctgcccacacccctgctgacgggaactctggcccccaggttttcgacgctggggaagtgtttgggatcatgcaagtggaggaggtagaagaggaggaggacgaggcagcccgggaggtgcggaagcagcagcccaacccggggaacgagctgtgctacaaggtcatcgtgaccagggagagcgggctccaggcagcccaccccaacaggtaggagcctggccagagacaccaccacaaccttcacttggtgaaaggtgggagatgcagtaatgcagattctcctgggccctgcaccgccgctggacatcttccttaggacagctttgtggcaagcacgtgtggccagcggtgtgtccatcagggcttcagagtactgtccgtggcaacacagcgttcctggggtgaccggatggaccgcggcctgagagcctctcccagcggtctcattgtcacagtggtcctgctacaggggattagaagttccagttttgctcgaggtcaccctccaggttaagggtgcaggtcagccttactcctccccagtcacagcccctctctggtcctgctaaattggaatctggggtgggccctggaacacctgaggacctgagacccagagcaggcctggccttgccaaggaccacggtgtagttagggcagagctgagactgtaccccaggcttcctgcccccagggaccaagagtggctatccctaggtcaggcctgcaggcccatctgccaaaggttttgtggaccctcagagaaacttgctgggcccctgtgtccacgcacagctctttgggcaggggtctggtctcttctgcagagcttctcccgcctcctcctccagctgggagtgggcagtagcaagccaccccggaaatacggacagcccagcacccccgcccatgcgtgcttgggctcaccgtccccttcaggttcagtgaagtgagttctcctgtgcggctcaggcccaggaacaggtgaattcagtgcagtggctgccctgggagctcccagctcatgttctctctcgggcctacaaccacataccccgctgccagccttgttttgggtggtggggaggctagggatccagagtcttggatttggagcctgagtgtttgtttcagccccacctgcttccgggcctttctgcttccgggcctttctgcttccgggccttcatccccctgagtctcccctgattgccaggccctaacaagctctccatcctcatccccatagctatctttgtacaacaccccttgttgcacttgcccagggtcaccccgaaggcctggctctgccctgcatcacgtggtcacccactctaacacaagtgcaagagtaaacccacttattttaggacaggccaacaaaactcatataagcacaataagataaatactcctgaacttgccccccagcctaagaactggaacactggctgtccctttcattttaaaaggggaacagagacgggggcaagctgggggcggctttgtctattaggcacctgtgtgtttggtgcctcctgatccggcagagctctgggaggattatggtcagccctgtgtcctacagggtagggacagttgatcctgtgccacagccccagcatgcttctgtagcagctcagctgcaggggtcctgtgtgtggggactggaagcctctcccacacaaaggccttggtgcttccagaagacctggctgcgtgggtgaggcctgtgtggtagcccttgtgccgtctgtgtgcgttggcctctggcgtgtagggcctttgcttttgttgagcagctgtggtgtgccaggcctgcaggccacaagatgggcagcatgggcctgccctgcagtggcccgaggtccagttgaggacttcacgctagtgactgctggtgtgtttattacaagtgcttggtggacagtaggtgtaccacatatctggtctcatttgctgcttgtgacagccaggtgacaggcggtagagacccctgctgccctgtttgagaagcttgaagaggaggaggtgcttgctcaggatcacacagggagtgagcagcagcgccagcacctgacccaggcccactggagtccaaaactaggcataactatggcacccagtagaccaaatctaaggaagcttgggccctggtcccaacacagccctgggcctcttgctcccccgacttccctttgccccatgcccacccggcagcctcacattgtggcctgtgcccgcagcatcttcctcatcgaccacgcctggacgtgccgtgtggagcacgcgcgccagcagctgcagcaggtgcccgggctgctgcaccgcatggccaacctgatgggcattgagttccacggtgagctgcccagtacagaggctgtggccctggtgctggaggagatgtggaagttcaaccagacctaccagctggcccatggggtgagtgggtagctgggccccggggagggggaggacaggcatgggcacagacctccgctgccctgtgccatcaggccgggtgaggggccggccagagcaagcaactcactttctcctgtggcttcctaaggagagtgctatcctggggactcggacccagctggcctctgagctcacaggacgcagccctctcagactcctaaactgaaggggcccagatgactcagccgcctctttcctggcccccctgattctgtcactctcttaaaagccctcaaccattcctcacccacccctgctggcctctccggggactcaccccatgctccagcccctcaccactcttagtttgggaaaagacacctgcttgtttctcatgattttagcttagatgtcatctcctccagggacccttccctgagctcaaagacgactcccccgacccccccattaccctcaaacccatatacacccctacgggtgctgggctgagtgccttgttaccaaacgcccttttaccacgagtgttcacgctgtgttacccaggcctgtgtcctggtctgcaaaggcagggctgctgtcccggagcccctagcttagctaaagggcctggggtacatgtgagagggcctccaagatcagagaaatggctgtgggctggtggtcgatgtctgggttccggaagggagttccggtgggtggatgggtgagcgagaggtgccatatgtgctctgtctgcagacagctgaggagaagatgccggtgtggtatatcatggacgagttcggttcgcggatccagcacgcggacgtgcccagcttcgccacggcacccttcttctacatgccgcagcaggtggcctacacgctgctgtggcccctgagggacctggacactggcggtaagtccagcacctgcccgccctggaggaggggcctcagcccagtgtcccgtcaccccctctgatgggcactcatgtcttggcacagaggaggtgacccgagactttgcctacggagagacggaccccctgatccggaagtgcatgctgctgccctgggcccccaccgacatgctggacctcagctcttgcacacccgagccgcccgccgagcactaccaggtgcagccctcctccacccaccaggcctgtctgcttggtagcttccagaatgttctctgtgcacacaccaaatgttatcaaaccccagccgggtgccaggccctgagccagttaccgtgggaggcatagagttttgggagcctctgagagacgaggggctcagagagtgaacacaagctgcctgtggctgcacggtgggggctccagatcccagggtgcctggtgctggcatccgtcctcagggggtccacgctgctcccttgggaaggagggggctgtgcagttggtcttggccatgagccccactcagccccctgtcctcatctcaccgaggcatggaaacaccctgtgttcacacatcgcgtgcctccctccctctgcaggcctgcgagttaccatcatggtcactgttattgataacaaaggtgctttcagtcttggtcagggccccgagggacccagctggcccactcggtagtgcctggctggaggtaagagctcatccaggccccatacaaggaggctggcgggttagggagtcggagttgtcgaggccccagtgccgggggaggaagaggagcctgtgggagcgtagccacctccagaaccagtcagggctgggtaggaggttcctaccctgacccatctctcctccttcccctcctctcccatctgctgctgcttccgtaggctggaaccagcctacaagggagcctgtgcttagtactttgtgggcgtgtgccactcagttccttacaattttacagttctgtttttatcttcattttactgaggatgaggacattgagacacagagaggttaagtcatttgccaggggtcacacagcagggggaagagctggagtccagctgaggctgcaggcttgcccccacggcgactgaagtcatcctttttgcacaccaggcgctcactaagtgcctcggagggtttcgggaagggttagacgagttgacccatgtgagagtgggcgcgtggaggctgggcgtgggggctcatgcctgtaatcccagcactttgggaggctgaggcgggcggatcacaagatcaggagatcgagaccatcctggccaacacggtgaaaccccgtctctactaaaaatataaaaaattagctgggcgtggtggcgggcacctgtagtcccagctactcgggaggctgaggcaggagaatggtgtgaacccaggaggcggagcttgcagtgagccgagatcgcgccactgcactccagcctgagaaacagagcgagactccgtctcaaaaaaaaaaaaaaaatagagcgggcgtgtgtggagtggtggcgtgtttgtgtgggcgctgctgattgcaggggtgggctgtgggtgggggggcctcctttcactttcggtctaagtcagtggtgattgaaccaaccatgccaaaaacaaggggctcagtcttgttggttcaaagggtgcttacaagcctcccagagcccctgcaccaggaaggtgcttagtacacgtttgtctgaaaaagtgaatgccttcgtggatgcaactggagggacaaacacttcctggtctcgggtttgtttgttaatggaacatgaactaaagtttgtgtttttccttgggaagctctgggctgaccaggaagaggaggagatacaaggccacgcatccttgttttttcccatttgaccctttacaatcaggtctgtgctctgggcccagggttgcctatgttgattagctatggctgggtaacaagtaactccaaaacttagcaccttaaaacagtaaacatttattatctcacacgatttctgtgggacaggagttcaggagtggctcaacggggtgcctctggcctcaagtctcccttgaggtacacaggccgcccgtcgggctgtggacccgcttctgcatggcatatgtgcatgcctgctgtgttggtgctgactgttggcagcaggcctgggctccctgccttgtgggcctctccataagagtgctcaggtgtcctcaggatgtggcacctgatttctcccagagcaagtgatccgagggagagagcagagaggaagcctcaggcttcatggccttgttgcagaagcaaccctgtcccttccacctttttcctgctcattagaagcaactcattaggcccatcccaccctcagagatggatgcggctctgcctttggaagatagtgtcaaagagtttgtaggcatgttttaatctttttttttttttaattttttaaaaaagatagggtcttgcttttgtccaggctagagtacagtggcatgatcctagctaactgccatttccaattcctgggctcaggcaatcctcctgcctcagcctcccgagtagctgggattccaggcaactgctaccaagccccgctaattattcaacttttctgtagagacggggtctcactatgttgcccaggctggtcctacacacctgggctcaggtactcctccacctcagcttcccaaagtgcagggattactggcttgagccaccatgtgcagccacgtgggcatgttttaaatcatcacactgcagaagctcccgacagccctcgtggctcctaggacaaagcggctcctctcaggaggggtttggcaccttctcgccccctgcgattttgaggtagcaccgagaagatgtgcaacaatgtttaccttgttcttttgacaccaaactaggactgttcggcatccgaggggcctggagccccagaatcctggggtgaggggggtggttagaggctttggggtgttgggagggaggagcagccatgcgccccttgaggccatagaacctgatgccaggtggtgaggcttgtgtcccctccttcttttccttttttttttttttttttttttttgagatgtagtctcacactctctcccaggctggagtgcagtggcgcaatctcggctcactacaacctccgcctcccgggttcaagcgattctcctgcctcagcctcccgagtagctggaattacaggcacgcgccaccatgcctggctaatttttatattcttagtagagtggggattttgccatgttggccaggctggtctcgagctcctgacatcacgtgatccacctgcctcaccctctcaaagtgctgggattatggacatgagccaccacggccggcctttccctcccttccttgacctcatctctacttccggtgtgtttccttttaggccattctggaggaaaacaaggagaagctgccacttgacatcaaccccgtggtgcacccccacggccacatcttcaagtgcgtagcccccccccactgcttgggctgggacttgtccgcagtccccgcctcccatgcttcgtggttcccacagccccagaacagtgcttggcacgtggcacgcagcaagtcagccgcatcctgtctgggcacagcagtgacacgtgcagggagtggagttcttgggaccccagagaaaatgccgcagaaagtgagagagcgagcagggctttctggagatttttttttttttgagacagagtctgtctctgtcacccaggctggagtgcagtggcacgatctaagctcactgcaacctccacctcccaggtttcacacctcacctatgaggccaggcatagtggttcatgcctgtaatcccagcactttgggaggccaaaccaggcagatcgcctgagatcgggagttcaacaccagcctggccagcatggtgaaagcccgtctctactaaaaatacaaaaaaaaaaaaaaaaaaaattagtagggcatggtggctggcgcctgtaatcacagctactcgggaggccaaggaggaagaagaatcacttgaaacctgggaggcagagcctgcagtgaactgagatcgggccactgcactccagcctgggctacagagcaagactccttaaaaaaaaataaaataaattcatctttgaaagttaaaaataggaataggccatggaaatgctggcagtgagtgggtaaagggccccctgggcagaagcgttggccaccactggtccccatcccacccctgtcctctgggcaccaaggggtcctgttaccaaccttgcatgtcatggggctgctccgcttacctggatacgatgctcatccagtcctggaaaccgacactagccaggcctgtgcatgccagccctccccacagcagggagcctttgctggccaggaacatgctgggcacccacaacaggcacccgggctgccagtaggggcccctcccaggaggctgcaggtgtggctgttgagttaaggaaagccaggccggcaggtccaggcgggacaccttgcagaagcaggcacaggtgaggacccagagatgcagagcagattccacctcagccttcacaggagcccctccctgaggctcccagacactccccttggctgcccaaacctggtctagccaagaacaggcaggctgctccactctgccccctccaccgggcctgagggctttcctccctgctggcctctgccccagctgggcagcccaggggctcttgctgagacgtgagtcttgtggtgacctggccagggcctaaggtccctccacctcctctggggcagaggcctcacggaggcccttggtgtgcctgtctgagattggtggccccagcctcatcctcttgttttgcatgtgagaggaaagaactagcacataataaacacccaaattatgccatttaattttaatgacaaatgtgaggtggacggtgtggtccagtcctgcggatggggaaccaggggtcacaagggtacaggttgcgcccctccctcagcagattggagggagcggggtctgaacccgggctgtccagcatcatgactcgaacccaggacttgcctctgcctcattagcttcaaaacagggaagggagtccctgagccagggctagtgctggagtcccgcttggacacttgggagccgggatcacccagctcgggctctccccacagggtctacacggacgtgcagcaggtggccagcagcctcacccacccgcgcttcaccctcacccagagtgaggcggacgccgacatcctcttcaacttctcacacttcaaggactacaggtgagggcacctctggccgcaggggccctcccagtcagggcttctaggcactgccggcctccccttgagctggcgcacctgcctccgccctgcaggaaactcagccaggagaggccaggcgtgctgctgaaccagttcccctgcgagaacctgctgactgtcaaggactgcctggcctccatcgcgcgccgggcaggtggccccgagggcccaccctggctgccccgaaccttcaacctgcgcactgagctgccccagtttgtcagctacttccagcagcgggaaaggtggtaagtcccagacacggcatcggtgtgctccatggcccttttccccggcccagcgtctgtgtccgcctgctcctccatgagcacccactgtggaaaccgtggtgcaggagccgagctgtgggccccgaacgtcacggccgtcttcacggaccgcaggacctctccaggtttttgctggggctgtcctctccaccgcagcgcagctgcctggcctctggcaaacccctccttgtttcccatgcccctgcctctgacagctctctggtgccccctcagctcccaaggagaagtgggctgccctcttctgcctctgggtcctggggtggcaccatctgggaacacaggccccaggcgccccccagacagcccttctgctccccaggggcgaggacaaccactggatctgcaagccctggaacctggcgcgcagcctggacacccacgtcaccaagagcctgcacagcatcatccggcaccgagagagcacccccaaggtgggccccgcagaccaggagccccagggctcagggccctggctggacagtgagaggtggggctaaggggaccgagcatcatggtccttatggacaggtccaggctgggcagggtggcttacacctgtaatctcagcactctgggaagtggaggaggatcacttgagcccagaagtttggaaccaacctgagcaacatagggagacctcgtttctacaagggaaaaaactttaaaaattatctgggcatgttggcacacacctgtagtcccagcttctcaggaggctaaggcaggaggatcacttgagcccgggaggttgaggctgcagtgagctgtgatcgcgtcactgcactccgccctgggcgacagagcaagacccagtctttaaaaaaagaactgtcctgggtgcgtctaatcgcaaagttcctaccacatagtgtgccaggtatggctgcccagcagggtgaggtggctgagcctggacaaggagcctctcagagccgtggtaaagattcatagtgaggggacatccagaagcagtattgggattgcaggacacaggatctgcctggactgtgtacatagtcagaggctggcgggaaatgcatcatgaggacgattgtcgtggagacttcaggccatgggatgggggtggatggaattatgggtgagaatttatatttcatttcaattaaaaatggatataaagactttgcttcagggtgcggtggctcacacctgtaatcccagcactttgggaggccaaggtgggcggatcacctgaggtcaagagttcgaaaccagcctggccaacatggagaaaccccttctctactaaaaatacagaaattagctgggggtggtggcgggcacctgtaatcccagctactcaggaggctgaggcaggagaatcgcttgaacccgggaggcagaggttgcagtgagccaacattgtgccaccgcactccagcttgggcaacagaacaaaactctgtctcaaaaaaaaaaaaaagactttgcagcaacttaggcaggtttgaaaaggcagaaggaggagtaaagtgcagccatgtctgtgccccctgcgtggctttgtgtgctcgggagccccagggggctctgtcctggccaccagcgagcttgcacctgtgtcctccaggttgtgtccaagtacatcgaaagtcccgtgttgttccttcgagaagacgtgggaaaggtcaagttcgacatccgctacatcgtgctgctgcggtcagtgaggcccctacggttgttcgtgtatgatgtgttctggctgcggttctccaaccggtaagtggagggccggctgggtccagggtcggggagctgggtgaccgggtggaggtagcgggtgggtgatgggccctttttggaatcagaaaatgttgttggaaggcaccctccatcactcacccagctagcggcccttggagcccatctcccttggtgttaattggcggtgacttgccctgcccacctcagagttctggtgttgcccacagtaatggatgtgaacattctttgtaaaatgggcaccaacatgagaaccaggtgccatttttatggacctgcagaggcttcacagctagcacctcactcacctccaccccagctcagtggggctgtggggctcccccagccacacagacaagggaacaggctcccgcctgagcagcaggtggtcctgccctgagccctgaacccctagttgggaaggctgagtgggtggcacctccctcgcagggacaaggccgctcaagaacccatatgtgtctgcacacttgtcttccagggcctttgcactcaacgacctggatgactacgagaagcacttcacggtcatgaactatgacccggatgtggtgctgaagcaggtagggcctgagggaggtgcagagcaggttcacacagaggccagggcacacccgaccccaccccgcccacactgcctcctaggaggactggcacacaggccagtcccaggagccgcctcctgagttcctgctatggaaggcgattgttagcgctgccatcatgagccaggctgggttctgtgttgtctcaggtaggtctccccacggcacagagggccactggctgtgtttgagataatgtggacacagagggggatgggtccagcagcaggttgagacagtgtgttcccagccggggcttactcctcaccaccacttcaaccggaaaagcagaccaccctgtgagtgccagggcaggcgggggcggggaggccccacctggtccggctggctgctggcccgtgaccctgcccgggtctaggacctcctgtcctccctggtgcacagtgttgagcggtgccccatgcagtgggcactcagtgaatggcagctgcaccatctgagcacctggagctcaggggcatctggacaaaggcccttccaaggtgggggcgagaaaccagagctggccagccagtgtacgtggacaggtaggcacagcctgcacagaagcaggaggccagctctgggtacaggaaggaagaaaggaagtcctggaaggcctctgtggcctggctggttaatgagtgtttcagatgcacagaacacctaccccaccctgcctgtcgccagccttgcaggtgccgcggactccccatgcagccagccccaacgctccccgacccctgaacgtgtggctgtcattcccaggcatgtctttggttcttttcagcaggagtatgttcctgaccattcaagctgctgttttgcttacttaggttttttgttttgttttgtttttttgagagacaatgtctcacgctgtcacccaggctggagtgcggaggcatgatctgggctcactgcaacctcaatctcctgggcccaagccatccttctgcctcagccccctaaagtagctgggactacgggcacgtgcctccacgcccggctaatttttttgtatttttagtagagacggggtttcgccatgttgcccaggcttgtctgaaactcctggactcaagcgctccgcctgcctcagcctcctaaagtgctgggattacaggcgtgagccaccatgcccggcctcctacttaggtttttatgtaaatatcatcttattcaacggatccttctgcagcttgctttgttggctgagtggcgtgttttgaggttttgaggttcgggcttgttgctaactgtggcggcgattggtcatctgaggtcttcactaatgataaatcatggcgcgtgaacatgcgtggaggcacctggccatgcccatgtccgaggagtcctctaggaggacttggagaaagggccctgccatgcactggtgactataccagcacacactccccacaggggccgagtggtcctgttgcttctgtctgtcttatccttgcctgtgttgaagcctactccctaggacccagaccccccagcagggccccaggacattgttggaagtcgccctcaggttctgagcccctcccttctgtactgtgggggtcatcccgggagtcctctcctggagctctgtgcctggggaggtacgtccagcatggcatggatggcgggcttccataggggcctttcctggcttgttcttttctgggagaaacctgagccgactgccaccttcctcgggtgtgttttgggtaaagtcttgaggccagaaagatcttgcatccctcaagcactcttgagctggtgctgaaccagggcacaggcaggtcccgcggcggagtcttgagctctgcctccttcgcactgtactgagctgagtgtgaggatggtgccagcccaggccctgcagtttctggagccctcgatgttcattgtctcgcgtgagcctcacagctgcgtggcaaagtcagtttactgggcagagcacattttcccatttcacagaggaggaaacaggctcagagaagttaatccgttggtccagagtcacacagtaagacctggagcccagactccatctcctgcctcctgtttggaccctgagggttcggggttggctgcctgctcctggaacccccacccagtgtcagaagctcctggtccaggcagtagcaggctgcctgctcccggcccagcggaggcctgtacagagcgtgatgggccctgtgtctgttgcaggtgcactgtgaagagttcatccccgagtttgagaagcaatacccagaatttccctggacggacgtccaggtaattcctgtcctgcacaccatcgcaggccggtggggcgggtcccgggctgggggcctgcaggagctgctcccttccctctctgctggcatgggctgggagggacctttgtcccctgcagttggtcattctccccagaggctggcaagacagcgtgggctcccctcccttccaccctgggcatttgtgggtgctcctgagagggagggagctggaggggcatgtggggcacccctgggacagccagagggtggcggcactgcctgaccctagattcccagtcatatggagacgttggctgggcctccatgtccagcagcggcattctgggtgctgtgttgagctccttggggcagtggggagcaacggggtctgcggcaggagatgggcagatttgcagaaggtgggcgtcaggagtaagagggcaggtgctgggcggaggtggccatggtgaggtctagagacgtgaagatgtgggagggggtgacttgggccacgtggggcccgggacttgggcaggggcagcagaccccctcttgagaggctgttctgagcaggcctcgtaactcaggctccccggtccccaggctgagatcttccgggccttcacggagctgttccaggtggcctgtgccaagccaccacccctgggcctctgcgactacccctcatcccgggccatgtatgccgtcgacctcatgctgaagtgggacaacggcccagatggtaagaggggctccccatctcctgatccaaaccagcaggcgccccctccgccagccagccacagcctggagaaggcaggcagctgccccaggctgtcctctggcttgaatcagccaggaatctgggttggggaaagccctggcttggcccacaggaagtgcctgcggtgcagagtctggaggggaaaggctgcgggttgggcctctgagtcgggggagagctcacaggacaggagacccgtgtgaaaggcaccctgaccccaacccacaccaccctggctggccttccctgtgccagacccccacacagtacactgctgctgcatatctacttttttttttttttactaaactgaacatccaagcttaaagggccaggctgtcatccctagggctggaggcagccctggcctctcctagagaagcagatgtcaggccaggcctccccagcaaagtcaagagacccaagttctaggcccggccttgtcctgctcatcccctgggaatcagggcccaggttcatggcctcccagcctttgctggatccccaggccactgtccctgcagagtggaggccaacgagccttcacactctgctgcgctctttgccatcaggaaggcgggtgatgcagccgcagatcctggaggtgaacttcaaccccgactgtgagcgagcctgcaggtaccaccccaccttcttcaacgacgtcttcagcaccttgtttctggaccagcccggtggctgccacgttacctgccttgtctaggcactcgctgtccccaaaacctgtgcttggggcaggattccaacctcagttctctgagctgcttctgcaaaggcccccatgtccctccccacaccggccctgggcatagcctcagccccaggcctctgtcctgccgagccatcctcccggcgccacactccgggagcacagcatcctcctctcacctgtgggtcagagcaggacagtgatggtgtccccagggctgagcaccaccccacgccctgccctcacccctcaccaccatctgtgcactgatgagtctccagtttagccaagggctttgttcctggcatggagaatttgttcctggctgctgtgtttccagggggtgctgggggaagggttccgtggagcgagacaaggtgtcctcgggagcagggttccaccgggaagcgtttgggagccctgtatcacacggggcaggcgggtttctcttccggggtctctgctcttatgcatcaggacgaccccgggacggctgtggggccccacactgcacccacagggctctatgcgacaggggcccaggaacagcctgaggccaccacccagcaagcccgccttatcacccattccagctcacccagaaccttcaccagcaaacctcctgctgaggtcctggcaggaggccaccgtcttgttaccgtttccttttcgtttgctgagggtcacagaccccaacagggaaatcagtatctgtcttcccagtggttgccctgctcgccgggcactccacggggtcccgcccttgtgtgagatgggccaggatccttcggcaaggggcgcctggggctggggctgattgtgggcggtggagcgccagacagaaaaggattccaatgagaacttcaggttaaagtcagatgccacctaccagggtctacagtcaaaatgttggctttttcttattttttaatgtatgggagaaaaatgtaaaattccagttcttttctaattgtgtttctgaaattaggagtcagctgccagcgtttttgtgtggctgcagtgtgcctgggcccagctcacgggcagtgggtggacctaactgcccaggcaggcgagagctacttccagagccttccagtgcatgggagggcagggctaggtgtagcggtgtctcctctttgaaattaagaactatctttcttgtagcaaagctgcacctgatgatgctgcctctcctctctgtgttgtctgggcccttgtttacaagcacgcgttacccttcctgaggggagccatgctctagcccctggagggcctgttgcaggggcagggcgggcccgtcgcctttggcagctcctggagagctgtggacatgcagtccccctcagttcgtgctgcaataaaggccatcttctctta

SEQ ID NO: 38125 - DNA, 7576 bp, Homo sapiens
gcactcggctcggcccggcccgggccgcagcatggccgagccgctactcaggaaaaccttctcccgcctgcggggccgggagaaacttccccggaaaaagtcggacgccaaggagcgcggtaagcggagatcggtggggaacagggggcgccgagccccacccggcctgggagcggggtcccagggccccgaggacagacggtgggggggatcagggggagccccccgcaccccgctgcagactggggtgcctccagccaggggagggtaggggtcctggaaggaaggggctgggagggaggggggcgcggaccgttatgtgctgctggccggggatgccagcgctgcgggctccttgggaggcccgggagggggcctcgcccacgacaggaaatggggccgcgactgagggcctggagggtggaggggaggaggggctgggaggccgggacactggggcccagtcgggctgggcaaggggcatcgggagccctggaggcgcaggatgggagatgggaggcgtactcctgcaaaggaaagagaggggcggcccgtcaatcagagtagctgccccctccgcctcccacctactaacagtgacggcaactgcgcctgccttagccccaggaaactgtcccttttatacagatggggaaactgaggcacggagcaattgggtcatgtgcccagggccatcgacttaaacagctctttggactatgctacaaacagagaccctagagggtggacatcagaggtggccagaggaggagttcagcagggtagcaagtaaaaaccttagagaaacagctgcgtgggatagggggacccaggaaggaaggagttaaaggaggaaggccagaccattccatggacgtaccccttccccccaggccttcccaaagattcccaatgttcccagggaagggagaagggacagagatgcccaaacacaaacacacacaggaaacagcccaggacatgagacaggagaggagggagggaaggggaagtcccaaagcattgagcgtggggggtctggcctgggctgagggacaagggcccatcccaggatggcgacagagtttggaagacaggagggagggtaaaaggggcaggggactgggagtgactgtgctgcagggaatagaaaacccagctcctcactcctgagcacgtagtgcctgctgtgggctgtatacttttccaaaaggctcctggaagcctccctggacatggaaatcacatccccccatttcacaggaggatactgagcctcagagagggaagcgacttgcccaaggccacgcaggtgcaaagctccatgccacggttattgagagggtagaggaagtggagactggaacgcagtacctacgggccccaggaagcctgacttagaaccctgaggctgcagggatggagtccccttttgggatgccagggactgagtagggggtgctctaagctgataactgagatcgctagcctgtggctgcctattccaaacaaaacagcaggatccaaggaaccatgacttatcaggggccggccagggccgtacacagcatcccacccactgatcaattgcacagggctgctctgcaggcagtgaggggctgggtgggtctcactccccttgctctctgccaggccacccagcccagcgcccagagcccagccctccagagccagagccccaggctcccgaagggtcccaggccggagcagaggggccctccagccccgaggcatcaaggagccctgcacggggagcctacctgcaaagcctggagcccagtagccgccgatgggtgctgggtggggccaagccagctgaggacacctctttagggcctggggtacctggcactggggagcccgccggcgagatctggtacaaccccatccctgaggaagaccccagacctccagcacctgagcccccggggccacagcctggctcagctgagtcagagggcctggccccccaaggtaagaacaagcttcccatccccttccccaaggtgagcaccagctccacatcccttcccttcagggtagcaccagcctcacactccctcctcccagaggagcaccaacctcacactccttcccttcaggggagcaccagcctcacatccccaccccgtcagatgctcccagaggagcatcagcctcacaccctcctccccgccaggggaacaccagcctcacactccttcccttcaggggagcaccagcctcacccccctcccctaagcccaggttcctggaccctgaagtctgctctccacacaggtgcagcccccgccagccccccaaccaaagcctcccgcaccaagtccccgggccccgccaggcgcctctccataaagatgaagaagctgccggaactgcggcgccgcctgagcctgcgaggcccccgggctggcagggagcgcgagagggctgcccctgcgggctccgtcatcagccgctaccacctggacagcagcgtggggggccccgggccggcagcagggcctgggggcacccggagcccgagggccggttacctcagcgacggggactcaccggagcgcccagctgggcccccatcacccacctccttccggccctacgaggtgggtcccgcagcccgggcacccccggccgcactctggggccgcctcagcctgcacctgtacggtctcggggggctgcggccagcgccgggggccacccccagggacctctgctgcctactgcaagtggatggggaggccagggcccgaacagggccactgcgaggggggccggacttcctgcggctggaccacaccttccacctggagctggaggccgccaggctcctgcgcgccctggtgcttgcgtgggaccctggcgtgagaaggcaccggccctgtgcccagggcaccgtgctgctgcccacggtcttccgaggtaggacatgcggctgcaggggaggaggggcagggacccccaaaccccaccgccaccccccgcagagtgcctagggggctgggctccgggcggaaggtgtggcctggagcagcgaggccagggtacatgaagcttcagagcacacccggctcaggcccccttgtgtcctcagggtgccaggcccaacagctggccgtgcgcctggagcctcaggggctgctgtatgccaagctgaccctgtcggagcagcaggaagcccctgccacagctgagccccgcgtctttgggctgcccctgccactgctggtggagcgggagcggccccccggccaggtgcccctcatcatccagaagtgcgttgggcagatcgagcgccgagggctgcgggtgagcacccaccccaccccaaccctctggcccccagacctcagaccactcttcaggacaccctatgtacagatgccagacccctacccccaggcctgagccactcctagctccaatcccaacctagacaagggcagaaggcgcccccttgactgtagcaccctgggcagaacccatgggtcatccattgatttaaaaacaggatccaagccctcctggggctcagagtctgatgggggaaaagatacgactctagtcattcacaaatgtaaaactataactgggactggagttggggtggggtgtacctagggtctgggagagcttaaaacaaaacctggggtagtcatggaaagcctcctcaaagaagtgtcagtttcctaagtcaaaggagatggcagccaagacaagtagtccaagcagagggtttacaaggccaggttgtcaaggtagttccaacctcccagcccacaatgcccattgctgcctggcccagaattccagtgctcaccccactgggccctgattagtctgtggccccggcaagaagacattcactctctcttcccacccccaggtagtgggactgtaccgtctttgtggctcagcggcagtgaagaaagagcttcgggatgcctttgagcgggacagtgcagcggtctgcctatctgaggacctgtaccccgatatcaatgtcatcactggtcagcatggccccctctcccctgcctgctcacccccattcaatgcctcacttcaaggccttggggctcctctgggacctcagtcctcctatctgaccttgctttcacccacctcctcttcccccttagctgtgccctccttagccttagaagccagtggtgccctgaccagaggggaccctgtgttcacaggcatcctcaaggattatcttcgagagttgcccaccccactcatcacccagcccctgtataaggtggtactggaggccatggcccgggaccccccaaacagagttccccccaccactgagggcacccgagggctcctcagctgcctgccagatgtggaaagggtgagttgggcctggtgggagtgatgggacttgagagtgggctgataccaatagaatgtttcacccatgcctgggcctgagatgggcatgagctggcagcatcatcatatccccaagaaataggtgctattagcatcccacttcatagatttggaaactgaggcccaaagcaggtgacagttgcccaaggtcacacagccaggatgtgtcaaaaatgcaggctgaacgctgatctttcaacctacaagggaggttcctggctgagggaacctagacaagtcccatccctctctgtgcttcaatatcttcatctgtaaaatgagattcatggcagctctgcttttccaatgcttagttgcctttggcttcagtcttccctccaacaaaataggctcataatactaacatctaatgattaatagtcttaacccgaccacatcccagctatgagactgtgaacctgcttccctactctagccaccttagtctcttgcaggtaggtgccacaggggcctgactttgtctgacttacatcctctcaaccctctcccaggccacgctgacgcttctcctggaccacctgcgcctcgtctcctccttccatgcctacaaccgcatgaccccacagaacttggccgtgtgcttcgggcctgtgctgctgccggcacgccaggcgcccacaaggcctcgtgcccgcagctccggcccaggccttgccagtgcagtggacttcaagcaccacatcgaggtgctgcactacctgctgcagtcttggccaggtgagttcatgcccagggcctgcaccaccaatctgagccaggctgctacagtgatgccaccttaagggaccaatcagtgtcttaggcttgaagctacgccccctcatggagtaaactggtacctggttgcctcagcaaccagttcagatccaaccaatctgtctgttttgtctttttttattttcatttttttgtaaagacagggtttctctatattgcccaagctggtctcaaacgcatgatctcaagccatccttccgcctcagcctcccaaagtactgggattataaaccaaatcaccttgccccacagagctgattcatctttttatttttattttttattttttttgagatggagtcttgctctctagcccaggctggggtgtggtggcatgatctcagctcactgcaacctctgcctcccaggttcaagggattctcccacctcagcctcccgagtagctgggattataggcacgcaccaccagtcctggctaatttttatattttaagtagagcagggtttcactgtgttggccaggctggtcttgaactcctgacctcaagtgatccacccatttcaggcctctcaaagtgctgggattacaggcatgcactaccaatcctagctaatttttgtatttttagtggagatggggcttcacggtgttggccaggctggtcttgaactcctgacctcaagtgatccgcctgcctcaggcctcccaaagtgctgggattacaggcatgatccaggcatgatccacagacctgcccctacccatctttgatgcagtcagaggccctgcctcttgacatgccaatcagaggcctagttgcgtaagcaaccagtcctagctctgccagtgaaaacctgaaagggtcgaaggccgctttccacaggccaatcaggagcctagttccctaagcagccaatcagaggtcggctgtcgcctctttctatgacctaccctgtctcccttcagatccccgcctgccccgacaatctccagatgtcgcgccttacttgcgacccaaacgacagccacctctgcacctgccgctggcagaccccgaagtggtgactcggccccgcggtcgaggaggccccgaaagccccccgagcaaccgctacgccggcgactggagcgtttgcgggcgggacttcctgccctgtgggcgggatttcctgtccgggccagactacgaccacgtgacgggcagtgacagcgaggacgaggacgaggaggtcggcgagccgagggtcaccggtgacttcgaagacgacttcgatgcgcccttcaacccgcacctgaatctcaaagacttcgacgccctcatcctggatctggagagagagctctccaagcaaatcaacgtgtgcctctgagccagatgacggggtgggaccccggttagtaaggaccgggcgcccagtggctaaggcggtgccctggtgaccaaggagagccagacctgttgctcaggccgagctcctggttgccagcgagttaccacgggaccagtcgcgtgtatggctgagactcattcccagtttccagggcccggtatttggacactagttgccaagtctggggcctggggattttagggaccagcggttgtgaccatctttcctgagcaccaagggcttccccttttgttgccaaaaaggtagttctcgcgcttgctaggctggcctctcttgcctccccttggccggggcaacaccagttactgtgagcatcaccctggtgtggtgagtcacctctagtcggccctcttgctgctgccaaccaaatcagtattagctttgagcactgcactgtttctccctcccttggacgacacaaagactagcatgaggcactgtttgtggggggcagcccctatcctgggttccagcatggacacaggggtagcctggggcttatagagaaacagctggtttcccctacccttttccggggaagtccccacgattggcctctagtcagcaaatggagataacagagtctggcctttccaatccccatctccttgccccccccttgcccccccccccgaaaaaaattgagcacttaaacccctcccttttggagggggccccctgaagcgtcaggctgggggcagtctggtacggaacatatttattgcctccatgcatgtgtgtgtgtgtctgtgaggactggtgtgcgtggacacgtctgaagcaggcgtgtggggctctttcagggaccacagaggagggagcagtttgcagtgcccagccaccctgaaatccccaataatggtgcctcagtgggccccagagttccagtgggagagtacggttccctcctgtctccctcttcttttccgcacctccatctttgtggataataaataaatatgcacaggttctg

SEQ ID NO: 38126 - DNA, 46898 bp, Homo sapiens
gaaggtggcagagcagcctccccaactaagcctgggtcgccgcctcggtgaagggccgcggggccgagcgcgggaagtggcgtccagtcggtttttggcaggcgagagccagagcgtgagaaccctcccacggcgaggccaagccctgagactggactagcaaggtcgtgagtctctctgtcagctctccgcagcgaaggggcgcggggggcggggaccgtgcccgaccgtgccagctcccgccccggaagcggaagtgcaagcactgcggggtcctgtccagtgtgagcccgacccgagctccagtagttccgcccgctggtcatcgcgccctttcccctgccggtgtcctgctcgccgtccccgccatgctgtctctagactttttggacgatgtgcggcggatgaacaagcggcaggtgagcttgtccgtcctctttttctcctggctcttcttgtcccttcgaggctgctgctgcggggcccggcggaccccagggttctggtgtgagggtctgagctggtctgatacccgggtcattcgctttctttggagactgtggccagaggccgccttgtccgcctcattatttttaaccccgaactgattcagggcctaccgggggcggggcgggaagcggtgtcttcacgttccattcctcccactgaggcaggggagcaaatggaaaccgtacgcgcttgaagtgggagttggggttgcttattgttttagtcattttaaggcggcggactcttgatttctccagtcggagcgactccaggtggtttcgggagagacgaggtttagccggtttctggggcgctcaggaaggcgattggaggccccacaaaaaccgttttgctgctttcagctccttgcaaccctttagtagagctgaaccgtagcgggctgcaccgactttgacttggaccactctgggctccgagttggaacagttacactacttgcccttgcgtccgcttagcactaaggcggcagccctcggaatctatggttttacagtccaatatcagtgccacggggatctggaaatgtaggtctcctgattttgtccttacactttactttgatcttctagatcgtatgccaaatagtactgagaatattgttgtaattatttagtccttagaaaaggttgttctgttttatcttttgcgcctagtgtgtctgtagagcctagttttgctgcatcggactttttttttgttttaaacagtattttactgttatgattatcctgatgtcaccattaaggattttttttccttggacttgcattttttgtacttataactgccacttagggaagtagatacacaacctttccttactccccttcaggccttagctagctcagtgtcaattctgtcagtcagaattgagcattctataaaaattgcgcaaacgttactttatgtctttatgacaacacttcaaatttttacttgtatagtgttgtctttttttaatccatatttggatttctagatgccacagatatttctctgaggaaagtatttattttgagtctgatatttattgtactctatgctaggtacaatgagagaaatgcaaagatagttaagaaagactcggccttcaaggagcctaaatgtgtagaaaaggactaaggcaaaacaataacttttttgagctcttgccatgtgtgaagcactttatacacctgtaaggtaggtaacgttgttcttattaaacatgaagaaaatgagactttgtgagaagcaatacagtatagaagttaagaatatggactctaaagctagatttcagaggtttgaagtagctctgctacttactggctgtgtgactttgagcagattacttaacctgtctgtgcctatgtttacttttattgttgtaaaaagatatgcaacataaaatattccatttcaaccgtttttacgtgtatacttcactgacattagttgcattcactatgttgtgcaaacgtagggtcgctatgaagattaaatgagttaattcatataaagccctcagaagagtgtctggcacatggtgagtattggctgtactgtggtcgatgtcattgttagagagctttagtgatttgcttaagacagaaggtagactgggtgcggtggctcacgcctgtaatcccagcactttgggaggctgaggcaggcggatcacaatgtcaagagattgagaccatcctggccaacatggtgaaaccccctctctactaaaaatacagatactagctgggcctgttggcgcacgcctgtagttccagctactcaggaggctgaggcaggggaatcgcctgggaggtggagattgcagtgagctgagatcgtgccaccgcactccagcctggtgacagagtgagactccgtctcaaaaaaaaaaaaaaaaaaaaaagaaggtatatggcaggatgtggatttgatctcaggtcttactttaaagcctgaacacttggataaagaaggatatgacctgttctagcagtggtaggaaaattttgagaggttccagtcagggcattacgaacagcttcaaggagaaactagcatttaagttggatcttgaaagaccttaatagcttcatctttaacctgggttggttagcattccaataatcaaaagggaaggaattcactcagcacttgcaaacctgctagataggctctaaagcatagagatatataaggtactcttcctgctctaataaaatggacaggaagaaagaacagaaacatgaagatacaatgaataggctactctgccctgtgtttctctaatatggagtgattgtggttcagaattcattgcatctaggacattcagggttagtggaagtttaaatggtaaaattatcctccctggcctcccagaggttgttaggaatggataggagggattggataacatggggtgagggagagttatgaaatgagatctttatctgtacataatatctaggaggaagaattgacaatacatgtagatactgagaatcagacgaaagagggaaactagaattttgttttattcctctaaaagttgctattatttgcataacttctctgcttatacctaattacatattacatatatgttaaatgtctgattgctttgagtttttgttttttttttcttatcagatccacagaggaatactttagtaaatgaactccatccatttaaagtgtaccatttgataagtgttttttttttttttttgagacggagtctcactctgttgcccaggctggagtgcagtagtgcaatcttgactcactgcaagctccacctcccaggttcacgccattctcctgcctcagcctcccaagtagctgggactacaggcacccgccaccacacccggctaattttttgtatttttagtagagacagggtttcaccatggtcttgatctcctgaccttgtgatccgcctgcctcggccttccaaaatgctaggattacaggcgtgagccactgctcccggccggccgataagtttttatacttacgtatactgatcacaatcaagatatagaacgtatatatcacctacaagacccgttctgtcccacctctaatgtgctttttgtcagtatagaggggtatgcattttatataaatggaatcatagagtatgtattctttggagttttaatcagtttttaggctggacgcagtggctcatgcctgtaatccagcactttgggaggccgagcaggtggattgcctgagctcaggagttcaagaccagcctggccaacatggtgaaaccctgtctctactaaaaatacaaaaattagccgagcatggtggtgcgcacctgtaatcccagctactcaggaggctgaggcaggagaattgcttcaacctgggaggcagaggttgcagtgagcccagatcgcaccactgcactccagcctgggcgacagagcaaggctctatctcaaaaaaaaaaaaaaaagaaaaaaaagaaaagagtatgtttcagttttgtaagaaaccataaaacactttcagaatggctgtactgttttgcctttcaccagcaatgaatgagagttcctgttgctccacatcctccccagtatttcatgttgtcagtgtactggattctgggctttgtaatagaggtagaggtatgttgggtttcttagaatttttttttttttaagacaaggtctctctctgttgcccaggctggagtgcagtagcataatcacagcttactgcagccttgaactcctggggctcaggcaatcctcccaccttagcctcctgagtagttgggactatggatgtgtgccaccatgcctggctaatttttgtattttttgtagagatggagtctcgctattctgcccaagctggtctcaaattcctgggctcgagtgatcctcccacctcggatcctcaaactgctggaattacagatgtgagccaccacacccagccaagttgtttaaattaattgatttttaacagtgctgcttgtattctttcttagtctctgggtaccaccctagaatattaggtgatctttaaggtccttttagctaatagtcatatactattttatttgtattcttacctttgtttggagtacggcttcttttttttttttttttttttgagatagagtctcgctctattctgtcacccaggctggaatgcagtgacgtgatctcggctcaccgcaaccaagtagctgggattacaggtgtgcgccaccacgtctggctaatttttgtatttttagtagagatgggggtttcaccatgttggccaggcttgtcttgaactcctgacctcaagtgatctgatcgcctcaggctgctaaagtgctggggttacaggcatgagccactgtgcctggcctttaatataatttattattctagttttttaacagcactgtgtttaacaaccagcttgcagaattgctgaaaatttaggaagcttgttccagcacaccactgattagtatgagaggtttgtttttttttttaatttttgtttgtttgtttgttttgagacagggtctcactctgttgaccaggctggagtacagcggcaggatcttggctccctgcaacctcctccttccgggatcaagtgattctcccacctcagcctctggagtagctgggactacgggccagtgacaccacacctggctaatttttgtgttttttgtagagtctgggtttcaccaggttgcccaggctggttgtgaacccctgagctcagccatctgcccacctcagcctcccaaagagctgggattgaatataggtgtgagtcactgcgcccagccttaatatgagcatttttttttttttttgagatggagtcttgctctgttttgcaggctagagtgcaatggctcgacctcggctcactagaacctccgccccccgggttcaagcgattctcctgcctcagcttcccaagtagctgggactataggtgcgtgtgatcacacgctaattttttgtatttttagtagagacggggtttcactgtgttagccaggatggtcttgatctcctgacctcgtgatctgcccacctcggcctcccaaagatatgtgtgtttttcaatgcacattgaggtggtttttgtgtgcagaaaaacctatttagagttatctttagttctaataattataaaacctaaaattttaaaactaaattctttcttaaacttgtagaatttgtttacaaatcttatcctatttaaagtgtagcaaattttaacaatcacttttttatttgagacagaatcttgctctgtcgcccaggctggagtgtggtggcaccatctaggctcaactgcaacctctgcctcctaggttcacacaattcccctgccacagcctccagagtagctgggattataggcgtgcaccaccactcccggctaatttttgtattttttttagtagagacgaggtttcaccatgttgaccaggctggtctcgaactcctgacctcaagtgatccgcctgccttggcctcccaaagtgttgggattacaggtgtgagccactgcactcagccaacaatcacctttaagagcctatgtttggtttaatttcaaagttaaacatcttaaaataattaaactttataaattaaaaaaatattttaaagaactttgattattcaacaaacatggactacttatataatttttatagatctgagacttcttaagttctcttaaaatgtttcagcactgtatataaataggaaactttctgattcacataatctaaaacaactgattacacattttaaactgaatttttaaggctgacttattacttcactaggccaaattctcttaaattttacaaaagttaaaataccaaatatagctgggtgcagtggctcacgcctgtaatggtggaggccgagatggatgaatcgcttgagcccaggagtttgagaccagtctgggcaacatagcgaaaccccatttctactaaaaatacaaaaattagccaggtgtggtggcacacgcctgtaatcccagctactcaggtggctgaggcacaagaatcacttgaacctggaaggcggaggttgcagtgaatcaagattgtgccactgcactccagcctgggtgacagtgtgagaccctgtctcaaaaaaatgaacagaagaggccaggtgcagtggctcacgcttgtaatcccagcactttgggaggctgaggccggcagatcacttgaggtcaggagttcgaaaccagcctggccaacgtagtgaagccccgtctctactaaaaataaaaaaattagtggggtgtggtggtgtgcacctgtaatcccagctacttgggaggctgaggcagaagaatcgcttgaacccaggagacggtggtcgtagtgagccaagatcacaccactgcactccagtctgggtgacagagcgagactccatctcaaaaaacaaaacaataccaaaaacaaaaacaaatacaaacagagttcttaacataagaatattaacactatgcacgctttcccttaaacattctatttttaattataaatcattctggggataaaaatgatagctaggtgcggtggtgcacctgtagtaccagctgctcagggaggctgaggcaggatgattgcttgagcccaaggagttcaagtctagcctggtcaacatagtgaggccccatctcttaaaacaaaaaaaaaagatatttactcactaataaaataagtatgttatgccaaattatttttatgttacatgtatgtcacatgtaatttttagaattgacttctctgcttgctgagattttttttattggccaggatgtgactagatccctgtctgagccctgaagggactaagcagactcccataaatgtgtgcttagctccccgcaggccacttatattgcttgattgaatttgcatttctctgggttttaattatctgtatgccttcctgcctaaatgtaaagtccttgagacttaataggatccttcattctttttatatcttcctatctcttagtatcacccaactcttaactgttattgcagtgatatcttaacgatttctagatagctttttcttttcttttcattttttttttcctgagataaggtctcgctctgtcacctaggctggagtccagtgatgcgattacagctcactgcagtctcaacctcctgggtccaagctatccccccacctcagcctcccaagtagctgggactacaggtgtacaccaggtaccatagtgagactccatttcatacctggttaatttttgtattttttgtagagttgagatttcgccctgttgcctaggtatctttgatacttttttttttaaacgagttgtcgctctagtgaaacatacagaaacctaggaaatttttcttagatatagacctaataggaataaatgtgaagcaaataggaggtgtatccaacacagaggataaagccactactttttttgattatggaaaagtaatctggtcttatttaggttcaggaaaatctttattactggcagggtatcaacatttattaatgaattgccaagtttcaatgtagaaatattgatatcagtccccattacatacacaagaacatcacaagtaaaattttattgtaaactgcaattaacatcaacaggtatattcttttttttttttttttttttttttttgagacagagcctcactctgtcacccaggctgaagtgcagtggtgccatctcactgcaacctctgcctcctgggttcaagcaattatcttgcctcagtctcctgattaactgggattacaggcgtgtgccaccacgcctggctaattttttgtatttttttagtaaagacggggtttcaccatgttggccaggctggtcttgaactcctgacctcaagtgattcaccagccttggcctcccaaagtgctgggattacagatgtgagccactatgcccggctggtatattcttttgaacagccagaaattattctttattccatgtaactgagcaaaatccagaatatagtaccatagtaacaaagatattttcttgctaccattccttgatattttacatctgttattttttttataacattctctccacaaatgacgtaaagacaaggatgattattcttttccacagccagatggcacaagcctataacagtaaagatgagctccccttaggagaaactgtggttttaactcttcttcagaagggttatcttttctgctcaaggaagaaagtgagctgtagaatccaaacacttaaggtgtctactccttaactggaaaattttgtccaaaaaacatggtttatcagccagggtttagtctgggaagaagaactactatgaatattattgaataatggatttattatagtaataaaacctcagccgggcacggtggttcacgcctataatcccagcactttgggaggccgaggtgggtggatcatgaggccaagagatcgagaccatcctggccaacatggtgaaaccctttctctactaaaaatacaaaaattagctgagcctggtggcgcatgcctgtagtcccagctactcgggaggctgaggcaggagaattgcttgaacctgggaggcagaggtcacagtgagccgagattgcgccactgcactccaggctggcgacagagcaagactccatctcaaaaaaaaaaaaaaaaaaaaaaagtctcacacaattgtaggagaagctggataagtaagagtctaaaagtgggttagagacccagaggaatgtcactaagcagctcttctgaagcactggtttgggtggacagatctaagcttgccatggagtgtgggacaggattccacatccagctgctggagtgagactgcaaaggagagcagatggaaggatccgcgggaggccactgactgtctgtctagtctctgagtcagccagaagagctgaattctgctagcctgtcagtgtctgtcttaccatctctaactacagtgaccttctgcgtaattgcagctactgcactttcaccttccaaatcttgggcagatttctttttggctaactctaacccagaaccatacagggaagggcatttggggaaacctacttctagcttaaccaagttgataaagtacaaaactgttagattctaccctttgtcaacttggcatctatacacacctgtttttatcatgttagctttcgaataaagataaaacaaaagttacgtttctgttataactatcctttgtttctgtaattggtcacatgatcatagctgttttctttctctgctctcagcaagaacctaaattggtcataatttcttgcctgatggggtgacctacccttctttattgaagggttgtcataagaagtcctacctgaattgggttgttggagttttcactgacttttagatgggagtactgaggggccccagagatcccctatattccagttatatttgcttccctcatggtgtagtagcaaccctatttctctctgatggtcaggatcaatcaccctagccaattataaccctgctgcattttggttctctagaatgaggagcccgaagtgaccaagtagcagtcttaacattcagtttaatggaaccattatgtcccttaatggatggattaaaacctttgtgaattaaaacctttaaatcaggccaggtatggtggctcatgcctgtaatcctagtactttgggaggctgaggcaggtggatcacctgaggtcaggagttcgagaccagcctagccaacaaggtgaaaccccgtctccactaaaaataaaaaaatttttggacattgtggcgggcacctgtattcccagctactcagtagaggcaggagaatcgcatgaacccaggaagcagaggttgcagtgagctgagatcgtgccactgcactccagcctgggtgacaagagcaagactccatctcaaaataaataaataaataaaacctttaaatcagcagatttaaaagttgtaaggatgggaagcataattttttttttgatggaatctcgctctcttgcccaggctggagtgcagtggtgcgatctcggctcactgcaacttctgcctcctgggttcaagcggttctcctgcctcagtctcctgagtagctgggactacagatgcacaccaccacgcctggctaatttttgtatttttagtagaggcggggtttcaccatgttgaccaggctagtctcgaactcatgacctcaggtaatccacctgcctcggcctcccaaagtgctgggattacaggtgtgagccactgcgcctggtctggaagcagaaatttcgctaccagatcattaggggtaataatgagaggagtcacacccattcctatcctttaattcctggactagtgaatcctagctatagaaaaaacagcaccaaatgttggttgtcagttcagatcatatacaacatactggagaacattagacattaccccagccccacaaagtgttgccacctagctggtgccataactgcattctgaaaaggccatttctgtcacgcagaagacagtaactgtagcagtaattgaacagggaaaatctaatataagtaactgttaactactaaaagatgctaaactactaaaaagggataaaagaggactcttggctgggctcagtggctcaggcctataatcccagcactttgggaagcctggacaggaggatcacttgaggccaggagttcaagaccagcctgggcaatatagtgagaccccgtctctacaagaaattaaagtattagccaggcgtggtggtactcacctgtagtcctagctactcggtaggctgaggtgggagaatcacttgagcccagaagtttgagcctgcagtgagctatgatcatactactgtactccagcctgggcaacagaatgagaccctttctctttaaaaagagaaaaaaaaaaagactccagaagtagcatatgcagaaaacagctactatcctccaggatgaggaagagtgaacaaagaaagaactaagaaagcaccttaccccaaacccctcccaagcctgagattcagaccttttggtgagggtttggctgccacaggaacatgcaacctatcatggcaataccatttgccagagtactgacctggagctggtttatagtcgtgaattactggaaggttaagaaatttggcagagagtgagtgtgggctggagtcaaccttgatggtccctgaggtgagcactatcaggcttccaacacacagacccactgggtatcaggtggaataaaatcatgttgaaaccaggaagggaagccctctgttgctttgcagtggtctttcaataccctttattaattaaacctaacattaagctagctggcggaggatttgtgtttataggattcagcttgagtaacacaaggaaggagggtggatttggagttgagagacaataaatcgaaaactggcctactattctattatttcaggccagctacttcaaggtgatgagggacatagtaagactagtgaattccatgactgcttgtccactgctgtgttttagttgctataaagtaagtccccctgtcagaagcaatgttgtatgggataccacaatgaggaataaggcattctgtaagatcatggatggtgctttttgacagaaatactaaggacaaggaagaccaatctatatccggagtttactctagcaagaagaaattgctgttcctttcatgattgaaatgatccagtatgatcagcgtgccatcaggattggtggcagtgttggttttttgcggttggcagggtagtcactcagtgttggctagaacctaataggtcttggtgagtggaagtccatgttgctaacctttatcttggctgctgcagccactttggtcatgagtccgttgggtaagacaggtggctggggaaataggctgactgacatccacagaagaagtcatttttgttcacctgattattaagagcttctgctgaggtaattctgtgatgagcacttatatggcacacaattatcttcatattctatatacgtatttggagtgctccatccacatatctcttcctcagacttcttgtctcaactttccagtgatgtcccctccaagtcgctgtccatccagccaaactgctagtcatttttgaatcaatgtaaatctacatctgtagtcatctctccatccaggcaaaatgaacaactgctgtatcgcttgaagctgcccattgggaggatttctcttcctcacaatccttcatgatcaaccctgcatgagattgtaatgctatagctgtctgctttcagttagtgctagagggtttatgttgaaccatcacaaatcaggcctaaagtgttccttagtcagctgtcagagggagctcctcatgaggcagtaaatgcaagatgagagaggaagcagggtagcatcgttaggagccatgggtatctgagtcacttgctcatatttacttgtgtcttcaagacatgcttgagcccagtcttctgtataccacttacacttaatgatggagtacttactgctgtgcatgccctattttttggcttggtgaatctgacagcgtccaggcatccggtgcatgtcagggagttcaggtcacatggtaacttggcccatggtcaagttgttagtctctacaagaactcagtagcaaacaaaaagctgttactcaagaggagaataattctccaaaggacagtatagctttgtccccaatcccaaaggtcttgcctgtcatttacttataaaggactgctgatggctccatatagcatccctatccattacagacacaccagtcatcatgaaatcttctgagtcacgtgggtactactgtaatcccaggtactagtacagctttcaaagcttggacctgttgcggaaccttacttaaaactggcttaaaatgggcttactaaataaatagagtaagttggggagtattcacttttctgcaattttctggaagagttagtgtgtagaattgttagaattgttttccttaaatgtctggtggaatttgccagtgaataccatctgagcctggagttttctttgtgggaagattttaaatccataaattcaaattatatgtaggtctattcaggttgtctatttcttcttgagtgaattttggtagttggtatcaaggaattgacttacttcatcaaagttgtctaatatgtaaagttgtgtaatatattggtataaatatatttataaactgggcactgttgcttgtgtctataatctcagctgctcaggaggctgaggcaggacgattgttgagcccaggagtttgaaaccagcctgggcaacatagcaagacctcatctctaaaatttttttttttttttttgagacggagtttcgcttttgctgcccaggctggagtgcagtggtgcatgcgatcttggctcactgttgcagtgagcctcccgggttcaagtgattctcctgcctcagcctcccgagtagctgggattacgggtgcccgccaccacgcccagctaatttttgtatttttagtagagatggggtttcaccatgttggccaggctggtctcaaactcctgatctcaggtgatccgcctacctcggcctcccaaagtgctgggattacaggtgtgagccactgcgcccagccaaaaatttttgaaaaaattagccgggttattagttgcagaaatgtttagaatttttacattctcatgatgaacttacctccctattattattattattattatcattgttattgagacagactctcgctgtgtctccaggctggagtgcagtggcacgatctcggttcactgccacctccgcctcccgggttcaagcaattctcctgcctcagcctcccaagtagctgggactacagccgcacgccaccacacccagctaatttgtgtatttttagtgaagatggggtttcaccatgttggccaggatggtctcgatctcttgacctgtgatccgcccaccttggcctcccaatgtgctgggattacaggtgtgagccactgtgcccggccaaaatctactttgtatgatattaatgcaaccactccagcttgctttttttttcttcaattttcttttgattaatgtaagcatgatatgtgtttttctctttttttctttcacaatatttgtgtctttatatttaaagtgcattttttgtaggcagcatataattgaacgttgttttatttatccaagtggacaatatttaacttctaagtatagtatttagatcatttacatttttttttcttgaaacggagtcttgctttgttgcccaggctggagtgcagtggcatgatctcaataagtataaaatataagtatctattatgcctgtaatcccagctacttgggaggctgaggcaggagaattgcttgaacccgggaggtggaggttgcagtgagctgggatcatgccattgcactccaccctaggcaacaagagcaaaactccatctcaaaaaaaaaattattattattattgttattgagatggagtcttgctatgttgcccaggctggtctcaaactcataggctcaagtgatcctcccactacagcctcttgctgagtagctgggactataagtgcatgccaccatgcctggctcagtctttttttttttttttttcctatttgctttttcatttgagataatttctattgttatgacttcaagtttgctaaacttttcttctgaggtgcctagtcagctgttattttcacctgtctgctgtttatttcaaacattgttattttttgtctctagaagtttgatttaggtcttggattttttttttttttttttttttgatatggagtttcgctcttgttgcccaggtaggagtacatgcaatggcgtgatgtcggcttactgcaacctctgccttccgggttcaagtgactctgctacctcagcctccctagtagctgggattacaggcatgcgccaccacgcctggctaattttgtatttttagtagagacagagtttctccatgttggtcaggctggtctcaaattcccaacctcaggttatctgcctgcctcggcttcccaaagtgctgggattacaggtgtgagccaccgcgcctggcctctggatattttttctatcatccacatctctacttaatgtgctaacttttcccctacctttttttttttttttttttttttttttttttttttttttttttttttgagacagagtcttcctctgtcacccaggctcgaatgcagtggtgtgatctcggctcactgcaacctccacctcctgggttcaagcaattctcctgcctcagcctcctgattagctaggactacaggcatgcgccaccatgcccggctaatttttgtatttttagtagagatgggattttaccatgttggccaggccagtctagaactcctgaccatgtgatctgcccgccttggcctcctaaagttctgggattacaggcataagccacctcgcccagcaaatatccctttctactaatcctataatttctgccatttctgggtctgtttctgtttattgatttttctcattataggtcatattttcttgcctctttgcatgtctggtagttttttattggttgccagactttgtgaattttacctttttgggtgctggatatgtttggatttgcataaatattcttgagctttattctgggttacaggcaagttagttggaaacagtttggtcttctcaagctcttgtgaagctttgttagatggatccagagcggcctttagtctgtggctaattttgcactacaagtgagtaatacctttctgagtactctaatccaaagccccgtgaagatttccactctgtctggtggaaacaaactattcttacgccataagagctgtgagaattgttccatccgctgcttttagatggttgtttttccatcctcaggagtcccctcacatgcatgcactgatcattgcttttgcctccctgaactcccagttcttttttttgtgtgtgtgtgtctttgtttttttctttttccgtggagaacggggatcttgctgtattgcccaggcaggtcttgaactcctgggctcaagctatcctcctgcctctgcctccctaagagctgggattacaggcatgagccaccgtgcctggctgaactccccagttctttatcctcaagtcagggagactgctaggctctgtctgcatttctcctttgccctgtggtctggaaattctccgatctataagttgaggcagttgtaggtctcaccttctttgtttcccctttctaagtaatcacagtccttactacctgaacacagtcatatagccaatgtccgaaaacccttgtttcatatattttgtccagtgttttagttatttcaggcaggaaggtaaatttggtctctttaactcattttggctagaacagcatattttgttttttttgtttcctggtttttttttttttttttttggagacaagagtcttgctctgttgcccaggctggagtgcagtggtgtgatctcagctcactgcaacctctgcctcccaggttcaagtcatcctcccacctcaacctcccgagcagctgggaccacaggcacgtgccaccacgcctggctaaattttgtatttttggtagagatggggtttcgccatgttggccaggctggtctcaaactcctggcctcaagtgatctgccctccttggcctcgcaaagtgctgggagtataggcatgagccaccactcctggccaggacagcatattttggaaattcacctatgttgcatgtgtcaatagttaattcctttgtattcctgagtagtattccattttgtggaaatactacgatttatgtacgggttgagtatctgttatctgaaatgcttggggccagaagtattttggactttttttttattttggaatacttctatttgcattttaccggttgaacatcccaaatctgaaatatccaaaatccaaaatgttccagtgagcctgaattcatctgttgatgggcatttgagttatttccggtttgaggctattatgagggaagctgctgtacatgtgtttgtatatgttaaatgtgttttcacttgtcagattttaaaagatttaacagatttttaaagtgaaaattgttttaatgatggtatgcttatttagactattaggaatttaaaaaattatcatttaagattcattccaggtcctgcattgattttattgggtcacaataatagtgtccatttgaagatatttcaattttttcagcaccgtcaatttcacttctagctgctatcagtataccttctgtaatatctagcttctgatttctcctttcatgagttagaaagcaggagaattgtgattatggattaatgagtcccttaatttgaggtcttaagataaatggaatttaagacttaggccaactgctattttgtagctctaagacacatttttgcttctgatttctatgaacatatcttatatgttgaacttcaaatatctcttacaagaataggaagcacaatggtgtatttgatcattgtgatcagtaaatacacaggatgtagcttctagatggtagcccattaaattatagtatttaaaattattatcaacttttatcttgctgaattttctgtgttaggtttttcttaatttcttattatatattacttagagtggattataaattgtcttgtggcttattctagtcacaggagtttgggggaaggctctacacaatacttcctaaaaagaaaaaaaagaatagtaaacacaaatccctatatcacagctgctgagagatattatatagaactttgatatcattcttttctagtttcaccttgagcattgaagaaatattgttctggtcatttcttagaaaaaataataaggctattcaattctgtggttattattctacatatgttgcaatgtctttattaatagttagcttgatgtggtcagatatgaggttaggtagctgccaccttatttctgccaatacagaaagaggcaacactttttttccaattatatacattcctaagcattcagacatagtgataaagaaagtaggggctagggaggcaatatgtttgacgtttgagtaaagactgttggcaggaaaagagagggtaaaaagaaagggagaagagtatgacacttttcaatcttttgctcagatacaatgtttgttttagcaaatagtgtgcttctgtctaggttttggcttgcagattgacttagcagtatacaaataggtaccttttaaggaacataccagttatacataatcaggaactttaacctctttctctaataaaaatgaggaagatgatcttgatgattagctacatttcacaataataattccataataaaagtattatatgtctgagaaaaaggagaaggataattatggctgggatagtgacctttcttgcaagaacataggaaattatatattttaacttgttcatttttattgtattattattttttgagacaagatctcacactgttacccatgctagaatgcagtggtgctgtcacagctcactacagcctcaacctcctgggctcaagcaatcctcctacctcagcttcttaagtagttgggactacaggtgtgtgccaccacactcagctaattaattttttttttttaagagacagggtcttgctatgttgccttggctggcacttttttttttcttaatttttaaattttgttattttttttttagagatagggatctcactatgttgcccaggctgaactcgaactcctgggctcaagcagtcctcccaccttgacctcccaaagtgctgggattataggcataagccattgcacccggtgggcatttttcttttaaatagcagttatcttattaaatgtctaattaggtaacttctgcaactctataaccgagcccttttgaaaatggaaattttttttccccaacaaaatagacgtgaactgtgggtttttgttttgttttgtttttagtttttatttacttcagtgtgaatttttgttttgctgccaaaatcttaatgtgtttgatattgggatattgccataaaccctgctaagagtatatgtaacatagggtacatgcaagtattaccttttcaaaatcacacccattctgaatcctggaacacatctgacccccaagggttttgagtaagggattatggagctatatacattgtagaatcctacaaccccttcctcagaggttctgaattagggcccagaatctattgtcctaaccagtactgtaggtgatatttttagtgcagaaagttggaaatttgagtcttaactgaattcctcactgtttatcttctggttgacataattgtgtcttagaagctagttttcctacttctatcatgtcccactccacgtcttcaattcagccttcagaataagaagacccattttgtcttttaaaaagccaccatcttgaaaacatagaatttaggaggccagagttctaatagtgctactctgccagccagtagacaagcagccatgagcatgtcgcttagcttctctgtgcctcagtttccttacctgtaaatgtgagtgtcaaagtaggtttcagattatccatgtgctcacatcactctattactgaaagaacagcaaatatttctaattgtctcggcgaaaatgttcatatttccttttgtggaaattgattaattacattgattgagtacaccgtgcttcattggaatgctagaagaatagtgttctggccattagcgtggacttaaaaaaataaaccaaaacagtttagttttgaacaggtgatacttgcatatagtaaaaactgtaaaaacatgaagtatgtatatcagaaaatatttttcttccaccttgactcctggttccttttctccagtttcttgtctgtcttttcagagattaactgtgcatttataagaatatgaaacttgatcgcttctcggccttttggctaagatcaagtgtgaagaatatgaaacttgaaatgtttttaaaaagtatgcaggaaaaacaggttaattgtagggagaaaatagaaaatggtacaagagagctggattcctcatcacaattgtatttattttttgagacacagtcttgctctggcacctgggctagaatgcagtggggcaatcatagctcactgcagcctttacgtcctgggttcaagtgattctcctgcctcagcctccaaggagctgggactacaggcatgcaccaccacacccagctaatttttctttttttttttttgagacggagtttcgcccttgttgcccaggctggagtgcaatggtgcgatctcggcccactgcaacctccgcctcccaggttcaagcgattctcccacctcagcctcccgagtatctgagattacaggcatgtgccaccaagcccagctaattttgtatttttagtagacatgggggtttctccatgttgggcaggctagtctcgaactcccaacctcaggtgatctgctcgccttggcctcccaaagtgctgggattacatgcgtgagccaccgagcccagcctctggatatttttttttaatcatccgcatctctatttagtgtgctaaattttcctctaccttctttttttttttttttttttttttttttttagatggagtcttgctgtgtcgcccaggctggaatgcaatggtgcgatctcagctcactgcaacctctacctcccgggttcaagcaattctcctgcctcagcctcccgagtagctggaattacaggcacacgccactgcgcctggctaatttttgtatttttagtagagatggggtttcaccatgttggccaggctggtcttaaactcctgacctcgtgatccgcctgcctcggcctctcaaagtgctgggattacaggcgtgagccactgcactcggcctttttttgtatttttttttgtagagataaaggtcttgctttctggtctcgaactcctaggctcaagtgatcctcccacctcagcctcccaaagtgttgggattacaggcatgagtctctgtgcctagcccctcattgtacattttgaacatcatgcattaacaccctagtatgaaagtaaacaaacagtttttagagtggttggggtaaacaccagaatgaatagctagaagagatgaaaatggttgatgtaggtggcctgccatggctaggatattgcttttttttacatattcttgtatgtatgtgtgtatactgttttgattaaaaataacaattgatttaaaaagggaagtagaaaatgtagatgatcaaaatgaaataaataagaattgcctagtattacacccccaaatataacaactaacatttattttattttcttcctttttttttttgagagagtcttgctcagttgcccaggctggagtgcagtggtgcgatctcagcttactgcaacccccgcctcctgggttcaagtgattcttgtgcttcagccttttgagtagctgggattacaggcatgtcccaccacacccagctaatttttgtgtttttagtagagatggggtttcgccatgttggccaggctggtctcctacttctggcctcaagtgatccacccacctcagcctcccaaattgctgggattacagatgtgagccactgcacctggcttcttccatattttctatgcattttttggaatttttcagaaaaaattgaaaaaacagtacagggaacacctgtaatctgtcacacagatccaacaattattagcattttggccatatttgttctatgtatacttatgtgtgtgtgcatatatagaattttcttttgctgaatcacttgaaaatgagttgcagatatgagaattcacccctaactacaactactagctaactactactaatatgcatctcctgtgataaggatagtattccacataaccacaacaccattatcacataatttaagaaaattagaggccgggtacagtggctcacatctgtcatcccagcactttgggacgtcaaggcgggtggattgcttgaggccaggagtttgagaccagtctggccagcatggtgaaaccccgtctctactaaaaatacaaaaattggccgggcgtgatgatgcatgcccattgtaatcccagctacttgggaggctatggcacgagaatcacttgaacttgggaggtagaggttgcagtgagctgagatcatgtcactgcactccagcctgtgtgatagagcaagaccctgtctcaaaaaaaaaaaagaagagaaaaaaagaaaacatgaatttcctaatgtcatttaatattcaaatcatattttgagtttccccagttcaccccaaaatattcagattttttcttatgcttttttttttttgaaccaagatccagccaaagtttgtgcattattagaactgaatgagaagaaaaaaacaacaaagaaaccaaagtttgtgcgttacatttggttgttatatctctttagtactttttaatctagaacagtcttccacctttttttccatgacattgaatgacattggatttttgaagagactaggacagttgtgtagaatgtccacaagcaaatattaacaaaagtgaccaggcatggtggctcatacctgtaatcccagccctttgggaggctgaagtaggcggattgcttgagcccaggagttcaagatcagcctgggcaatatggcgaaacctcatccctacaaaacatacaaaaattaccacgtctggctactcgggaggctgaagtgggaggattgcttgagcccaggagttggaggctgcagtgagctgtgattgtgccactgcactccagcctgggcaacagagtaagaccttttgaaacttctgttttttcactttatattactaatattttgttagatccacagtttcagtcctgtgtttaagtttcttcatagttggaccttaatatatgctttttcagatttctcccagtactttccagtaccagctttttccttgaactatttgccatggtgtctagtcatcctctctatactttttccagccttggcccaaaacagttagctcacattatttatcttatctgattttgtaatattttttgcctttttccacgtgttctgaattttctttatttgaaattgaaatgccgtctggtgttttatctgtttattcaagtcacagaattttagagtttgttggagtactggaaatttagtaagaaggctgaccttcaagtcttgactatgtgactgataagcttaggacttggtgaagtctcctcttttcgagacagtttccttaactgtaaaatgagaaggtagagttaaatgtcattaactattcccatgattatcaagggataagtatagtagaaaagtaatagagggccgggtgtggtgactcacgcctgtaatcccagccctttaggaggtggaggtgggcagatcatttgaggtcaagagttcgagaccagcctgatcaacatggtgaaacccagtttctactaaaaattcaaaaaaattagctgggcgtgatgacgcatgcctgtagtcccagcgactcgggaggctgaggcaggagaatttcttgaacccaggagacagaggttgcagtgagctgagatggcaccactgtactccagcctgggtgactgagcaagagcgaggctccatctcaaaaaaaaaaaaaaaaagaaaaagaaaaagtaatagaggagttcagaagcagagacagattactcttggctggtaagtagcatgagtgataaatttaagctgaatgattatggagcccaaatgaaataacttgtgtgaaatgttcttaaaataatatggtgttatataaatgtaactgatgttttaccaaacaaaatggagcagggtgctttgggtgaaagaaggggggcctgttttgatctgctgatggcataattattataatgtattaaagaatgtctcagaactgtagttgtcctaatagtactgcttgaaactttcaaattgttactgctttcagttgctttccgaagtggggataatggtggatctgatctcttctgttttgttcttgcagctctattatcaagtcctaaattttggaatgattgtctcatcggcactaatgatctggaaggggttaatggtaataactggaagtgaaagtccgattgtagtggtgctcaggtaacagtttttcctttcaaggcatggaattgcatggcattacttgggagaaaaattgagatatgaaataactggcatatcattctcttagaaactactcttttccagaaaagggcctggaagaaaattagtcactacttatcagttgtaagaaattctcaggctgggcacggtggcttatgcctgtaatcccaccaatttgggatgctgaggccggtggattacttgagctatggaatttgagactagcttgggcaacgtggtgaaaccctgtctccacaaaaaatacaaaaattagcgggtgtggtggcatggacctgtagtctcagctactcgggaggctgaggtgggaggatcacctaagccctagaggttgaggcctgcagtgagttgtgattgcaccactgcacttcagcctgggtgacagagcgagaccctgtctccaaaaaaaaaaaaaaaaagagagaaaagaaattcttactttgttaggcatttccattcagaactccaaagggctcatgacctttctacaaaaaagttaccatgttaaggtttgtttttgtcacatcccttaataaagtgtctcgttgtactttattttcctgaaattcttctgtctttttatattcctcattttgatacaccaggcctgatatttagttgttagttcattagatgttatagtacttccacaaattaagagtttttctgtagcatgttctcaatgtcaggatagaatcatcactaattatttccaagtttcctgctgacctttaaatatcacttctaaactagactccaggaattttgaaggcattaataccatctcttatggtgacaaatagtactgaattttttttctccactctgcttccttccctatctttgcactcatactcttagtgaatattttttttaaagatggggtctcgctctgttacccaggatagagtgcagtggcgccgtcataactcactgcagactccacctaccggtctcaagggatccttccattttagcctcctgagcaggtgggactgcaggcctgccccaccatgcctggttaattttttaatttttttgtagagacggtgtattagtccattttcatgctgctgataaagacgtacccaagactgggcaatttacgaaagaaagaggtttactggacttacagttccacgtgactggggaggccccacaatcatggcagaaggtgaaaggcaggtctcacatggcggcagacaagagaagagagcttttgcaggggaactcccctttttaaaaccatcagatctcgtgagacttattcactgttactagaacagcacaggaaaaacctgccccatgattcagttacctcctgctgggtccctcccaaaacacgtgggaattcaagatgagatttgggtggggacacagccaaaccgtagcagataggatctcactgtgttgcccagtctggtcttgaactcctgggttcaaggatcctcccaccttggcctcccaacatgctgggattacaagcatgagccaccatgcgcaaccactcttagtgattttaaaacctaatttagtaactcatttttagagaattaccacttggttgtttgactgaaacattataggctgggtgtggtggctcacacctgtaatcccagcactttggaaggccaaggcgggcagatcacttgaggctaggagttcgagaccagcctggccagcatgttgaaaccccatctctactaaaaatacaaaaattagctgggcgtggtggcaggcgcctgtagtcccagctactcaggaggctgaggcaggagaattgcttgaacctaggaggcggagattgcagtgagcggagatcgctccattgcactccagcctgggtgacaattgaaattttgtctcaaaaaaaaaaaaaaaaagaaagaaaagaaacattacagttttgtcatattttgggcttaattttgtaagcccagatcttttctggagataatggagtgcatatttaaaataaatggaattattaatattatctagaatctaaataatagtgcattaacattatctagaacctaagtaatagtacttagattactcttttttaaccaaattatcgagatatgattgacatacaaaaagctgtacatatttaatgtatacaacttgatcaatttgcaggtaagtatattcctgtgaaaccatcatcacaatcaagcaagtgaatatattcatcactttcaaaagtttcttccctttctatttttttgtgataagaacatttaacacagggcctccctccatcgcccagactggagtgtgccatcacacttggctaattttttttttacagagactgagtcttgaactcctgatctcaagtgatcctcccccctcaacctcccaagtgctgggatgataggcttgaaccatcgtgcctggcccccagtttcttttcttttcttttttttcttttcttcttcttcttttttttttttttttgagacagagtctcactgtattgcccaggctggagtgcaatggcgcaatctcagcccattcaacctccacctcctgggttcaagtgattcttctgcgtcagcctcctgagtagctgggattacaggcgtgcgccaccatgctcacctaatttttgtatttttagttgagactgggtttcactgtgttgatcaggctggtcacgaactcctgacctcaggtcacctgcccacctcggcctcccgaagtgctggaattacaggtgtgagccaccgcacctggctgagattttttaaaagtccctcaggtcattccaatgtgcagcaaaatttgagacccactgccatatccctttacatagagggaagagagtctttaaacaaaagtgtttggagtttgtacttattcctgcgttgaactttatttcttgtctttctattcttacttaagctgttgttatagaaaaccggagcttgagtttctgaaaaagactgatgggctacttctttatagataaaaaggggttcataaattagtgcaaatatcttaggaccttttcagcacttggcgtaggatggaagaggtaagaggtaagaagatactctgtagaagttagtcttacttgttaccatggaattgaatcttttcctggcttcggaaattcttaggcaaaaatctctgcttattccttggttttctttttttctctttttaaaataagtaaattgataacacaagctttatctctgtagctggctgttccttgacttgatgagccatttttccttctaaatgagttgaacatataaggtcatcttggctgttatctttataaatggcagaggaagatgatccagttctcatttgcatatctgaatatgtttagtgttttcagatgaagtgagaataagggcattgttttaaagttcattcttttatattctgtttgtcatttgaaattttaaaaggttaaggaattagtaacactgaccttttcaagatttaagcttctttgactagtgatacttgaaatggaactagttagtgaaggttaataactaaaaaaaaatcctttggcgtaactttttagtctgaggaaaccatattttgagaacaatacacatttctgttgatatagttgttagggtattgagtatactcccaaagtgatattttttattttgttgaatatctaattttgaaagtacatttaatctcatactttctttttgctgttatattcttctttcccttccagtggcagcatggaacctgcatttcatagaggagatcttctctttctaacaaatcgagttgaagatcccatacgagtgggagaaattgttgtttttaggatagaaggaagagagattcctatagttcaccgagtcttgaagattcatgaaaagtatgtgcaaagtatagcatctttgtttctaagtgcttttgtttaagtgtttgtggtatttagttttgatagcctaaagattgtaaaacagtgaggaacctctaggccttcttccagtccatttttatgaatgctggaaagtttagtgaacattttgaaaactgtaaataattatttattagttcatttctttccctgaaggtttttccagaggtttttctttgttcccttttacttcccaacctgtcagtgactctgtatataattccaaaaaactatgacataaagatagatcctaaatagaatcttctggttgggcacagtggctcacgcctacaatcccagtactttgggaggccaaggtgagagaatggcttgagctcaggagtttgaggtcagcctgggcaacatggtgagactccttctctattaaaacaaaacaaaaccaaaaaaggccaggcatggtagctcacgcctgtaatcccagcactttgggaggccgaggtgggtggatcacctgaggtcaggagttcgagaccagcctggctaacatcgtgaaaccctgtctctactaaaatataaaaattagccaggtgtggtggtgggcgcctgtaatcccagctacttgggaggctgaggcaggcgaattgcatgaacctgggaggtggaggttgcagtgagccaagattgcagcactgcactccagcctgggcgacagagccagactccatctcaaaaaataaataaataaataaataattagctgggcgtagtggcatgtgcctgtagtcccagctaattggaggactgaggtgggaggattgtgtgagcccaggagtttgaggctgcagtgagtcgtgtttgtgccactgcactccagcctgggcgaccgagtgagaccctgtctcaaaaaagaaaaaagaaagaaatgaaagaaaagggaggcatcctgtatgacacacagacgagaagtgaaagagtaggcatgatttcggttctttttttgtttgttttttgagacagtttccctctgttacccaggctggaatgcagtggcgctatctcggctcactgcaacctccacctcccaggctcaagtgattctcatgcctcagccttctgagtagctgggattacaggcatgtgccaccatgcccagctaatttttgtatttttagtagagacagggtttcaccttgttggctaggctagtctcgaacccctggcctcaagtgatccgcctgccttggcctcccaaagtgctgggattacaggcatgagccattgcacctggtggatttcagttcttgaaagaagaggaaactgtcaaccattgctttttgaaattcctataaacattctagtttagaagagttctttcttcattggtgaaataaagatatgactgcttatttttttttaataaaatcagatatcagtatgtatgtggaaatactataatttaaagtgacattatattattgactgggaaggaataacttaaatttttagaaattgtttggggccgggagcagtggctcatgcctgtaatctcagcactttgggaggctgaggcgggcagatcacctgagctcaggagttcaagaccagccttgccaacatggcaaaacccatctctactagaagtataaaaattagccaggcgtggtggtgggcacctgtaactccagctactcaggaggctaaggcaggagaatcacttgaacctgggaggctaaggttgcagtgagctgagatcacgccactgcattccagcctgaatgacagagtgagactccatctcaaaaaaaaaaaaaaaaaaaaaaagaaatttattttggaattacagaggtttattcagcatggatagtgttttccagattctgaaagtggatttgtgttgttcattctcagcaatgcctgttgtgaacaaagctgaaccaactttcccctaaatatatcagagagaatcaaattaagctcaggccttgtttaagctggaggaaaatttctccattttaatttgtgatcctttgaaattgagtgagtttggctgggtgtggtgactcatgcctgtaatcccagccctttgggaggctgaggcgggtggagtgcttgagcgcaggagctctagaccagcctgggcgtctagaccagatggtgaaaccctgtctctacaaataaaaaaaaaaaaaaaaaatgagtcaggcacggtggtgtgcacttgtagtcccagctgctcaagaggctgaggtaggaggatcacttgagcccaggaggttgaggctgcagtgagccgagatcatgccactttattctatcctgggcaacagagtgagactgtatctcaaaaaaagaaaaaagaaaagaaaaagaaattgaatgagtcatagacttaagtttaaaactgcttctgggcagattcatagacagagaatatattaattggaaaatccttaaatttttaaaataattttgtacagaattctgatgattttaaatatggtacttgtaatctggggtttttggtgatttatttcagactcttgagataccttcaacttgcaggcctgtgtagataacagaccctgttaatattcagaaattttcaattttctttttttcttttggggagactgaaatatctggtcaggattaccatttgggttttttttgttttttgttttttcttttgagacggagtctcgctctttcgcccaggctggagttcatggtgcgagtttggctcactgcaacctctgccttctgggttcaagcaattctcctgcctcagcctcccaagtagctgggactacaggcgcctgccaccacgcccagctaatttttgtatttttagtagaggcagggtttcaccatgttggccagactggtcttgaactccggacctcaaatgattcacccacctctgcctcccaaagtgcagagattacaggcatgacccactgcacccagccccatttggtttaatagtattaacattgttcttaaatatggggacaaataatattcaaaatgtatgtatttagtaggttcatcctataggaggtatattagtctgttctcatgctgctaataaagacatacctgagactgggtaatttataaaggaaagaggtttaatggactcacagttccacatggctggggaggcctcacaatcagaaggcaaagaagaagcaaatccatgttgtacatgtcggcaggcaagaggtcatgtgcaggggatctcccatttataaaaccattggatctcatgagacttattcactatcatgagaacagcttgggaaagacctgcccccatgactcaattacctcccactgggtacctcccatgacctgtggtaattatgggaactacagttcaagatgagatttgggtagggaccacagccaaaccatatcaggagatattataattggatgatactgaacactggcatgtgattaagtatttggaaagagaaattttaccattgggtgacttaatccttagctttgcttttcccatgcagatggatacattattctgtacccatttagcttttggggtcttatttttttctcatctgtaaagtggttatttccttcttcctaatttcacagtattgtgatgggtgaattaaattctaaactctttgatctccctagaagtagataatattaaatatttggtccttgttccagcaagggaaaaatcctatgtaaatatgccttcactcagtattttgagcctatgacttgtgaaatgctggagtaggacttaataggtctagtaagatcaggtgcggtggctcaggcctgttatcccagcactttgggaggccgaggagggcggatcacctgaggtcaggagttccagaccagcctgaccaacatggtgaaaccctgtctctactaataatacaaaaattaactgggcatggtggtgcacgcctttaatcccagctgctcgggaggctgaggttgcagtgagccaagatcgcgtcattgcactccagcctgggtgacaagtgcgaaactccgtctcaaaaaaaaaaaataggtctaataagagccggttgccaccagagaatatttgtttcactaagtagatgaagaatatctatgctttttcaaaaaaactatagtgataactcctgattacatcccagaaggggaaattgggtgtgttagttagtttgtttgtttgtttgtttgtttgtttgtttgtttgttttgccagcaaatcaagtctttggtaatagtccagatctctctagcaccctttcctttttctggggagttccccttttcctggatttttatctcctcatatctgatttgccttttctgcatgtgtggagttgatattgttttctgggttgaattcagttttccttcctgctgttcctgactttcactcttgcagtgagcccctcctagcacctgtcctcttttacccttcagaatttttccttttttcacttactgaattgtcagctacagattatttttctctgtatatatttgcattttttctaactggcatcttatttttaatgtgactgtttgcacttaaccatctttggtgtttgcaacacctcccaatttagtttcctctgcagatttaacatctagtgagccagtttccggcttagaatctaagtggatattagcccatagaaacctgaagctaattttcttctttctactacagtggtcaatccaaatgcactttgaattaattttcagctagtctttatcaactgtaaaatatactttgctttcaattaaattttaaaattactagaaacttcatggttctttagtagaattaagctaataattttctgatcaacaaaatgctgttcctggctgggcacggtggctcacgcctgtaatcctagcactttgggaggccgaggtgggcagatcatgaggtcaggagttccagaccagcctggccaacatggtgaaaccctgtctctactaaaaatacaaaaaaaatagctgggtgtggtggcgggcgcttgtaatcctagctacttgggaggctgaggcaggagaatcgcttgaacccaggaagcagaggttgcagtgagccgagatcatgccattgcactccagcctgggcgacagtgtgagactctgtctcaaaacaaaacaaaacaaaacaaaaaaacaaaatactgttcctgtaaaccctggcatatctgaagaattgaggtatttcttctttgaaagctaacattttttcctaatataaaagtaattcatgtttgttagagaaaaaagaagataaaggtaatctaaagaaagccatagatagccactgtttatccattggtctgtttatccattggtctgtattattttagatcttgtctaataccttttttttgcttttattttctgaatttggggagtttctgacatgtacagaagggtatgaggaacccccatgtatctatcatccctgtcccagtgatgattaatatatagccaattctgctccatctctactcccacctcttccccttcctgttattattatttgttattcaagacagtgtctcactctgtctccaaggctagagtgcagtgacgcaatcacagctcaccgcagcctcaatctccctgggcttaggtgatcctcttaactcagctggaaccacaggcgcacaccatcatgcttggctaatttttttgtattttttgctttgccatgttgcccaggttggtcttgaactcctgggctcaagtgatccacccacccaccttggcctcttaaaatgctaggattacaggagtgagccactgcccctggccaaacaattctttagtatcatcaagtttttgatatttgttcaaatccccaattgtgtcataactttcttaaacaatttgtttgaatctggacccagataaagttctcagctgcaattagttgatgtggctttatactctcttgtttttttgtttttttcgttttgggatggagtctcgctctgtcgcccaggcttgagtgcagtggcgtgatctcggctcactgcaacctccgcctcctgggttcaagtgattctcctgcctcagcctcctgagtagctgggactacaggcacccaccaccatgcccagcttatttttgtatttttagtaaagacagggtttcgccatgttggccaggctggtctcgaacttctgacctcaggtgatccgcccaccttggcctcccaaagtgctgggattacaggcgtgagccaccgcgcctggccgtctcttgtttaatctgtaggttacttccctaactttctttgttccttgcaagtcattagttggagaaactgggttattctgtagtttcccatagtctgtatcttgccaattatatcctgtgagatagtttattgtgttcctttgttctttgtgtttccagaaaattggtagtgtgtatttattttaatataaaaatgagattgtactgtacatgctattttgtattcttttcttcacttaataaaatttgtacaatcttgtcattcttctataccattattttaatgtttacataatatttgagctccttaatattggatctttagtttgtttttagtcgtttatgaacaacacagctattaacattcttgtagctccataaataattatttcgacactagaatggtgaaaagataccccagtgccacaaacatgtttggttaacaagaacagattttgtgctttaaatgccatgaaggtatttgatgacttgggtttcctttactcttttaaggcaaaatgggcatatcaagtttttgaccaaaggagataataatgcggttgatgaccgaggcctctataaacaaggacaacattggctagagaaaaaagatgttgtggggagagccagggggtaagtatagaggggagcatctcaaactttttatatcacttgaagtgtggccctctcaatcatattatttgatcatacacagttgaatatagagatttggttctggttccaccaaatcacccttgtgtcctttgaaaattttgcttcttaaaaagtgtctaaaatttcaggtatactactccaaaggtgaggaactgggtggggtgcaataaaagaatagaatactagtgatgagatggtgaattggatgtgacaattttaaaaaatgtgttcacttatttggttcactcaagaaatagtgggcaccttccatgtgctcttacgtccacactatgctagcctctgggggtctagagcactattaatcctgcctcatgaaagttacatttctttttttttttttcttttttttgagatggagtcttgctctgtcacccaggctggagtgcaatagcgcgatctcagctcactgcagcctccgcctcctgagttcaagcgattctcctgcctcagcctcccgagtagctgggattacaggcgcccgccaccatgcccggctaattttttttttttttagtagagatggcgttatatttatatttcttaagaagtactaagtcaataactcaaaagtgttcatccaaattagttttatcatgttaatttaatccataatatttctagtcttgaaattgatgaggttgaatgaaattaaaaagttatattaagcctgtttgtttcagattttatcaggagaacagttcagtggaggacaggaattgtaagttgttggtattaaggaagtatggcattgttgctcccttaatgtaattaatagtattaacaataactcacgtttattagggcttattgtgtaccagagactcattctaagtgctttacaagtattaccacattttaacctcagaacaaccctaatattcccattctacagatgaggaaacataaatgagttaggttatgtatctaagattatactgatggtcgtaagtggctggctgcatagtccaccttaccatcatacaaaaattactagcgtaacatttctgaaatggatagttgctaattctcactagttagatgccacatggcacttttgccactgtcagaacctctgctccttttgacctagaacagactgtatggatacagagttattacaccagtaagcaggtctgagatacgcagttcccatagagaaggaagtatgagttgctaagtgaaagcttcctcagttacagcacgagagatgctcagtttggggccaaagagatcagatcagaacaggtatcattgtgctttgcctgctgcagagctgtggttgttattgttgttttaatatgtccccgctttaaggaacttttcctttgatggagctaaaaatacttttataatccaaattaggtcatcagtgcttctgagaaatactagtccccatcttcctcagttcccaagatgctgctaatgtgattatttaaactctccaatctctttgagtctttgtttttcctcaaattataaatgtacagattcatgtagaaacataagaaaatatcaataatcaaaaagcaaagtcacttcttgtctcctttttcttgatctccataaatatttactattaactttttggtttatattagcctttgtgtgtagagataaaaatattaatgagtacttttttttgccttttttttttttggagacagtcttgctctgtcacccaggctagagtgtgggtggcatgatctcagctcactgcaacctctgcctcctgggcttaaaagattcttgtgcctcagcctcccgagtagctgggattacaggtgtgtgtcaccacacccagctaattttttgtatttttagtagagatggggtctcgatatgttgcccaggctggtctcaaactcccagcttcaaatgatccacctgtcttggcctctcaaagtgctgagattacaggcatgagccacggcacccagccctagtatgtacatatttatacaaacataaaacgcattttgtgtgtgaaaggagaatggtcacactatcttataaccccttttttacccaaaaaattactagcgtatttacaaatcaatatatttatcatcatatcatcattttcaaagctgtatgctattccactgtatggaaagaccatatactctatcctatggatagaacatatagattttattcagtcagtctcctgttgttaggtattctgattgtttccagcttttttattgcgaacaatgttatgataaatatccttattatgtatatctcagcatttctgcccaatcattcttcagagtaaattcctagaagtggaattactgggtgaagcatactcatatgttaaggcttttgacaaattttgccaagcctgtttcatttatactcctgctagtacaactgagtgttcctttatctgggccttcttttttttttcttttcttttttttgaggcagagtcttgctcttttgcccaggctggagagtcttgctctgttgcccaggctggagtgcagtggagcaatctcagcttattgcaacctctgcctctcaggttcaaatgattctcatgtctcagccacccaagtagttgggattacaggtgtgtgccacaattcctggctaattttttatatttttagtagagatgggttttcgccatgttggccaggctggtctggaacccctggcttcaagtgacctgcctaccatggtctcctaaagtgctgggaccacaggcatgagccaccacatctggcctgggtcttgattcttaagtgtttattacagctctgtctgctcactctggcccattggttgggtaaaagatgcatcatcctacgaaaggttaggggagctttcactcaacttgtcttctggacaatttttgaaaaaattctgggctgggtgcggtggctaacgcctgcaatcccagcactttgggcggctgaggcgggcggatcacaaggtcaggagatcgagaccatcctggctaacacagtgaaactccgtctctactaaaaatacaaaaaaattagctgggcgtggtggcgggtgcctgtagtcccagtgactctggaggctgaggcaggagaatggcatgaacccgggaggtggagcttgcagtgagccgagatcacgccactgcactccagcctgagtgacagagcggcactctgtctaaaaaaaaaaaaaaaagaaaaagaaaagaaaaaattccacactatttaatgctatttttaaaatcccaacatagaaactatagaccattttgagctgttacttaaaaaaatgtaatagtctagtactctctgcattaaggaagtttctgtagaaaaaaaaaacctaagacatgaacagcagaagcacagaatcttaactatataaatttactttccattgattgtacctctactgagcttgacacgtaatggaacataacactttcttttgtggaaattgtgtttataaaacactaaactggtatttcaaagtcaggatgtacacaaatcttaagaatagagcttttccacaggcaagtctgttactgtagtacatacgtcttcatgcttttttttttcttgagacagagtctcactctatcacccaggctggagtgcagtggcagaatcatggctcactgcaacctccacctcccaggcccaagcaatcctcccacctcagccttctcagtagctaggatcacaggtgcatgctatcacacctggctaatttttttaatttttgtagagattggctctccttgtgttgcccaggctggtcttgaactcctgggctcaagcagtcctccaccttggcctcccaaagtcctggggttacaggtgtgagccactgtgcctggcttcctttatgctttttttttttttgagatggagttttgctcttgttgcccaagctggagtgcaatggtgctatcttagctcactgcaacctctgcctcccaggttcaagggattctcctgcctcagcttcctgagtagctgggattacagcttcctgagtagctgggattagccatgcccagctaattttttgtattttcagtagaaacagggtttcaccatgttagccaggcggtctcgaactcctgacatcaggtgatctgcccgcctcggcctcccaaagtgctgggattacagatgtgagccactgcactccgcctcctttatgcattaaaaaaaaaaaaaatttttttttttttgagacagagtttcactcttgttgcccatgcaacagcatgatcacggcaacccccacctcccaggttcaaacaattctcctgcctcagcctcccaattagctgggattacaggcatgtgccaccatgcccacctaattttttgtatttttagtagagatggagtttcaccatgttggccaggctggtctctctctttttttttaacagctgcacactaaaaaaattttatgttgaggcctaaggctctaaattaaaataatttaaaaaaacttttattgagatataattcacatatattagaatataaaattcaccatcttaaagagtacaattcagtgggtttcagtatattcacaagattgtgcaaccatcaccactatctaattccagaacatttctatcaccccaaaaataaaactcagtactcattagcagtcactccccatcctctacttcctgtagcctcggacagccactaatctgctttctgtctttgtgcatttccctattctggacttttcatataagcagaatcatacaatgcgtagtcttttgtgtccagcttctttcacctagcataatgtttttaaggcttattcatgtcgtagcatgtaataaaaacaattttagaaaatgaaactaatactgaaccaattaagtattaataaaggtgatttctttctaaactcaggaagttgaaaaattcaagagcacccattagttaagaaggaatagaaagcagcaggtgaaaagggtgaaagattggcagaggatcggggaacagaaatgttgaaaatggaaagaagaattaaaaatatataaggaaggagtagagtaattgagctctctgttaactgaaatcagttttatggataagactttttgaatgtacttcttacttgaaacaagtcattctagaaacaagatgatccttttctggtcatcgcatattctcttactctctcatttagttgctgctggatttcagacttcccagatatagaccccttttgatatttgacagaattgtgctggggtctcttcttaatttttgtggcatcttttctttactgtttgtttggccttttgtctaatgatctctatgagcatcaggagacagtgctttcttctgaggctacttcctcagcagtacctttgatcccaagaattcccacggaaatgtatttaactatatgaaatgcattttaccttctagatattaacttggcacaggctagtgttggagttggctttgtggatggcattcattttacttactttaaacctcctgcttattagcaactctgctttagcacatgagtttatctgagcaaaataggcaaaaagtgcaaatggtttgaatttaagatgactgatgatagcagcattatacacttgattatcagctctttgcttatctctgtccatggagggtaacagtggtacagacaattaaatcttttgtttgactttgaactgcctcgtcatattctgggatccttagatcttgcttatattactcctaaagaccaagttgctttcatttcacttacagtgggcaaagaaaagccaacctttaaaaaaaagtttcaggttgtgtgtggtggctcacgcttgtaatctcagcactttaagaggccaagatgggagaaccgctggagcccaggagtttgagaccagcctgagcaaggtagtgagatgctgtctctacaaaaaaatttaaaaattagccaggcatggtggcgtgcacttgtagtcccagctccttgggaggctgaggtgggaggattgcttgagcccaggagttcaaggctgtagtgagctatgatcacaccactgcattctagcctgggtgccagagtaagatcatgtatcaaaaaaaaaatttttttttttaaattccatggattattcacaagcaggctatgtgattgctgggagctgaggattgtggttctttgggcatagatatcattgcatggaggtaacagagtctctgtgtattagaatggctgcttattgatcatcagatcagaattagcagcttaatgttttagtagaaatcacagatgcttttatagctcttaatctgtactttactgtgaggcatttgcctttatgttcttaaattaggtgatttactgaaagctattgcttttatggaagtgttaaaaatgagacaaaagaaataacagttactgcattaaaaaggaaaaataatatatatatataaatatatataaaatgtagaaaacctctatccatcctcttagagcttagccgtgccattctttaacgactgttacttttcagctcttggagatcccaggggttgagatgaaagcatgaaccctaagaagggatattatttgccatcacacacctatatgtgcatctcacactaaaattgtacttcttgaattttgatgtacaggagcgttatttgggccccacctttcagaaattccctggcttagttggtctgggaaagatacaagaatctgcatttttatttattttttttattttttatttttattttttgagacagagtctcaccctgtcgccaggctggcatgtagtggcacaatctcggctcagtgcaacctccacctcccgggttcaagcgattctgctgccacaacctcctgagtagctgggattacaggcgtgcaccaccatgcccagctaatttttatatttttagtagtgacagggtttcaccatgttggtcaggatggtctcgatctcctgacctcatgatccacccgcctcagcctcccaaagtgctgggattacaggcgtgagccaccgtgcccagccaagaatctgcatttttaacaagccatcaagcggttgtgacagaggaggtctaggctttaagaaacaccagtgtatggaatgggagtttggggatggggcaagagagacaggtctcagtgatcctgctagaagggagaggacagagaggggtgaagacaagagacaggaagtgaggggagttcttttttttttttttttcccaaggcagaagaatttttcttagtacagaacaaaatgaaaagtctcccatgtctacttctttctacacagacacggcaaccatccgatttctcaatcttttccccacctttccgccctttctattccacaaaaccgccattgtcatcatggcccgttctcaatgagctgttgggtactcctcccagaccgggtggtggccgggcagaggggctcctcacttcccagtaggggcggccgggcagaggcgcccctcacctcccggacggggcggctggcctggcgggggctgacccccacctccctcccggacggggtggctgctgggcggagacgctcctcacttcccagacggggtggctgccggacggaggggctcctcacttctcagatggggtggctgccgggcggagggactcctcacttctcagagggggcggttgccaggcagagggtctcctcacttctcagacggggcggccgggcagagacgctcctcacctcccagacagggtcgcggccgggcagaggcgctcctcacatcccagacggggcggcggggcagaggcgcttcccacatctcagacgatgggcggccaggcagagacgctcctcatttcctagatgggatggcggccgggcagagacggtcctcactttccagactgggcagccaggcagaggggctcctcacatcccagacgatgggcagccaggcagagacgctcctcacttcccagacggggtggcggccgggcagaggctgcaatctcggctctttgggaggccaaggcaggcggctgggaggtggttgtagcgagccgagatcatgccactgcattccagcctgggcaccattgagcactgagtgaacgagactccgtctgcaatcccggcacctcgggaggccgaggctggcggaccactcgcggttaggagctggagaccagcccggccaacacagcgaaaccccgtctccaccaaaaaaatacgaaaaccagtcaggcgtggcggcgcgcgcctgcaatcgcaggcaccgggcaggctgaggcaggagaatcaggcagggaggttgcagtgagccgagatggcagcagcacagtccagcttcgactcggcatcagagggagaccgtggaaagagagggagagggagaccgtggggagaggcagaggcaggggcaggggcatggtcaggggcagaggcagaggcagaggcgagttcttaaagggaagtgaaatgtgtcaaaaacaaaatgtgtgttcttcaagtttgcctgaggctttgatggtgtagatattatgtgggaggtaatttctgtttgtgctgtctttggcatggtctgggctgttttaaagtgtgcaaaggtcagcctccacttcagctcagcgtccctatgacaggctctagcttagtacaatattgccagtccgctctggagtccagcgatagaagaggaggataaagaagaaagttttacatttgctaaccacctattccgcccacatcgatggtaccctgctaattttctctttctgccgtgaatgcttatgatgtcaaagtagtcttttgcatggagaggaatttaagccctgggagaaaataggatttccccaagagaaagcaaaaagaaaaggcccggacattcagacattcaatcaggcaggatgtactggatatctcctatgtgtaaggcactatgttgaccttgaggatacagggggaacaagataggcatcattgttgcctttatagagcttctagtttggtaggggagacacacatgtatcgaatctgttgtacaactaattatttaagtaaaagtatgataattattataaagacctcaaaggaaatgtatcaggtgctgtaagataatttaacaggtggttttgcttagtttgaggggaaaaactttaggggcatgaggaattagaaagagctagtgaaaagaaagtgtagcagccaaagagttaggtgaagaaacaaatctgtggtacattaagaaaccaagaaggaggaatttccagagcatatttgtggtcatgaaagtcaaatgctgccaagatggaaaggaagatgggagttgagactggtttgctacatatggtgatgaaaactgttctagaaaagtttcaagttaataggaccaaacacagcttacaggtgattaaaaaatgagaaggtggtgaaatcctaagtactataatgagctcttacactcactttttggccacttaacatgaagtactttgtaatattctggctgtgcttgctttgtctccccagctagattgacagcttcctgaaggttatgatgataaacctagcccctagcactgtatcaacatgtagcattagagtcaccacctggagatctaagaccttggctctatctggtgctggttctgccacacagaaaccatgtaccttgggcatgatcatctgtttcctcatctctaaaatggtgatattcctaactttcctatcacttgggcttttgcaaggatcaaatagggcagtatatagaaatggactttgtgaattgaaaattagtattctatagaagatattgataatattcagtgagtgacaacagctgctttacatcggaaattctgtgataatcagttttttgtttgttttagatttgttccttatattggaattgtgacgatcctcatgaatgactatcctaaatttaaggtaagagtctgtattatttgttttattaaaaaatgtaatcttttgggccaggcacagtggctcaagcctgtaatcccagcactctgggaggccgaggtgagtggatcgcttgagcccaggagttcaagaccagcctgggcaacatagcgaaaccccgtctctattaaaaaaaaaaaaaaattattagcctgggcgcagtggctcacgcctgtaatcccagcactttgggaggctgaggcaggcagatcacctgaggtcaggagttcgagaacagcctggtcaatatgacaaaaccctgtctttactaaaaatacaaaaaaattagccaggaatggtggtacacacctgtaatcccagctactggggaggctgaggcacgagaattgcttgaatatgataggtggaggttgctgctgcactccagcctgggtgacaaagtgagactgtctcaaaaaaaaaaaaaaaagaaaattatttaaagaaatgtgatattttgcttagtattggaaacttttaaatggattatagttaaaagatgaaagaataattgggtagtttagcgatatattcacaaagaccaatttgttaattaactcttagaacctctgaacttttcaacgcttctctgacttgtggttctgtgtttattttctagtatgcagttctctttttgctgggtttattcgtgctggttcatcgtgagtaagaagcctgccttgctgttcctgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcattgtcacactttcaaatttttgtacatcagtgaatttttttatattaaaaggttgagccaaagcccccagtgtttgtattttgaagccaagcttcacttctaaagtgcctacagagacttgtaaatgaaaatgcagctctgcacgagtttgaaaccgtcatacctccttctattaggaatggcatatactgaggtggtcgtaagtcttaacttctaaaattttaaataaaagactttgcacattg

SEQ ID NO: 38127 - DNA, 21122 bp, Homo sapiens; identical to SEQ ID NO: 35724

SEQ ID NO: 38128 - DNA, 53496 bp, Homo sapiens
agactccgtctgaaaaaaaaaaaaaaaaaaaaaaaaaagattgtatttggagcaaagttttactaaatccttggaagaaaactgcactgtatctaaaaagcacttcatccgattctcccatgtaactgggaacttctcactgaccctcatttctctcagattccagactacaaccatcccccaccctccacctcagattctgaagtttttctctaccctttgaaattcttcacacttctctttaccctagagttccaaaatctaccatgcatgtatgtcccaaatattatataggacctatttatactaaaaagctactcctgttttatctgaatttcaagttttaccaggtattctatattttttctaaatctggcaactatccctcagagtcatcgctctgctttccctggggacagaggagaaaactcaggattcctccccctttattaaataagttatctttatttcatcctctcccaccaaggcaacacccagagaaaataatttttctcacttctttcccttagaacaaatgtttgatttctgttttaaatagcagagttttttctatctccatcatatatcacctatctcttaacatgtttgcatttaacaagttagagtgacttgttttccagttttattttcgtgagtgaacacagatgtttcagaattgcctcatccaaccatttagttcattgtgttcatgtcagttgtgcactaaacactaaactaggtataggatatcaaaatgagtaaaagaagggctctgtctggggaggcagtgtcttttaaaatgggaaagtaaacaatgagtccacattagcagatggctctgaactcagccgagaacagtaaactctgcctagcgttttcacattttggtttaacatcgtttgtgagttagtgacttttgaagggaaagaacagccttctagaacaccaacatcacacttagattgtccttaaataaactgctgccttttaagcaacactgggagtgaattctgtcctgctgaccccctttccaattgcaacaaacacctaaaatgactttggaagctggcagagaaccctttttgaggaggtgcagacagatatccccttatggtgaacaacttctacacttaaataaccttactcactttgaatagattcttattagttttccttttggggggctatttaggtttctaaattttgaggtacctaacatttacatgctgttacaatctgatatgaagttcatcaatgattaagttatttagactattttttaagacttcttttttttttttggagatggagtctcactctgtcaccaggctggagtacagtggtgcggtctcggctcactgcaacctccgcctcctgggttcaagtgattcttctgcttcagcctcccaagtagctgggattacaggcatgcaccaccacgcccggctaatttttgtatttttagtagagatggggtttcaccatgttggtcatgctggtcttgaactcctgacctcgtgatctgcccacctcggcctcccaaagtgctgggattactggcgtgagccactgcgcccagccttcttaagggtgattaatacttagtatctgctctaggaccttgctatttagagtgatcctcagacaagtatcctcgccttcacctgggagcttgctagaaatgaagactcttggttcctacacatagcagctcaatcagtatctatatgtccacactatttccatgtgctttgaagaacattagatttgataagcattagtctagggcttagcatggtgcctgtgctagtaggtgtataataaacactgattgaattgtacgatatattaatatgtttccttaagagtgcataacagaacactgaatttctctccaattacaatcacgatcatcttcctcattctcctcactgtttcaaaatgctagtcttagctgggcattggggtatgcgcgtgtagtcccagatcctcaggaggctaaggtgggaggatcactaagcccagtaggtcaaggctgaagtgagctgtatttgcaccatcgcactgggtggcagagcgagactctgtccataaaattaactaaactaaaaattatagtctcctgtttggtttagcattaactactttatagtgtaatttggaaagatgtcctcctctgctaagggagtacagagcagtatccatggcagaacttgggaattctgcatggaaagatggcatctgaaaagcactggaccgaacggaacccacttctccatctccaatctttaaagtttattctaactacaaggagcacttggtccatgataggaagctgttctttcagatgccacaagtatctctattctccagaaatatctttttcacaccatttgccaattttccaaaagaaacacacaaaaaaacaagtagttctctaattttacctggatttaaaaagagaagcctctctttataataagacattaataacttgtgaataactgataatactgtatcatataatttcccaaatttacatcaaggagtttcagtttattgagaaaagccaagaaaaaaagacaaagccaagaaaaaaaaattccggggctaggtcaatcagagaaactttgcctcttctcgattcctttggtgacatatagtcagtgatacaatggtaaatgtttaatgactggatatctgggagaaacacctggacttctaaggtcttccaatttatatggtataagtagtccctttatggctgatttcaaggtgccaatattgtgtccggaattggtgggttcttggtctcactgatttcaagaatgaagctgcggaccctcgcggtgagcgttacagctcttaaggtggcgcgtctggggtctgccccttctgatgttcagatgtgtttggagtttcttccttctggtgggtttgtggtctcgctgggctcaggaatgaagctgcagatcttcacggtgagtgttacagctcataaaagccacgtggacccaaagagtcagcagtagcaagatttattgcaaagagcgaaagaacaaagcttccacactgtggaaggggaccggagcgggttgccactgctggctggggcagcctgcttttattctcttatctggccccacccacatcctgctgattggtagagcccagcggcctgttttgacagggccgtgattggtgcgtttacaatccctgagctagatacaaaagttctccacatccccatcagattagttagatacagagtttccacacacaggttctccaaggcctcaccagagcagctagatagaatgtctattggtgcactcacaaaccttgagctaaacacagggtgctgattggtgggtttacaaaccttgagctagatacagagtgccgattggtgtttttacaatccctgagctagacataaaggttctccaaggccccaccagagcagctagatacagagtgtcgattggtgcactcataaaccttgagctaaacacagggtgctgattggtgtgtttacaaaccttgagccagatacagagtgctgattggtgtatttacaatccctgagctagacataaagactctctatgtccccaccagactcaggagcccaactggcttcacctagtggatcccgcaccggggctgcaggtggagctgcctgccagtccggcgccgtgcgctcgtactcctcagcccttgggtggtcgatgggactgggcgccgtggagcagggggtggtgctcgtcggggatgctcgggcagcacaggagcccatggagtggatgggaggctcaggcatggcgggctgcaggtcccgagccctgcaccgcgggaaggcagctaaggcccggcgagaaatcgagcacagcgccggtgggccggcactgctaggggacccagtacaccctctgtagccgctggcccgggtgccaagtccctcactgcccggggctggcagggccggccggctgctccgagtgcaggcccgccaagcccatgcccacccggaactccagctggcccgctgtcacctctcaatatgacgccactaaacatggagttgataacaggtgtgcagtagctcaacattatatagtatttctaccatacagatacagtagtagacagagcttgatgaatatagaacaaatttgcgtcagacaatagctttttgtttttagatagtttctttaagggtgaaaacatttaaccaggctctcttgaagccctgctgcctgggggaagtcatttgatttttgctagtctgtatgcattgtttatgtacagactttatggttttgttctcaaaggcatctcctcctaccccgagcctcacactgctggggtttcgtttgttttaaatcttggttggagggggcactctctccagaaagtaaaagacaacggatctggctccagtccaggacggaaagcataacgcttgatttctggatggggtttgcacaaggacagcacgtgagttctgctctccgtgggactcagaccggataggccgtgaaaatctctaaggtgtcagtccacgcaacctaacctggcaaagggaatgctttgcaaactcaggccccagaacagaactcggcctaccagatccagggagccaaagcacgcaggcgcagacagagtagcggtgagcagaaggcaggcgggacgggcgcgcgcactcggcggccaggcgcggcgggagcgcgccctagggggcgggcactgaagctgcggcttgcggttcagcgggttctagggcgccgggcgctcgggcctcggccatggctcacaggccgaaaaggacttttcggcagcgcgcggctgattccagcgacagcgatggcgccgaggagtcgcctgctgagcctggggcgccgagggaacttccggtcccgggttctgcggaggaagagccgccctctggaggaggccgcgcgcaggtggcgggactgccccaccgggttcggggccctcgtggccggggccgggtctgggcgagctcccggcgtgccaccaaagcggctccccgcgcggacgaaggctcaggtgtccagggagacgcggggaagcggggaggtgacggcacagggcgggaaggggccgcggggtctctggatccttctctgggggttctataacttgctgccgaccacaagccatgctgagtcttatccagaaagacttatccagaaggtagtgagcgagaaaatagctcgagcacttgcccgctatctgcatctgccttttggactccttgggggaaataaaacaatcgtgtacagttgggaggctcttcgttttcaccatcagttgactccatcagttataactaacacagttatcaaagtttatgaagaacctaaactgtcacaacaaagttcaataatttataatactattaagtgggcagaagttatatgtaccttttagacacttgaccaacttatctttcttgaaaacatttagccagagtagtacaggaatctaggttttgggacattcccctttgtttattttcttttttcaccagttatttgcaaaaactaatagtaatatatacaacacaaagaagcatgatagagattcatgacactgtagatggtaccagtaatggtgttagatatagtgtcgtcattttgaagtacctttgagttcttaaatacaggtgtaaggcagcataaagttgtttaaataaaatgtgctgctctgagttggaattgtagcttaatgaggaatacggtttttggttagtcttgagagctaaaatcttcctattattttttattgtcattaaagtgatttttattaatttattgagaagtaaaaaatgtatatacttatagtgtacaacatgatgtttgaaatgtgtctacagtgactaaatggagctaattaacatttgctttaccttaggtacttacttttttttgtggtgagaacacttactatctactcttactaattttcaagtatgcaatgcattgttattaattttagtcaccgtgttgtagaatagaattcctcttgtctaattaaaatgtgtgccctttgaccagtatcttcccaactaccctcaacctcactcagtcccttctaaccactactcgactctctgcttctgtgatttctgatttccacttttttagattacatatgtgagatcatgtggtgtttgtctctctgtgcctgtcttatttcatgtaacataatgtcctccaggtttatgatcttcgtgatttcttggtctttcttgtgaccttctatttgtctaaagttttcatgaccttttatatttgttttctggttaaactttgtagatgaaagttgaagtcaggagttccttttctcttgccttctagaatagtggttctcaaactctttgggaattggacctcttttagactcttagaaatgattaaggattccaaagagcttttgtttcagtaggttatacctatcaatatttatcacactaaaaataaaatttattaattcacttacaaaaaatctattacatgtaaggataagtaagatttttgtgaaaagtattaccccaaaaaaggaagagtagcattgttttcaatttacagatctctttaatgtctggcaaaatattaatagaagacagatgaattgtcataggtgtttctgcttttaatctcttgtgctattttgttttggttgaagtatttgaagaaaatacagcctctgacagatacatgattaagacgagtacttaatagcatttttagatcattgagggtgttgtgctttaatataacacagctcaacaagtaataaactaacccttcttaaaagttagttgcgggccgggcacagtggctcacacctgtaatcccagcactttaggaggccgaggcaggtgtatcaagagatcaggagttcgagcccagcctggccaacatggtgaaaccccatctctactaaaaatacaaaaattagccaggcatggtggtgggtgcctgtaatcccagctactcaggaggctgaggcagagaatcacttgaacccgggaggcagaggttgcagtgagctgagattgtgccactacactctagcctgggtgacagagtgagactttatctcaaaaaaaaaaaaaaaaaaaaaaaaaaaagttgccaaatggattcttaaaccatatgattaaatttggggtgctcttaccttaaaactctgttctgttttgtactttggatcttttactcatgaacgattggtaacatcttgcattatttggaaggtattcattagctgagtttgcagatcttgcaaatgttggagcattttattgtacaataccaaaaaaatcatagtattaccactgattaatcagtctgtaagtactggaaagctgttaggttcacagtagagaatataagttttccaaaatctcaattttcacttgaaatctctcattttattgataggcacaaccgggctcatgttttgagaaaatgtttgtcagatagccatgtctgaataatcggtttgttagtcattctttcaagtaaaatggtgatgcttcttaaaaacaacgtctagttcagcttgcaactcagtcacacaaatgcttttccttaaggcagccattgcatttcaagatgcagcaaaagtgccttatgaatactttgattttgtcacaaagaatattaaacatgtgtactcaagggtcaaaatttaataaaataacaattttttaattagttcatgaagagcaactggcttttttctgccatgtgaggtaaggaaaaataccataactgctactacaaattgattcattcatgccaagagcctagcagttttacccatcactgcctttacttcattatataaatatcaacatggtaaaaagaacaaataacatgttattattgtgatgaaagtagttttaatttcacagactctctgaaagagtctcaaggacctccagggattgataaaccatgctttaagacccactgctttggtgttaatccactttggaaacaggtatgggttgtcataaatgacaatatctaagaaagatgtgagctgcagctatattttttttagtgttttaaattttgattttactccagccttttttgaactgtatgtaggtcttctaactaaggtagaaaattaaaattaatgagtagtatgtaatcttatgttttaaggttactcataaagattgcaaatttattgtggattaagaaatcctttcttgtcaataatgtcaagaattcctttattttgttcattcaattttcacaacacccctgtgggttttatcttggtgttatctttgtttaacagattaattgaatttaacagactatttaccttcccaaatcatgcattgaaaagatggacccatggtttaatattgaccaaagtgctcgttacaatatttctcgccaccagccgttgaaatatggcatactataaagagagcctaagttctgaagttgcctgggattaggttgacagccctgcttctccactgcccgagttggtgttctttatcctctcaatccttagtgaactcatcagaaattgcatttactttatagaattacaggtattaaataagtcatgtaaaacaggtttcagtgtgcctagtacatagtatacattaaatatttttcttttctacttattcacaatcattactattctaaatattacttcattttttgtcgctttttttttctctaatgcctccttcccttttctcattgcatacttttggaaatatattattagatgcctagataatacaaatagggtctttgtacacttagtagatcattcagttgcttaagaaagaaagttggaggaagatcaatatgtctactttaatatatggactaggattaaaacaccgtattatacatatgccatgtgttgttcagaatttcaattaataattccattattttgactcttttttgttgtatttttaaaatgtcctgttagaatccagaacccttgatgtgtccacagatgaagaggataaaatacatcactcctcagaaagtaaggatgatcagggtttgtcttctgacagttctagctctcttggagaaaaagaactttcatcaacaggttagtaatttgtatgattttggttaagaattttatttttaatatagtgtttttgatatagttattaatgacataacaaactctagtgacatggggcaagtaggtcattaatgatgattgtcagagtgccaaaattgctcatttttattacattttaacatgcacaggtcagacagcttataagtagcagggctaggattcaaacccagtttgttctggagcctgtattcttcttaatcactgtgctatactgggtgattgacattgatacttgaaggatggtaagaatttgtcagggaggatgtttcaggtataggatgtagcatatctgaaactctagggaaggtatgtaatatgtgcaggaagctaaaaatagctctggctgaaagtatttggttgcgagtttaaggaaaagaaaacaggaaggacaagttggagtcagattatacagggcttagggaaccactgaaaattttatacagatgacatgaatgtttttgtgtcttagaaagatcagtctagttcaggggttggcaaatctggcccaccacctgtttttgtaaacaaagttttattaaaacacaatcacagtctttcagttacttaatatttgtgggtgcttttgcactgcagcagcagagttgagaagttgccacaaagaccctatggcccgcaaagtgaaaaatatttatctggcgtcttacagaggtttataacttgttttgtgccgtggactcctttttcagtctagtgaagcctaagatcccttctgagaaaataaagtaaaatacatagctttgtagaggaaacaaattatattgaaataaaattattaaaatatattttatgacgcttgtaatatagtaataagtgcttctgtgcttctttttttttttttttttttttgagatggagtctcactctgtcgcccaggctggagtgcagtggcgcaatctgggttcactgcaagctccgcctcccaggttcacgtcattctcctgccttagcctcttgagtagctaggactataggccaccacgcctggctaattttttgtatttttagtagagatggggtttcaccgtgttagccaagatggtctcgatctcctgacctcttgatctgcccacctcggactctcaaagtgctgggattacagacgtgagccaccacgcccggccataagtgcttctttattagcctattaaataacaacaaccagtagctctgtaaccttgtaattttgtttcttctccatgtccacaaggtacagaaatactaagcgattaagccaatattaagaactgaaatctagtaaacagttgaagccttgtctggattctagatacagtgctattcagtaaaattttctgtggtttggaaaaattttctatcttcactgtccatatggtagccactagtcacaagtggctgttgagctcttgaaatgtggctatagcgagactgagaaattgaatttttagttatatttgaatactcacatagggctagtggctactgtaccaaacaatgctactataaaagatggcggattagactaggtgccatggctcatgtctgcagtttgggaggccgaggtggatggatcacctgaggtcaggagtttgagaccaacctggccaaaatggtgaaaccctggctttactaaaaatgtaaaaattagccaggcatggtggcatgcacctgtaattcaggggactgaggcaaaagaattgcttgaacctgggaggcagaggttgcagtgagcagagatcatgccagtgcactccagcctgggcaacagagcaagactccatctcaaaaccaaacaaacaaaaaaagatggtggattaaacaggataaggcagtggttgtaaagtgttggcagcactgcccccaccttaggagagagggcagcgtttgaaaatgtgtgggattatttaaatgattatagtagttgagttgttgctggcacatagtgccctagaggcaagggatgataaatgtcttaacaggagtgcagaacagttcagcgcagtgaattgcccatcccctatgcacattgagaaacgctgattaaaaattgaaaacttgtcctgtgaggaacacctgaaagttcgaaggacttattggctggcgaagaaaagatggaggaatgtgttaattttaagggctggcatgtggaagaagagcatttatttgtgttccgatgaataactgcctcaaaatagtccctctagcagagattacttgttactaatagaagatgataatttacctctcagccctagatgattgcatatcagataggatgatatatgtgaagaattattcataagttataaatttgtaaaaacatgatgtatttattattgaacaatatgctgacattattgattcctcctatgtctgcccagcatctgctgtgtgagaacccttgaacgaggtattgaatatgcagaaacaggacaaacgcaatactcttctcttccttggttttttacttctttatttttacttgagcagttacctttatgtagcactaatatcttactagtgtgtcccattgcttgtgacttactaattaaaccctaccgagtcacctgcaagaaaatcacttccaaaataagtatttctgtgtccacattcatacacttgagtatttgaacctaaatgtcttatcttaatcctgcctgcacattaaaatcctctagggagctataaaaacatacttctgctcagctctgcctcagatcaacatctgaatcactggtatagaggcctgggtatgtcaagcttctcaggtgactctgatgtgtagccagggtcgagaattgctactataacctgctgtgatggttttgaatcttaaatgctttgggaggaggaagagacacctgaccttcatcatgtccctgacagtagtctataaataattactaatctataaaaaagcaaatcacttcattttctattacttgttcttgatgaatatttattgacttctagtgatttctttattgcttcatgattcactcaaggacttttaattttccctagggctgatgtcaagcatattggtctgtgatttctaaaatctttctctttttttgtttgtttcaaacatgggagcttttgtgcatctccaagtacatggcatttttctgtttatttctcaaagaatttgggtcaacttgtgggaaagtttagaaaatttcacttcagcctcagtagcttgacatctttttagtagtttgaagtgcttaaaatggtgaaaatttctctcgctgtttctttaatgtagtatttttcttaagaaaccgttttttccagaatgaagataaatttcagcttagatcatgcatgaagaaactcgttttaaattggaagagtttatgctaatgatatttatgctgtacaaaataaagaaaaaaaataagactctcttaagagttgttgtcatttaaaatttttcacctggtaaatgagcctgattattttctttacacttcttaatgtctcatgtttattcacgtggggctcactacagaaccgcagaggctaatttggctttgctctgttactgtttgtagtatgtttgtgatttcttgtaagtgtgggtaggagggaaggaggaaggaggacatcatagtgtagtatctctcttacttggtaagtcaggctggtctgtcattgatccttctaacttctgtagctctcactgattggggaacaccacactcagccctctccacatccctgcgctgacaatctcagagcttccagaaatgagaaatagcgacccctcaacaaagtgagcagtacctgatgagtaagagagttaaaagataaaatgaagcagtttcagtatattttctgatacttctagatttgtttgatttttctaagttgtatttaatctctattaagttttcttcctttgctgatacagattttgagccatttattaaagtcacattcatatatcaaaatagcaaataatttaggaaaatggtgcttttttctttttcttaaatgtgaggaatatttacttacattggtctttggtttttagtgtcctcgtctttgtttccttcagttaagatcccagatgcagcttttattcaggcagcccgcagaaaacgtgaattggccagggcccaagatgactatatttctttggatgtacaacatacctcctccatctctggtatgaagagagagagcgaagatgaccctgagagtgagcctgatgaccatgaaaagagaataccatttactctaagacctcaaacacttagacaaaggatggctgaggaatcaagtatggatttaccaatatatgaagattaggatattttttattagaatataatatgagagaatctccataaaaaatgtaatatgctggctcacattttatagtgttgataatggtttttaacatcgatttggtccatgatattgtgacctctaaaagatgtatctgtatcaaaatgttattatcaaggagtatgtgtaataatgtttattaatgcctgacctcccaccttgatgtttttggacaggttaaaaaaaatgtgcagtatcttactttcaaagcattgaaaacgatcgtttttacctgtataaatatattttttttaacatggaagcatctatagagattttagatgtcatgtattaaaatcttccctgctgtaataaaaaatttcctctaccaataatactaagccttaaaggactgttttcatatttctcatttatgatatatgcatttgaccaaggttttggtaactttaaataatatttttttcagaaaaggacttagttccttacaatttatttttaagtgtttggattctcaggtagtaattgagagatctttgataagaaaaaccaaacatttcattctttctcagttttttacaatatagggctatagtgttttgagtgggacagtttagtgataggagtgcaggttatggagtcagatcccaggatccagcttccagcttcaacatagtcctaagacagttacttaacctcccaatatttgcatttcctcatttgtgaaatgagggcagtaatagtgccttcttcccagaattattatgaagaataaataacacgtcaagtggtgctaagcctttgtataatctcaaaaaatgttggcttgctgcaattaaaatggaaaaatactaaacgtttacatgtgagctttttttccgctagtaagcagaaatgaagaaacaagtgaagaaagtcaggaagatgaaaagcaagatacttgggaacaacagcaaatgaggaaagcagttaaaatcatagaggtaatcattttttatcccatgtgtattagattcctgtggctgctataacaaattaccacaaacttggtgactcaaaagaacacacatttattctctcacagcgtggaggccaaaatctgaagtcaaggtattggcagcaccttgcttcttccaaaggccctggggggttgtggggagcggtaattcttccttgccttttgcaacttctggtcattccaggtgtttcttggcttgtgactacataactcctctctctgcctctgtcttcacgtggctttttccatgtctctactgtgtgtttttctcgtaaggatacttgtcattgggtttagggcctactcagataatccaagatccttcacttaattacaaccacaaagactctttttccaaataaggtcatgtttgcactttccagggattatgtcatggatgtatcttttgggaggcctccattcaacccactacactgtgcatattatcttattttccactagattataaataccttccacttgagggtactatttttttaatctttaattttatagtaattgacagtttatattgtacaggtgcttaaaagtaaagtttagccctcaagctttacttttaaacgcctgttctgtataatacaaatatatccaattttctctttggagactgtttttttcacttcacaatacaacagagacatctcaccgcaatggtatatctacttcgactacaccttaatgatttcatagcaatctagtgaatagataatatatatcatttatatattaaatctcattatgtgatttctcatataattttttattgtagtgaaccctatggtaaatattatacacaaatatgttatacctatattatgatatgtaactgttacatttctgcatacacaaataatagttttgtgttttatttaattttttaaaagatgtaaacaaagtaaatatccaacaataggggtcttggtacaatacagtaaggtgggatgaagtgctaaaaatggtatcagaaaccaaagctcgggaggctgagtcaggtggatcacttgagtacaaagaagactagcctgggcaacatagccaaaccctgccgctacaaaaaatacaaaaattagccagtcatggtggcacacacctgtagtcctagctgcttggggggctgaagtgggaggattgcttgagcccaggaggtcaaggctgcagtgagccaagatcacgccactgcgcttcagcgtgggtgacagagtgagaccctgtctcatttaagaaaaaaaaaaaaaaacaacgttaaagcccagatttggccaggcatagtggctcacacctgttactccagcacttcggaaggccaaggtggaaggatcacttcagcccagtagtttgagaccagcctgaacaacacagtgagacctgaactctactaaaaacaaataaaactagccaggcatggtggcgcatgcctatagtcccagccacttgcggggctgagctgggaggatcacttgagcccaggagttctgggtgcagtgagctatgatcacaccactgcactccagtctgggcaacagagtgagaccctgtcactaaaaataaataaatgaatgaatgaatgaatgtaaagtttaaacaagtagtgagctttgaaacataacaaatgtactgtacttggggttaaaagtcctagatttgggctgtgggtctgctgctagaatataagttctgtgaggtcaagaattgcaatcatagtgtacatcagagattcccaaactttctcattcatggagatgttagtgtcttggtaattttatcatgatacttgtaagccaaaagaagtaccaaacagttctatttattaagtagtccaaagaattttatacaatttatgtcctaagaactaaccatttggaaaaaataatacagataaattgaaggcaaaacatttttatctttttttaaataaccaaaattccttactaatgagatgtgtgttcctgttaggcattgcatgacttttcagaccttggagtcagattggacactgtcactctcatttccatactgatgttcacacaatacttgtttttatcatagcatcctcccaaaacccagctccacaaatatgacttcatcaaaaggaatggaacacattctttttttttttttttttgagacagagtttctctttgtcgcctaggctggagtacagtggcatgatctcggctcactgcaacctccacttcccaggttcaagcaattctcatgcctcagcttcctgagtagctgggactacacgtacataccaccatgcctgactgattttttgtattttagtagagatggggtttcatcatgttgcctaggctggtctcaaactcctgagctcaggcagtctgcccacctcaacctcccaaagtgctaggattacaggtatgagccactgtgtctggccatatggaacacattctaatgtaactgtgaactaagagctagtagtccaacagatgttgagtattacggtttttccctaaaaaatttaaaatgtctcactacacccctttaaatttgctaggatgcctttgcacacagtttaggaaccacaatatgcatgcaattttgaattctgatttccttgcttgacatattataaattatcttctcttgtttttatatcgttataacaactgattttaatagctatataatattcactggagtcactgaatcataatcttaaccattcttcattttggacattttaggttatttgcaatctgatttttttaattaacaaataagaatcagtgaatatttaattattttcctcctctcctttcttttgttcagatgtgtgtttttgaactattcctttgtaataattgccaagagttgtattactaatcgagatgaacatttttatggcacttagtatatttttctctattgccatttaaagaaaacttagctcaatctgtaatgtcgccaatatcatgggaatattttaccataatcttgccctcttcaggtccaagtatagttggtgaaaatggaatctcacacttatttgattttcatttttattgctaatgtgagtacatttactgattcctttattgaaaatctaccatttgccactgtgttactttcctgtggctcctgtaacaaattactgcagacttggtggcttaaaacaatagaagtttattcgctctgaggtctggaggccagaagtccaaaatcataatgtcagtagagcaacccccctttccagaaactctgtaggagaatccattccttgactcttctagtttctggtggctgttggcatgccttggcttgtggccacatctctctttgttgcatcttcacatctgcttcttctcttgtgtcccaaaattccctatctcttaggatggtacatgtaattgtattcagaccccatcgggataatccaggatatacaccacatctcaaagtcttaattacatcttttgccatataatgaacatgaacatgaatgtgaacatgttttcatggggtcaccattagcctgctacggccagttacaatgatgtacaacctctgcaggaagggagacaactaaacaaaacaattatagtgaaatcctacaggtgctgtgacagaactctgtgcagggtcctgaggtggcacaaaggagcaagtgggtgatcagttttataggagggaaggtaagtgaggaagtctgagaaagcatttatggaagtggtgatatttgaatgggttattgactgcaaaatatcaagagtgtttggagattttgtagatatgcgtagagctggatgggaggcttggtgagaactgaaatgacaaaagatgatgcttcatggaaaatataaaaagaatagctaagccagtgaaattggctaaatatctggtcagttttcttcatgtgtctttgtgtaaaatagaggttcttcaggatcttttgaacattccaagcatggaggagctgtgattagacagaggacactaatgtgaaacataccatgttataagatatatgttaggagtgcatttctttacaaggaccagaaaacccaaataagaatgtcttggctgggcgtggtggctcatgcctgtaatcccaatactttgggaggccacggcaggcagatgacgaggtcaggagattgagaccatcctggctaacacagtgaaaccccatgtctactaaaaatacaaaaaaattcaccaggcatggtggcaggcgcctgtagtcccagctactcgggaggctgaggcaggagaatggcgtgaacccaggaggcggagcttgcagtgagccgagattgtgccactggactctagcctgggcaacagaacgagactccatctcaaaaaaaaaagaaagaatgtcttaaagaaaagtaaaaactttacctacaaaccctccagcacacttccatttacttttcattgactagaatggagttgcagttaaataggtacttctatcatggaaataggtgttaggtcagccagacaggtctgtctactccacaaattaatattcatgaaggattgttgtttcttaaaaaactgggtgactttctgagagtacattagaccataaccaaaattagcttcaaaactaaacttttttaaaaatgtaatttttagaatttgcttcttaaatatgaatttaaacttctaaattttaaaactgaatttaaaaacattttattgggaccatgaaaaattacaaagacatggaattttttagcttgaagagaccttggatcatccagtccctttacatgctattaatgtttcaaaggtaaatgaaataaatggttttgtaaaaatctatttttacttttttaggaaagagacatagatctttcctgtggcaatggatcttcaaaagtgaagaaatttgatacttccatttcatttccgccagtaaatttagaaattataaagaagcaattaaatactaggtgagcaatactcattttgaaatttacatttgtcctagatatttaatactaaagatataacactatattcttttagattattaagtactgatattaaacagacttatgggggggaaaaaggatctcctgtgttatcatactaacacaatttatttcatttttgtatacactagtcccccccatatctgcatttttgccttctatggtttcagttatcggtagtgaaaccatggtccaaaaatattgaatggaaaattccagaaataaacaattcatatgttttaaattgcatgctgttctaagtagtgtgatgacatcttgagctgccctgcttcatcctgcccaggatgagaatcatccttttgtccagcatctctttgctctgtaagccagcagcctgttagtcacatagtaaccatctcagttatcagatcaactattgcagtatcacagtgcttgtgttcaggtaacccttattttacttaataattgccccacagtgcaggtgtactgtatgtaatatataaattaaactttatcatagttacctatgtatagggaaaaaacagcatatataggctttggtattatttgcattcactgggggtcttggaacctatccccatgattaaggggtgactacgatatgtctttttagtctttataacatattttacgtggttaaaatcagtaaatacaaaattctacttttctatttaatatgattataagcatttttctatattaccaaaaagcctttaatttttttaaaaaaactatcatgtttgtccatatagttgttatatcataattaaatacttctctgttggacattttgatctagaacaggagtcagcaagtcgtctttttgtgtaaaaggctggatagtaaatattttaggctttaagggctagatgattgctgttgtaactgctcaactctatgttacagcatgaaaacagccatagacaatatgtaaacatataagcatgtatgtgttccaatataactttatttataaaaacaaaggatggactggtagtttgccagccccctagaatacaaagataaccttgcatgagggataaaaaagaggcagcagatcattgatttatcgtagcattttattttatctggataactttattatattttattttttattaactaggttttttattttaaaaagaccatacactctcattgttaaaaaataaaataaccagtggaaaggatatacagaacgaagtaaattaccaccctccctagaggaacccattgctaccagtttcttatgttttgttccagaagtggtctatatgtatatctttataagcacatgtatacttatatattcccgtttttatacaaaaaaggacattatataccctgctctgtacctagttttttccacatgatatttacttacaagttcactgctatagtcaaaaatattctacttaactaaaacattttattaataatgcctactatacattattatcttgattaatttcttaattctcactctcctttatataaagcaaagaaagattctgaaagacaaatgcaagaaaacttgaagagagaatatttggcctaagcaagtgctaaagggtttccttttattgtggtgttctttgcttatctagtctataaacccagatttatatgattgtcagtttccttggtggtctttgaaaatatttacattagattgctacttttaaaagagtatgaaaaataaactaatttttattttatttatttagattaacattactacaggaaactcaccgctcacacctgagggagtatgaaaaatacgtacaagatgtcaaaagctcaaagagtaccatccagaacctagagagttcatcaaatcaagctctaaattgtaaattctataaaagcatgaaaatttatgtggaaaatttaattgactgccttaatgaaaaggtacatatcaatatttatttatatcatttccttttttggagaaaaccccttgtgcaattaagaaaagtctaaatctcacaattagatacttttctctagtatttttcctacacatttttaaaataagatgatagcattctcttaatgttggatattcaagttttttgcaactattttattattgtaagtaacattgtataaaattttgtatataaatttttgttataatttcttctgtttaaggaaaattccttgaaaatgaagtcaaataaaatgaattattaagtctaaatatttttaaggcttatgaaacattacaaaattgacctccagaaagattgtgccagttttattagtttactagattaggaataaatggattttgtttttacatatcatattttgatctcaagcaaactctttggttttctgcttgtgaattatttgtttcttgtctttgcccttttatctttgtggttcttagtggaaatttttttctttttcttttctggttttgttagagtatgaacaattctttatagcttaaaattttttaatgttttatcctacttaatgtgaacttaccagttttgtcttttgaatttgtttgtaatggtttttctttcaacattcagatgttttgaaatttttgtttttagtttttgttttatgcatactaagtttttacattggggcaggccttcagttgtctgtttttaaaaatagattaaccatttcaataaattattctctactttccacatttttgttatttttattttatttatttttctagtgagggggacagagtctcgctctgtcacccaggctggactgtagtagcacgatctcagctcaatgcaacctctgcctcctaggttcaagcgattctcgtgcctcagcctcccaagtagctgggactacaggcgtgcaccaccacacccagctaatgttttgtatttttagtagagacggggtttcgccatgttgcccaagctggtctggaactcccgagctcaggcaatccacctgtctcagcctcccaaagtgctagggttataggcctgagccactgcactcagcccacattattttttgtttataattaaaacaatgagatgctttgtcccaattgttgttttaagttggctatcttctactatcacttggtagttactttctgaagtatttattacaatgtaattttcttttttcatttgcccttgaaaaattacactgttaaaattttgtcagcctgtgcattaatgtactcatagcagcagctgtggagtatcaatggagtaggaggaattgttgctccccaaaatatgagagtttcaatttcaacaagtctcatttctgtatcacatcacaacttacttacctgactctggttagtttttctccattccccgatttttcaaatttcaccagctttgagtgcccccacctactttccacaccctcagcctggaaaacatctgtacccttcattttttcctattcttctgtctcaaaaaaaaatcttctatctcaaactttaatgcatgttcctgactccatcccatttggtttctttttttttttttcttttgagacagagcctcactctgttgcccaggctggagtgcagtggtgtgatctcagctcactgtaacctccacctccagagttcaagcgattctcctgcctcagtctcctgagtagctgggattgaaggcaggtgccactgcgcctggctaatttttgtactgttagtagagaaggggtttcgctatgttggccaggctggccttgaactcctgacctcaggtgatctacccacctcccaaagtgctgggataacaggcatgagctaccacatcctggcccccatttagtttatctatctctgataattgtaacagttccagtagactaagtcaattttctgattttttaatattaaaagtattggcagctaggtctgttgcacacaatgttttatacttcagatgtgatagtattgggaatgtttctttgagaattaagcatataaatatgcttatgtatcttctaaatattacttttatatatatatatatatatatatatttcattatcgatgacctgcaaaatgttacttatatgtgtatttcagattatcaacatccaagaaatagaatcatccatgcatgcactccttttaaaacaagctatgacctttatgaaacgcaggcaagatgaattaaaacatgaatcaacgtatttacaacagttatcacgttagtgtttttcgtgttccatacaatttattattcattaagctaaattatgtgaagaataaaaatatttttatttttataaacatgtttttcatgtattttcccacaaaccctttacccaccaacttccaaaaactcaaaacatttagaaataggacttaagaatgttttaaattaagtccaagactcaaaaataaacatgacttccagttatttactatttcagacagaatatgtacatagccatttagagaatgttttgagacaagttcacataattctggaggctctgtcagaagtctaacttcatagtttcagagcccttttacagattggttctggtgagtttcaatacagattttaagatctcattatataaaatacggatgcctcctcttttttttttcgcattgattttgtactttcagagatatcttcctttgattaaggtgctatcaggagatagtgaaagaccataaccaagtagctagtaaatgcaaaggcaaagtgactttcagtgaaacacacaacccttagtggatcataaataatggtattacgtattaaaataagaaataatatgaatagaatacagtaatccctctaatctgcagttttgctttccacagtttcagtcaacaatggtccaaaaatgaataagtacagtacaataagatattttgagagagagatacccaacattcgtataacttacaatatattattttcattgttctactttattgctattgttagtctcttacagtgcctaatttataaattaaactttatcataggtgtgtatatagaggaaaaaacaaatagggtttggtgctatatgcagtttcaggcatcgactggggttcttagaaggtgtcccctgcagattaggggggactcctgtattggcaaagccaatatttcttgcatttggctatggaaaaaaactggtagaaactactggaaaagaatatgagaaaacgaaactttgtggtagaactttgttgctgttctcaacaacagcaaaagtacaccagccaaagtacatttttaggctaatgaacctcatgcctgttaatattgcaataaagagttaacattgaaatgtcattgcataattaattgcaaaatttaagcatatttatgtatttacatatgcatatgtttatacatccatgatattacctttattttcaaagcattttacttttttcttttgagaatttgtagtatgaagtcaattttatttattaacaggcaaagatgagacatccacaagtggaaacttctcagtagatgaaaaaactcagtggattttagaagagattgaatctcgaaggtacctatataaagtgaagatttaaagaaagcatcattgagcaagtacttttcactactgaaatataattaaccacatgatgtcattaactatacctgatatacattattaatttgtaagaataatagaaaagcaaaatttagtaaaaccacccttgactgctttaaagacacattggtgtatttggatcagttaaaaggaatgggtaaaatgacatttatcaggctgggaattccttgtaactagaaaccggtcctaattataattaccccctcttcggaatctggttagcccatgggaatgtcctaaatgggaatgtcttataagagaaaacaaaacaaaacaaaaaatgcagaaccaccaactcaaactaatgaaactaaaaatgtcaaaaatattaataaaattgtgcgctgatatgatagtatatttctggccatttaaaataaatgataaaattacttattttcagcaagaggttaaaaaaaatttaggcatttattttcagcaagaactacttactttttgtttatttttggtttgttgcaaaatataggacaaaaagaagacaagcaagggtgctttctgggaattgtaaccatcaggaaggaacatctagtgatgatgaactgccttcagcagagatgattgacttccaaaaaagccaaggtcagttaccaagtttctaatatatcatggtttgagttttgaaatggtgagaaacactttgctgggattgcccttaataagtacataagctatataaaacagttgggtaaattcaggaaaaatgaaacacatttttcctctgtaagactcttttctctgaaaaaatggagtaaaatgaaggaaggaacattgtgagtattcttacatcttcatagttttttctcttagacgttctccaattaataatgaacatcttcatttcatttctttaccacacatactttctatattgtcatttttaacttaaaacatttgaatttggtgaaactttttagcatgatgagaagatgcatatagttgaaaaattctaggctctggatttaaataaatttgggttctaagggagatttttttctgtgtaatcttagacaaattttttgacctccctaaatttgatgttgttttgtctgtaaataagtagactatacctatatggtatggaagatagctacgatggtaaaatgagattaatgtatttctgcgtatagcaggggtatatatggtaacttctattagtgttgatattattactttgttgataaagtgatttaataaaaatttatattaatataaaaggacaaattttagctcaattgattacagtccatcatgaccgtgtttttaaggaagcatacttaaagttcacaacttaaaatgcataaagagacttattttgtttacaggtgacattttacagaaacagaagaaagtttttgaagaagtgcaagatgatttttgtaacatccagaatattttgttgaaatttcagcaatggcgagaaaagtttcctgactcctattatgaagctttcattagtttatgcataccaaagcttttaaatcccctaatacgagttcagttgattgattggaatcctcttaaggtatttatgcttaacatatgaaaaattatcctgattatattagttgcttaaattcccttactattgtgttaggcattaaataccttacccttagagtcggagctgaaatttagagctttggaacaatagtcagaaaatgtgtgctttcggctacattcttcttttcttggctgtcacttgatttttaggctaagcatcattaacatcagtaaagcaaacacatttttttttagcttcttgtacattaaatttaaaatcctcccagaaagtataaggtactgttgggtttggagaaagtagatataaaagccttgtttcaagaattcttaagttggagatgacatactgggaagagttgcttagggttgtgttgagaaggtggaatgcaagcctttgaagagtttatggggtaaacaggatgaatcagaaagggaaaggtgtttcataaaggtgtaaagggagaagtattagttcaggagctagaaattgcacagatatttagatcctaagttaaggaatataaactctgttcactgaatttgactgactaaaagaaaaaaaaagaagtatgaactcagcaactgcctactgtgtaataggacctttaactaaatcacatacaaattacatatttatgcttagtgaattgaaggggccagaaataaactttgcttgaagtggatgaattttttttataaacaaattccatggctgtttcaagtgcctaacaaatttgtattttgctccaagcagagtacttgccatgtggtagggtctaaaggctccggcacacactaggtagttgttgagtgtttgttgtgtgattgaatgcatgaaatgcagcttcttcttatgttacttagacaccatgtctcagtcatgctgtcctgcaatcctgcctagccttggtggtctagtgttaaaatagggaattaatctcttctgatccttagaaaagctctggtgattattgaaaaaaataataactatttaaaaatacactaatgttgaaagatttctttataacttttgtaattttctttgtaagttggaatccacaggtttaaaagagatgccatggttcaaatctgtagaagaatttatggatagcagtgtggaagattcaaagaaggaaagtagttcagataaaaaagtcttgtctgcaatcatcaacaaaacaattattccccgacttacaggtactgcttcgtaaccttggtaaaattaaattattttctgacagagtatataaggttgttaatttctgttatattcacaaagttttttcataagtttttaatctcaaggaaatgttatatgtagtaaaaatcaacagctgtcaaatgtaaggtggttaaaaaatttgtgtttgtacaggtggttggctaccaaactgctaatactcagattgatcactaatcctcatctgacgtatcatcagcagttccaacagttgacccttctttcttcctagaaacactgtctttacttggctaccaaaataccacactcttagtttcctgcccacctctctggtctttgctgtctgcttgtcacctctttgacttccaagtgctacagtatctctggattcaggtcacttaccttctctgttctatttacttcagtcacttagtatttaaagtcagtttagtgtttgtggcattcccgctgcttttatggcacttcagtcattttttagcacacttccatccatactacatgtgtccttttttccccttaacttctctaattgtgtttcttatccttttctttaaaaccattgcttcatctgggagtggtggttcatgcctgtaatcctggaactttaggaggccaaggcaggtagatcacctgaggtcaggagttcaagaccagcctggccaccatggcgaaacctcgtctctactaaaaatacaaaaaactagctgggtgtggtagcaggcacctgtaatcccagctactcaggaggctgaggcaggagaattgcttaaacctgggaggcgaaggttgcggtgagccgagatcgtgccattgcactccagcctgggtgacaagagtgaaactccgtctcaaaaaaaaaaaaaattgcttcatttcactcacatttgccactagcagctatgagcacttaacattaatgcttgtgcttcagaccttagcatgaagtcttttgttttacctgtgtacttgataaggatccgtttcactatgtcactgagaaagaaatttgacagcaaagactgcaaaactcttatttaattttttgtgtgtttgtttttgagacagggtcttcctctgtcacccagactggagtacagtggtgtgaacattgctcaagtcagtcttgaattcctggggtcaagtgatcctactgcctcagcctcccaattagctaggactccaggcgcgtgccaccatacccagctaatttttaaaagatttttttagagacagggtcttgctctgttgcccaggctagtctcaaactcctggcctcaagagacccttcccctaagcttcccaaagcactgggattataggcatgagtcaccatgcccagcctagaagttggaagcaattagccttataattgcttcttaggcaacttgattataagattttggctgggtggagttgctcatgcctgtaatcccagcactttgcaaggccgaggcagaaggatcgcttgagcacaggagttccagaccagccttggcaacgaggtgaaaccccatctctatttataaatttaaaatttaaaaaaaataaaaaataaaaactttcaagattttatttcaatgaaacttatggtgcatttgtggggtgtgttagaaagttactatttttaactaactctactaatgatagaatgcatgtgcctagtttaagcactctgctgaaaaaatctaaatactaatgatgaaacagtcccacaaataagtagctttgtgagaaattaacactgactgagtccaaatagtgattgaattctacatatatttcaaagatagcactaacagaatgtgctaatggattggttgtgcagcaagagagaaagagaggaatcaagaatgggtccattgaggaattggcctgagcaactggaaggacagaggtgccatttcctgaaatgaaaaagtctgacaggagtaagcttaatgtggggagctgtattagcatagcagctcagtttgggacatgttgattttgaagtacctgtaatctaagtggacatgtcaagtcagttgttgaatacatgagtcttaaagggggaggtccagtcagaaggtataagtttggaatttatccacatgacatttattgatggcatttaatgtataaaattgactttgaataccaagcgagtgaatataaaccgaaaagagaaggtaagtgacctgaatcctgagatactatagcactgggaagtcaaagagatgacaagcagacagcaaagaccagagaggtgggcaggaaactaagagtgtggtattttggaagccaagtaaagacagtgtttctaggaagaaagaagggtcaactgttggaattgttgatgataagtcagatgaggattagaatcaatcattggagtttgctatgtgaatgtcatctgtgatttgctaagagcgcattaggtaggctgataagagataaggcctaattaaagggaaagcaagaacaagtgagaagagagaaactggagatagaagtttagatagtactttgaggaattttgttgtaaaagataggagggaaatggaacaatactagaggaggaagtagggctaagggggattttttgtttgtttattattatactttaagttctggggtacatgtgcagaacgtgcaggtttgttacataggtgtacacgtgccatagtgtttgctgcactcatcaacttgtcatctacattaggtatttctcctaatgctatcccaccccagtcccctgacccccaaaaggccccggtgtgtgatgttccgctccctgtccatgtgttctcattgttcagctcccacttatgagtgagaacgtgcagtgtttggttttgtgttctggtgttagtttgctgagaatgatggtttccagcttcatccatgtccatgtccctgcaaaggacataaactcatcctgttttatggctgcatagtattccatggtgtacatgtgccacattttcttaatccagtctatcattgatgggcatttgggttggttccaagtctttgctattgtgaatagtgccacaataaacatacatgtgcatgtgtctttatagcagcatgaatttataatcctttgggtatatactcagtaatagcatggctgggttaaatggtatttctagttctagatccttgagcagtcgccacactgtcttccacaatggttgaactagtttacagtcccaccaacagtgtaaaagtgttctatttctccacatcctctcttttaattgtgatgttaggatgtcgattttagatctttcctgctttctgttgtgggcatttagtgctataaatttccctctacacactgctttaaatgtgtcccagggattctggtacgttgtgtgtttgttctcatggtttcaaagaacatctttacttctgcctccatttctttatttacccagtagtcattcaggagcaggctgttaagtttccatatagttgtgcggttttgagtgagtttcttaatcttgagttctaatttgattgtactgtggtctgagagactgtttgttatgatttccattcttttgcatttgctgaggagtgttttacttccaattatgtggtcagttttagaataagtgtgatgtggtgctaagaaaaatgtatattctgtcgatttggggtggagagttctatagatgtctattaggtctgcttggtccagagctgagttcaattcctggatatctttgttaattttctgtttcattgatctgtctgttatcgacagtgggatgttaaaggctcccactattattgtgtgggagtctaagtctctttgtaggtctctaagaacttgctttatgaatctgatctgagtgctgctgtattgggtgcgtatttatttaggatggttagctcttactgttgcactgatcccttcaccattatgtaatacccttctttgtctcttttgatctttgctggcttaaagtctgttttatcagagactaggactgcaactcatgcttttttttcttttttctttttttttttttttttttttgctttccatttacttggtaaatattcctccatccctttattttgagccagtgtgtgtctctttacatgagatgggtctcctgaatacagcacattgatgggtcttgacactttattcaatttgccagtctgtgtcttttaattggggcttttagcccatttacttttaaagttaatattgttatgtgtgaatttgatcctgtcattatgatgctagctggtcattttgctcattagttgacgcagtttcttcatagcgttgatggtctttacaattcggtatgtttttgcagcgtctggtaccagttgtacctttccatgtttagcgcttccttcaggagctcttgtaaggcaggcctggtggtgacaaaatctctcagcatttgcttgtctgtaaaggattttatttttcctttgcttatgaagcttagtttggctggatatgaaattctggattgaaaattcatttctttaagaatgttgaatattggcccccagtctcttgtagcttgtagggtttctgcagagagatccgctgttagtctgatgggcttccatttgtgggtaacccaacctttctttctggctgcccttaactttttttccttcatttcaaccttggtgaatctgacaattatgtgtcttggggttgctcttctcgaggagtatctttgtggtgttctctgtatttcctgaatttgaatgttggcctgccttgctgtgttggggaagttcttccggataatgtcctgaagagtgttttccaacttggttccattctccccatcactttcaggtacaccaatcaaacatagatttggtcttttcacatagtcccatatttcttggaggctttgtttgtttcttttcacttttttctctaaacttgtcttctcgctttatttcattgaggtgatcttcagtctctgatatcctttcttccacttgatcgattcagctattgatacctgtgtatgcttcacgacattctcatgcagtgtttttcagcttcatcaggtcatttgtattcttctctaaactggttattttagttagcaatacctctaaccttttttcaaggttcttagcttccttccattgggttagaacatgctcctttagctcagaggagtttgttattacccaccttctgaagcctacttctgtcacttcgtcaaactcattctccatccggttttgttcccttgctggtgatgagttgtgattctttgaagaacgggcattctggtttttggaattttcagcctttttgcactggtttctccccatctttgtggatttatctacctttggtctttgatgttggtgaccttcagatggggtctcttagggtacatcctttttgttgatgctgatactattcttttctgtttgttagttttgcttttaacagtcaggcccctcagctgtaggtctgctggagtttgctggaggtccactccagaccctgtttgcctgggtatcaccagcggaggctgcagaacagcaaagattgctgcttgttccttcctctggaagcttcgtctcagagggtcatccgccagatgccaggcagagctctcctctgtgaggtgtctgtcggcccctactgggaggtgtctcccagacaggatacacaggggtcagggacccacttgaggaggcagtgtgtcccttagcagagctcgaacactgtgctgagagaaccactgctgtcttcagaactgtcaggcaaggacgtttaagtctgctgaagctgcgcccacagccacccctttccccaggtgctctgtccatggaagatgggggttttatctctaagtccctgactggggctgctggcttttttcagagatgctctgcccagagaagaggagtctagagaggcagtctggccgcagtggccttgctgagcttcggtgggctctgcccaggtcgaacttcccggtggctttgtttacactgtgaggcataaaccggctactgaagcctcagcagtggcggacacccctccgcctaccaagctgaagcatctcaggttgggctcagactgctgtgctggcagtgagaatttcaagtcagtggatcttagcttgctgggctccgtgggggtgggacccaccaagccagactacttggctccctgtcttcagccccttttccagggtggtgaatggttctgtttctctggcgttccaggtgccactggggtatgaaaaaataaaaattaaaaaaaaagcctgcagctagtttgatgtctgcccaaacagccacccagttttgtgcatgaaacccacagccctggtggggtaggcactggagggaatctcctggtctgccggttgcgaagaccgtgggaaaaacacagtatctgggctggagtgcactgttcctcctggcacggtttctcgtggcatcccttagataagggagagaattccccaaccccttgtgcttcccaggtgaggcaacacccaaccttgcttcagctcaccctctgtgggctgcacccactgtccaaccaggcccaatgagatgaactgggtacctcagttggaaatgcagaaatcaccggccttctacgtccatctcgctgggagctgtagactggagctgttcctattcggccatcttggcagcctccttacactgagggggattatttttaatacaagataaatagttgtttgtagggtgatggaaaaaatctagtacaagtgatgtcaataccaaagtggaaggacagtgttctgggaacaggatcttagactaagccaaaaggcttgggatctcatccacaaaataaacagtttgcctgaagtggtgggagtgtgggtgcctcatccataggaataggagacaagttagagcatatcggcacagatgtaggtaggtgtgtagatgctgtggtaggagcttcatagtgctgcttttctgattgcttctattttcttagcaaattaggaagtaattagctgaaagagaatgcaagggagtagaaaaaataaagtaggaaataatcatctagaaggaaaaagtccatcaactgagagagagataacggagaggggagaaggtatgaagtaatcatctaggtgagagggagagtgaatggacctgagagacagagagagagagaggctcactcaagttgtatagtgatcaagttaatgtgtttgtttttccagccactttttatctgcatggttgcaggcagagactcagtgacaaggtgaacttaactataaagagctgtagtttagccagaggagtttaacaaagcccaagaagaacaaggaaattgaagatgtatgcaaatatgtaatggtaataattggccatggaacttaaactgaataaggagggaagtagtgtttgttaaaggtcttgattatttgtatatgaaaagcaaaacaatctagtaaatacattgtgtaccactgaaatatttgtttcagactttgtagaattcctttgggatcctttgtcaacctcacagacaacaagtttaataacacattgcagagtgattcttgaagaacattccacttgtgaaaatgaagttagtaaaagcagacaggtaataatttctagagttgcgaactccatgatctatctctaaatcattataattttcttacagatcttggtttataaaagatgcagaagtgattatcagaaaactgtttgggggaaaacatatttacttttgatttatagaaactagactttttctcagactgcactgagatgaaaaaaaaattttttaaactggacttggctattttttatctttataataataagatgaaagaatataccttgatacttctcaacactgtgataggagtggtaatcattttaaattatagacatacatgtaaggacccagattatgactttcattcctattagcttacttttctctgttcagtgatctgatttgtgttctcatggcccaggcagccatctttcaggattatgaatatacactggccctgcagagatgaaccggtataaattcattagtgcaaattcatttcttctaaaggaagacaacaatactcattacctttgttcttttggcaaaaatccagtggcattgtggctttgcttgaacaatggtttcaaaattagactgacacttattgtattaactagttatttgtagtctaccaaataatagtagtctctttaaggattcaaagttcagtaaaacagatcttaatcttacaatgatctagaattgaattcagtgaacataagacatattggggaactttttagagtgatgttgctgagaatcttctcactctttcattgtagcatttttttttattgtttgttgatgagattgtagattcatgcagttttatgagtaaaccaattttaggttgagctttaggaaattaaggagaaattgacagactggagaatgcccggagtagaatgacagaggtggttgaaaagcaaggaggcatatcatattcatattatgagcaccattaagttttagcccttggaactgtgattacaaaggaggatagctgtaagaaatgaaagggagaaaagggataccagcctaattctgccttcaagaagcatgtaatctcagagaaaataagatgcacataaactgtaacttaaaactggaagtgaaaaggagaagtagggaagataacaaacacttatttaattccaattgtgtactaggcactctgtaaggtcttgtacctgtcatcttaatcccagcagccctatttaaaaaatgggtgatcgccaggtatggcagatcacgcctgtatatctgagtgctttgggaggctgaggcaggaggatctcttcaggccaagagttcaagaccagcctgggcatcatagcaagatccatctctaccaaaaaaataaaaattagctgggctcccccttgagcccaggagttgaagctgcattgagccttgattgtgccaccacactgcagcctgggcaacagcaaaaccctgtctcttaaaaggatgacagcctcattttatagatgaagaaaatgaatctttaaaactagttgtcacagtgctactatgaatgagcactaggatttgaacttggatagtctgcctctaaagcccaagtttgcctcactgaccatgttgcctccccttgagcagcatagataaagtactgtgtcttcaggagagagacaggagagagaggttaccttcagcagtggggataaggaaataatttatcttaggggtggcatttgaactgtggcttgagggaaagaataggatttcaacatgtggcaacagagagagaggcattttctgcttacctccaataggataaaaactcaagtaaaatagatggaaactgttgcaggaattagagatatttaatttgaaagatgtacagagagatgctgtttgtattcaaagaaggtatagatttattctgtgctgttatgcagcatagaaccaagattagtagttaaaagctacaaagaagcagatatataatcctgcatttgctttccatatagtattgtttagttataacctaaatgtaaatcattatgctttaccatttgttaaatactttcacattgtctcatttgatcctcataaccctgtgaaatgtatttattttaattgcatttttacagatgaagctggggcccagaagggttaagtcatttttgaaatacttgaatactaagtggtagacctggctctttgtgatcactgaagcccttcagcagtattatggattcactcatgaagtcttttttttttttttgaggcggagtcttgctctgtcacccaggctggagtgcagtggtgtgatcttggctcactgcaacctccgcctcccaggttcaagcaattctcctgcctcagcctcccgagtagctgggactacaggcacctgccaccatgcctggctaattttgtgtgcttttagtagagacggggtttcactgtattagccaggatggtattgatctcctgaccttgtgatccgcccacctcggcctcccaaagtgctgggattacaggcaaactcaagcagtttttataatggatgtttttattctgaaaccgctctgctgtgaatgtagaaaatgggttgttttcataagcaggagaatagattacatcagggttttcagtctcagcactacattggcatttggaacagataattttttgttgtgagggtttgtcctgtgcactatagtatgcttagcagcatccctggcttgtgcccactaggtggcagtagcactccccggtcttcacaaccaaaaatgtctacacattgtcaggtattccctagggatggcaaaatggcacttggtagagaatcacttacactatataatgccccatgttgctaagacagttcaccagtgggatcactccatttcttcagtgatgaaagagaatgaggttcaagaatgaaaattgagtcagacaacatagtttctgttttcaaagttagaaggaaatgctgtaagctaatgcctggtaataatagttttgattctgactaaaaatctaaagtaaattattatagaggaagattatgaatacttaaatttaaaaagcagtaattactataatctgtcattgataggattcccaaatacaaatgatacttaacattgtttattgaagcaaattgttattatgattgttcttagggattaaatggggaaatataagcttaagtaaacctaaaaaataatggccagtagggcattggctacctatggggagtctgttagtattagatatcttctcagctttgccctgttcaatatttttattgaactggataaggagttaaaatacatactaatgaaatgtgtcagtgacaaaaagctaggaattctgtaagacttgtggatggtagaattagaatccaagaagatttcaaaagattgtagaaaattgactgattcaagaaattgtgaaaaaataaatgcatgtcccacccatgcgtttaaaaattcaactatataagtaaaagatgagagagacacagttttgaagcagcataagtaagacagattataatcaataaacccagcgtgagtcagcagtgtcacttgagtaacagaaaacaggtacatgggagtttctcctagtatgtgtgtgctattttgagtaagaatggcatatttggtgataatacccacagattagaccttcctgggaatattgcatttaattttcggtgtaagcatattaagtggagagtgtcttaagatagtatgggaaagagaagatgtaaaaaaaaaaaaagtatgatattcatcttaaaatctagaaaattgtcatgtggaagtggggctagttctattctatatgatcccaagaagtaaaccaagaccaaggagtggaagctgtgggagggaaaagtttgttaactctcattgttaactgaaatctaatagtccaaagttatgggcagcctcaggagataatgatcccctatcagcaaatggttttagacatggctggtggaccatttagtagaaatgtgaaaataagtctaaacatcacttgggagttcagatagattttcagactcattttttgttttttcttttttatcaacagaatctatttcaaataaatcttacgcaatccgatacgcaaacacacatacagaagtaaaactgctcctactgttgtgagcacctgcctttattcttccccaaccatccccaacatttgtccaggccatcctgggattacctccatggatatagagaacagcataaaaaccattggcatcacacaagtgcctctttaaagctgtttcaaagtatatatatatacacaaagggttgtatgtgagtctgaaagtgtgattcagaatgcttgttaaaactgtttggagaaccttattttccatcaaacaaatgatgttatttaatacttagaaaagttaatatctcacggttttaaaatatgtgaatttatgggaggtttcttttcttttttttgtttttttttttttttttgacagaaccttactctgtcacccaggctggagtgcagtggtgcaatctcagctcactgcaacctccacctcctgtgttcaagcgattcttgtgcctcagcctgccaagcagctgggattacaagcatgtgccaccatgtgtggctaattttttctatttttagtagagacagggtttcaccatgttggccaggctggtctcaaactcctggcctcaagtgacccacccacctcagcctcccaaagtgctaggattacaggcatgagccacggcaaccggccagtgaatttatgttttgttttaaacaatttatttggaaatattaatactttgaaagaaaactttcatgaataagagtagtatttccatattccctttaccaagatttacttgtcattaatattttgccccattggctttatcattagcccttccattttaaatatatacatacaatatgttttctcctgagtactgagaacagggtgcatatttgttaagacaaggatattatgttatataaccagagtagttagcaatttcagtaaatttatcaacacttaatctaccatccatattccacttttgccagttgattcaataatgtcctttataacattttcaatagaactattttaagaaacaaaatttaaacaatatgggaacatttgtcaaggccagcatccaaaatcattaaaattaaatgaaaaaaatcaaagcagctttttttgtatcatgaacacctaactcagtaagttacataaactcagatgctattttttggagatactgtctagaaaatgcttttttttctttgaacagaattcagaatgtttaaagaatggagtaaaatacaactgagttttaatttttaacattaaataaatgttgatatatggccacttgaggaatatgttatagataattaagtggaaagagaaacgacttcaggtcatgctttttaagaaaaatatatttgaattctacatttatggataattcagttagtatatagtatgtgacagttgaatttgtgctgtatacattgtcattgacttaaaaattaacttttactctaatgtgtagtatgccatttttatttttcaaatatgaataagaatatcattatataaataatataaatattgctaatatatgaaaaaaataaacactcattgtctttcatcctagtacaaggattaataccatcgtaggatattttcatcctggcttttttttcaaagttataatcctaataggcatgtaagttagtatactacttctgcttaatgttatctcattgcgtatttatagttgtctgttactgtagtcatcataatcttcagctaaagtttatgatagattcactggagcgatgtaacatctccttaaaattccctgtgattgaatagtttggtcatttccaatttttttatgtacaaacaaaatggatttccctaagtggattttccaacaaaggacccacagctggagtatataaaagacttgtacaaatcagtaataaaaagacagaacctaatacaaaaaaatagcaatgttggcaagcagcttaattaggtactttgcaaaacggcttgccaagtggcaaataggaatatgaaaagatgcccaacagcacattactcaatgataattaaatgagaattaaaacaacaaaatgaaatatgactgcatacccactataattgcaaacattaaaaaacaagaaaatgccaattatcgtaagtatgtagtgaaacaggatttattttatactgcaggaatgatgtaaatgggatgccactattctagaaaccgtttggttttttgtacgtagttgaacgtatggacatgaactgtactccagccattccatttctatttatatacccattagaaatgtatgaccatgcatactaaatgacatgtacaagaatttttatggcagcattatttataatagccaccaaaccagaaatcacctaagtgttccatcaatagtattcatgcaacaaaatactatatagcaatgaaattgatccaactatacccatatgtagcaacatggataaataaggttttttttgtacccaattgatagttattttaacagctggttatgtgagtgtggataaatttgtactgcagttaaaattactttttttttggtaaatacatttctatcttctatcactgatgcttttcaaatttgtaataataggatttacttaaatccattgtttcaagaatgaaaaaggcagtagaagatgatgtttttattcctctgtatccaaagaggtaagcgctgttaatttctagattgttggaaatagctgatcatagaatacagatttgtttaagaatgcaatgcaaaagaaactacagtgttttattttttgttttgttttttgtgtttcttttttttttttcttttgagactgagtctcactctgtcgcccaggctggagtgcagtggcgcgatctcggctcactgcaagctccgcctcccaggttcacgccattctcctgcctcagcctcccatggctgggactacaggcgcccgccaccacgcccggctaattttttgtatatttagtagagatggggtttcaccatgttagccaggatggtctcgatctcctgaccttgtgatccgcccgccttggcctcccaaagtgctgggattacaggcgtgagccaccgcgcccggccaactatagtgttttcaaaacatgtgtacacatactctatgaggatgcaaattgagatttcaacaaatatttctcagtgacttacataaagccgtgctttatcttggcgcttagatgaattttgtttggttggttttggttttggttttacatatatcctaggaacatagcaggtgatatagagtggtaaagagcacacgtccactgttagtaggtatttttatgcacttgttttctcatctataaaataaggataaaattagtgcctacctcacaggatattagggagatgaagagaatgctcagaacacaacagggcctagcacagaggaagcacaatgctgaggaacgagaaactgcacctgtaaattctgcagtcactttaaattataaaacgagtatttgatgtatgatcataactttgctaagaagccatcagttataatgatgcatgaactgtagcaatccagtgagtagtgacaggatggaggagctttatggagggggaagaaaggaacctcaaagctttctgattcattttgaatcatgagatgtctacatgtaaaaattctgccttggtaaactttgtttataatgttttagataatgcattcacatggttcagatgtatgaatgtgatatattagttatttgtttataaatatatattttataaacatatttataaatatataaatatatattttataaacatatttataaatatataaatatatattttataaacatatttataaatatataaatatatattttataaacatatttataaatatataaatatatattttataaacatatttataaatatataaatatatattttataaataaatatatattttatttataaaataaaataaacaatctctatttatattccattaaggcttagtttggttggtttaaaagaaagtctgatcttaaactctggttctgaaagactaatagttctttgcattttctcttctctttcgtttgtttctaattagtgctgtagaaaacaaaacatcacctcattcaaagttccaagaaagacagttctggtcaggcctaaaggtgagcaaaaactgcaaaaatgaaaaggcaatttttgtaaaaatcctgtttactatagaacaaagaacaacaaacttcttctataagaattagatagtattttaggctttgtggtcacatggtctctgtcgaattactcaactctgccgctgtagcacaaaaacagtcatagtacataaacaaatgaacatggctgtttgaataaaacttatgaacactgaaatttgaatgtcatataatttcctcatggtacaaaatattttgtttaaagacagttttaaaacgtccttgaaaagtgttaaaaccattcttagctcacggaccctataaaaacaggcaacaggatggatttaacccacaagctatatagttggctaacccctggccttaaaattattgctaagtcagtggcagtagggatgagaaggagaagaaggttcaaacaatgtttgggaggaagcattgaaaggagtcgataactgatcaagggaagataagatctattttgtacataatgaagatatatgtgggacaaatagagatacagaggtctaggaggtggttggatacataagtctgaatttcaggagacagatctgagctagagatttgggagtccactacctgtaggtaatatttggagccatggtcatgaatggcaagctgcgtaaggagactggatgaagcatgagaagtaggccaaggacagaacctcgggaaatactaacagaagaggagaacatggaggcttcagggaatctgtagaatcaattatgagccttaggatgatcacaagagaatggcctcaaggaagctaaatgaaagattttcaagaatgaagaaaagagtgttaaatgccaccaaagagtattaagagaaagactgaaacactgtttattggatttgacaattagaaggatataggtgacctcaccaagagtagttttaatagtgtgaattaatatttgtcatgtggttgaatcagggaaaaggctttctgggaagagggaacaacatcaacaatgagataaaatgtgaaaaagcattacattttagtaaaacagcatgtagttcagcactcagagtaatgaatatagtactgcaaaaaaagaaacaccttaaaattcacagaaagatctgaatttagtagagggaaaggacaaccaatattttattagaatttattatggttacttaatccaagttatcttcaaactcaaaggtgattataaatctttatgtatcagaggaatgaagctctcagcgttgattgccttctcaaggtcacatgttggtaatggcggccctagttttgacagtagttctttatgaatcacgtggtcctgtggtcttatacttgatggcccccggctttgagagaaaatggattgggaaggaagattattgatctggaaaggctctagtgaagttatttgagatagatttggggatggttatcctagaaaatgaaaataagatgagcaaatacatggagtttggaaagaatcaagtatttattcagagatattgtattctaaaattgacagttccaacagggctaattgtagtgagaattttagtttgaccaactcttcatgtttgttagagactattacagtttctctttggagaaaaggtacatatttacttgatattttattttagctcttccgcaatattcttctttggaatggactccttacagatgacaccttgcaagaactaggactagggaagctgctaaatcgttaccttattatagcacttctcaatgccacacctgggccagatgtggttaaaaagtgcaaccaggtaagttgtgaaggaagactgattctaattttatcatttctaaaaaatttagctattaaaatctattatttagcaaaataattaaatgtgtggtactcatatatagacaaatgggccaggcacagtggctcatgcctgtaatcccagcactttgggaggctgaggcaggcggattgcgtgaggtcaggagtttgagaccagcctcaccaacatggtgaaactccgtctctactaaagatacaaaaattagccaggtgcggtggctaacacctgtaatcccagctacttgggtggctgaggcagaagaatcgcctgaacccaggaggcagacgttgcagtgagccgccattgcactccagcctgggtgacaagagcaaaactccatctcaaaaaaaaaaattgacaaatgaatttaacaaagctaaaatgcagagccgctcttctgtatttaagaaagagtatactggtttgaaatatccccagtagggaaaggaaaaattacttaataaatgatgctagatggctggctgtttacaaaaagaatgttaagtcctcacctctcactatacaccaaaaaaatttcaggtaaaattttaaaaaatgtaaaaatgaaactataaaatatactaagatggtaaatgactatatttgagagtgagggagttccttctaaacttaaaggcaaaagaagaaattatgagaaaaagtaataaatttgaaaaaatataaaactttagtggatcaaaaaggtattgggattaattgattattattaaaactggggaatgtgttcattgggctcattatactattctttctactgctgtttgtgtttgaaattttgtataatagaaagttagaaaagttaagaatctaggaaataaaaagttgttaacatgtaacaagtgttaatattcacattaaataaaaaagctctttacaatttagtaaataattcaaatgttctgactaaaaatggccaaaacacgtgcaacagtaaagtcacctaaaaggatatgtaaaactaaccttaaaatatgtgaaaataattaatagtactaataatcagagaaatggaaattatttataggaaggatatttacttgaccagttgtgttggcaaacattttttggcgttgttattttacttacgatttccagtgttataaacacaggaaaacaacagttccatcattgcaggggcaccattcactgtatgcagtgcagtggttctggaaaacagtctcctgcactgggggaaggagggatacagctcttttggagagtattttggcatgatggatacaaaacttttaaagcttatattctttgacttagccaaagtaagttaagtcaaaaattagagatgcacatatagattttaagtacaaagaatattgttatagcattatttataatagaaaatagttggaaacacctacatatccctaaaaacatgatggtcttctcataagataaaaatgtgaaaggaaaataaatctcagaacctgtctcagatacttttgggttcacaaaagttatgtttttgaagaatttttaagaatatgggaaaataattattttataattaaaaacacatacacactaaactgttcccagatagaatagggtccatctgcttgttcttgcagcccaataacaagatgcagacagactgggaaagaaaggagcttatttttgcaaccagttacagggaaaaggttgtagcaactcaccagaccaactgaaagttacaatttggttttttgttttgttttgttttgttttgttttgttttctttagcacttatatgcattctaagctccatgctacatgggagagtgcatctacaagtgagagtgtttcattcagtctgtacaatctaactaccgtctggggtctgtaaagctttctctaaagtcttggaaagttttttaatcttaagtgggccctggtacaaagagtatgtgtaagaatgctttcattatttgatcagactttaggatctgggaaaactcaggcagggtcttaatgggtttgttttcgcattccagttcttgtactcaggcaccagtttctctagctctttaatgtttaacttacacattcatcaaaattatagaaaagggttagtggaaattgattcatctggttgctaatggaaacctagtctgccataaaactatatatcaattagtagccaaccatgattgttctggctatagtttttatatcatagttttaagcattatatattaaaaatttaaatcatcatccatgtaatgttgttcaggtttagtttagtcccctttgaccatagggtctattatgaagtggagaagaggaaatatatttacacagcattctttccacagcatatggttagaaaaccaggccaagaaaatcgacttttagtgctgggatcattaacgcaaaagctacatggttaaatgagaattttactgagacttgtaatacaaaacaaggggaaaacaagtgcaaatgacattcaatagtaaagggtggttttaaaacttttaaaaagagtttacataacaaaacttgtaggatcttctgccttaggcagtcagtgtgtcagtatttttcctgaatagttgaaacaggtgattaaggagtagaattctttttcctcaaccatgttttaaatgctgaccaatcttagaaagagcgcattccagaacgtttatttaatatactgtataatatatagggtgcattttaattttttccccaactctctgctttctatattgatcttgatgttaccaaatgtagcataatctgtatgattatctaggaatttccttgaatagtgtgatattgtgacaggccaggtttccattagcaaacagaacgatcagtttccaagaacccgttactataacgttaatgaaagtgtaagctaaacattaaaaaactggagaaactggtgcctgagtacaaaactggaatgcaaaaaccaacccattaagaacctgcctgggttttctcagcccctgaaatctgatggaataataaaagcattcttacacatacacctcattctgtcttaagattaagaaactttccaagactctcgagaaagctttccagaccctagtccctagctaaagatgagatagagattgaatgcaacactcccacttgcagttacaatcccacacgtagcacggagctttaaatatatacaagcactagaaaaaagcttagaactttgagttggtctggtgagttactctgacctcccttctttcccaattgtctgcatctcgttttcggacctcaagagcaggcagccatactttgttctctccgggaacaatatcaagtttttttcctttctccccttttccctcccttctttacccttgtttctgctatgaggaagttttttttttttttactttttaaattttttctaacatttttctgtttttaccaaaacttttctcaaaatcttgtattactcttaggatgacaatgataaaatgtaatttccatttccaaaagaaaaattgaatgcacctacattgattcattctgctgctttacaattaaggcaatgtattacactgatagaagattaaaaacataattaatttatctttcattctttgtatcttagaatcacccatttggttccttaactccatatagatcatatgctaggccatccaatttctttataaaataatagtgaatgtatgtattttagagttgtattgaccaaatattttgtgtctagacatttttggtttttagttgtaaattatgttttgtacagatttaatgactcacaaatacaagaatatagaaagaattactagtactaccagggagtgttcatagagagtagtgtattttaagttcttagcattaaagaatgaattccaaaatatatgtagccttggacacaaagggaaatctttagaaatttttatttaaccataaactataaaatggggagaatgatactcagcttacagtatcactatgagattatattagcaagatttcttagataactgtcattgtaaaccagccatgtgttttgattaacaggtagcagcatgtctaccagaaaaatggtttgaaaattctgccatgaggacatctattccacagctagaaaacttcattcagtttttattgcagtctgcacataaattatctagaagtgaattcaggtaatgcatattttattttcacttctataaagagagttcatggattctgtatgctctcaacaacttttagaaagatttgtatttttactgtacttttaaaaatttgttaaaactttgtagagttagtagatatttttatggttacctttgggatggcttatgcatatccatattttaaaatgtaaatctcccccaaattaagcaaattcaaaaaactatagcacaggggaatatagaattaaaactataaatcaaaaacattttattaagcactttttaaatgtgtttttaattttcctgtccatttttagagactcaacagttgttaagtacaggtctccagcttggtatttatccagcagtagctagctctctgttctgaatgtttcgttcacagcaccagctgtttgggggcttaaatacagtggtattcctgttaactccctctccaaaaaaaatttttaagcccagatttggccgggcatggtggctcacgcctgtaatgttagcactttgggaggctgaggcaggaggatcacttgagcccaggagtttgagaacagcctgggaaacatagcaagaccctgtctctagaacaaaaaatttaaaaattagctaggcatggtggcatgcgcctgagtcccagctactgaggatgcagaggtgggaagattgcttgagcctgagaggttgaggctgcagtgagctatgattgtgccactgtactccagtctgaccagcagagccaagaccaagtccctttaaaaaaaaaaaaaatcagatttgtattatttgctaatgtcatgatgtgtgaatatactcccaccattgcttccaccacaatgtctcatacaagctaatagcaacgcagcactactgaaatttctgatagacttactatatgcttttctaccttttacagtaattcacattgaaatttgccagaatacatccactaatgatctgtatttgaactttataattaagtggagatggcagcatctctctgtgttttatgctactttagatattggcttaaggtaaagcttttgttttagattaacaactgatgatcaggttctgaattgaccgctgttccctcatacattgcatttttaaagggagaaatttgttttgtttttcagggatgaagtcgaagaaataattcttattttggtgaaaataaaagctttgaatcaagcagaatccttcataggagagcatcacctagaccatcttaaatcactaattaaagaagattgaataaactttattggaaaatgctaaaattttaatatagttacactcagttcctttgtttgagaagaagctggtgcctctctcttctttattccctgtaatagaaggtaggatttgaaaaaaagcaggactccacctctgtattcccccgtgctttaccttctggcatcatgaaaagctgccatgattctgtggtgttctaaggaattaaatgcactggagctttaagagctcaacgtgtttccctttgattcttttggctggtctttcaattttcttaagaggggaactggagaaaccttgctaaaggttttagcttaagtgagcatgctactaagtcttctgtcctgaaccacaataatatcttttagttctctttaactacctttatttaaaaataagtcaatatgaaaatctcagttggagtgaattatttgctaagtattaaatgattaaggcatgtgccgattgtcaaattatccttcagaaatctgtaccaatttaatgtaccaacataagcataagtgagtgccaatgaatccctaccagcagtagttattatcctttttaaaaatgcattgaaaatttgaaaggtaaaaatcttattttaatagcgtattttgtgttggctattagagagtaaacatattggttttggccatttgtaattatttctgaaatatccatctttttcttatggactttaagacctttatatttttaaagatattgattttttgcccatgcttgtggcagaagttttccttatttgccatttttcttttattttttttttaattgtattttttgagacagggtctggctctgtcacccaggctggagagtagtggcacaatctcggctcactgcaacctctgccttctgggctcaagcaatcctcccacttcaacctcccaagtagctgggactataggcatgcgccaccatgcccagctgatttttgtaattttttgtagagatggggtttcgtgacattgcccaggctggtctcgaactcttgagctcaagcagtctacccaccttgacctcccaaagtgctgggattacaggcttgagcaaccatgtttggcctttcttttaaatttgttgatgttttttgaagcattaagtcattacttattagcaagttactattttgtttttttgtcattggtggtaggactaagaaggaaacagatattttaaatactcacaacatgtgattcattttctgataaaatatttgtctaataaaacagaggcaagataatttaatcaaaagaaattaagaaaattttccaaaaatgttagtttactagtaatttttctaagtctacttattaaataacttaagggaaactgtaaatatattttgcaaattgttgttcaaaagataattggaaaaaattgaatatattgtaggatttgaatatacagcctacttttatgtcacctctaccttcaaaactacatataatttattttaggagttggatttgttatgtctgttgcagtgaggacttgtgattcactggtatgaagaattttttgatgtttatattagtaacaaaattatacaaggatagaatctcatctagaaaatgcaaactattgttgaaaagcagttagcatttccacacaaccgctgtccccagagataactgctgttttcattttaatgttatccttttagaccttttctctatttacaaaaatgttacgtgtttctatgtgtacatagttttgggttttttttttttttttacgtaagtggcagacactttattgcacatgaaatttgtaatttttttctatttaagtacacatttggaaattatcctctgacttttggatttttaactaaatatgttggacgtgttcctttatatatttaagttcagcacagaaactttcctacctttttgtggaagataaaatattaaaactgctttcaaaactacaaattgacttaaactgctatagtaattttcaattaaatttcattatacctggagtttgaacgttaaggtttttatcatatactgtaattcaaaaatttacctaaatctcaatgtaaaattcttttttttcttattactatgaaatggatggaataaggagggggaacacaactagcaagaacaaaacattgggttggcaattgatatcacatcttaattctttccctgaatttctttcagctttttgttcacataaagaatgtgaaatttttacagaatcagacagatgactttaaagaaatttttttcatgatggaaaaatcacctcaattgatttttccatttcttaggtccttgaataaatgatacttaggtatacctcagaaatgccatatatgatacaaatcctgcaaaagacatcatgagaaaataccagcagtatctatcatgaatgtagaaataaaagtccttaaaataattagcaaatcaaatccagcaatgtataaaaaagataatagggtttattcctggaaagtaagg

SEQ ID NO: 38129 - DNA, 14324 bp, Homo sapiens; identical to SEQ ID NO: 35841

SEQ ID NO: 38130 - DNA, 23327 bp, Homo sapiens; identical to SEQ ID NO: 37295

SEQ ID NO: 38131 - DNA, 5138 bp, Homo sapiens
aagttgcttttgtccaaacatccgggcttctcctttttgtgttccggccgatcccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaaaacatccaggtaatggccccaaggcaccagctgccagcagccggagggccggcgatgtccagaagtgtcttggggattccccctctgggcctggaagtccgctccatttacaaaactctcttctttgggtcttcgtgcacactaaagtcagtgggattaacattgacctgaaagggccagactactactccagcctgaggatctcgggtttcagggcccgcccgaggcattaggaagaaggtattcttggaacaagttaggaggttggtcggggtaaggcatggagtggggttgggtgggattcactggcattcgctgaaaacatactatgtgtatagttttgtttggggcttaggaaagaaggaaatgggcactttttcagccttttagtctttgataggtaacataggagaaagacatgaatggaagactagtaggtttcccaggctagaaaagatagccaaagctagaaaccaggcgttctgagagcatatgagggggaatggagtggcatgatctgtagtgattccaagccgtatcctcagcagtggaagaacaaagccctaaaccctgggatgagcagaggacttaatggatggaacagaaaagtcctgcactctaggagccattgtcttcacagggcggaggctcagctgtgattgacatggagaacatggatgatacctcaggctctagcttcgaggatatgggtgagctgcatcagcgcctgcgcgaggaagaagtagacgctgatgcagctgatgcagctgctgctgaagaggaggatggagagttcctgggcatgaagggctttaagggacagctgagccggcaggtggcagatcaggtaagcaagattgaatcctctgcaggtagaaaagtagacctaggtatgtcccgtgttctggaattggtgttggtgatgttcgccccaggttgtccagttagaaccatgtagaaatcaaacggaaaataggcaacaggatctagaaccaacagtaccacaatacctatgcccatcttccttacttcagatgtggcaggctgggaaaagacaagcctccagggccttcagcttgtacgccaacatcgacatcctcagaccctactttgatgtggagcctgctcaggtgcgaagcaggtgaggagccttctcttgaagaagcttccctcctaacacctagaccttcatgcacactacagtcagatttcaagccctgggctctgatgggctccccgtcttcatgaccccatcacctctcatcactgcacctgtcactgaaacaagtaataatagcacaccatcttcctcttcttttccatctaactgactactcatcttccctcaaaacctacctcagatgtcacttcctctgttccacattcctcaatcccatccccagtttgttctctcctggtgttcctatagaactctgtgcttgccagccgggcatggtggctcacgcctggaatcccagcactttgggaggccgaggcgggcggatcacaaggtcaggagatcgagaccatcctggctaacacggtgaaaccctgtctctactaaaaatgcaaaaaaaattagacaggcgggtgcccgtagtcccagctactcgggaggctgaggcaggagaatggcatgaacctgggaggcggaggcggagcttgcagtgagccgagatcgtgccactgcacttcagcctgagcaacaaagtgagactccatctcaaaaaaaaaaaaaaaagaactctgcgcttgcctctaatagacagcacttcaccactgctatcctttcttattcctggaatcttccttccagagaccaacagcatctcaaaagcaggctctgtcttgtttatctttttattcccagcaccagaacagtctcagaatcaaaatatcagggcatagtttttgagtgacttttcaagaactagatttaatcctggcttggtttttttgttcatcctttaatcaatgctaatcaaatacccaggaccactcagcaggtatttattaagcatttgctctgtgccagacgctaaactaatcgtatctggttcagtggtgaagatagatgggagccttgctcttgagtgcagttacagtacagtactcattctatgatggggcacacaggagggatatgtgagccaaagcaggttggtgggtgggacaggacaagtttcccagaggaagtaaaacctagctaaaatcccaggtatgattaggagctagccacttgagagaagagggaagtgactaaattttcataccacttcacatatatttttcaagaaaatactcgaaagtgcctggaggcacagataagcaggaagaggaggcgtttttactattccctcagtaacacctttcattctaaactttccatctagccggctagacttttcccagggcttcctcattataaccctgaattctgggtactctctgctgaggtctgcctgtcttgtcatgtctttgttttgttttgttttgagatggagtcgcactctgtcacccaggctggagtgcagtggcgcgatctcggttcactgcaacctccgcttcccgggttcaggcaattctcctgcctcagcctcctgagtagctgggactacaggcgcccgccaccatgcccagctaattttttgtatttttcgtagagacagggtttcaccatattggccaggctggcctcaaactcctgaccttgtgatctgcctgcctcggcctcccaaagtgctgggattacaggcgtgagccaccgcgcccagcctgcctgtcttttcaaggggagggggcagacggatacatggtcgggccctccttcaaggcccagtagggctgagttctccatatagctgctgtttcagtcagctaagtttcagagggttgtccttcctggaagtaactttaggggcaaggaaatgatttcctcattccctatctgtctttactaccctgttctaccgtgtcatccaacatgtcttctaggccaggccccattccctggagttagagatgaataaaattcaggccttgccctccagaacctcatggccttgtgctgcctttgctttaatctctcctctcctctcccaggctcctggagtccatgatccctatcaagatggtcaacttcccccaggtgaatagagggtggcatgtctggagagccgggggaagcaccagggcagagggtgggaccaccaggcaaatcctgggaagccataaacagatgagctgttgtaccctccagcctgaatgaattggtatattgacagaaaattgcaggtgaactctatggacctctcatgctggtcttcactctggttgctatcctactccatgggatgaagacgtctgacactattatcgtaagcaggacagacaactttgggggggtggctgcactaggttgaaagctgcctgaggatacaatggtggagtgagacaggaacagcccctgcggaaggccctaggtgaggctgagatcagaggcctcctaggactaaatagagccttcaccccacagcgggagggcaccctgatgggcacagccattggcacctgcttcggctactggctgggagtctcatccttcatttacttccttgcctacctgtgcaacgcccagatcaccatgctgcagatgttggcactgctggtaaggagccaggtgtggtgggcaagagtgatgttaaaaagagtagccaggccttggtcggcatctgtcctggggccccaaagcctggaatgggaggagtaggccaatggaccatgtgtttcccagggtccccatgaggggccagaaagcagcccaacctgaatgattttcctctccaccatcctccttcccagggctatggcctctttgggcattgcattgtcctgttcatcacctataatatccacctccacgccctcttctacctcttctggctgttggtgggtggactgtccacactgcgcatggtaagctgggcaagaggcttccaggggtgggctgtcctcccagggagttggggaagacagcctggagctgtccatctcacaaagagccctaaatgggagggaagagcccaaagatggttctgccctgggtgggggtgtcttgtccccactcctcactttggagccaggccctttgagctgtattctcatggtcctaggtagcagtgttggtgtctcggaccgtgggccccacacagcggctgctcctctgtggcaccctggctgccctacacatgctcttcctgctctatctgcattttgcctaccacaaagtggtagagggtaagtggcaggaaggtctgggtgggggagaatgggaaagcagctgcctagagcaagaagctagatatgatggctggtgggctgggcccatctgatcctcgctcaccttccatcttccttccagggatcctggacacactggagggccccaacatcccgcccatccagagggtccccagagacatccctgccatgctccctgctgctcggcttcccaccaccgtcctcaacgccacagccaaagctgttgcggtgaccctgcagtcacactgaccccacctgaaattcttggccagtcctctttcccgcagctgcagagaggaggaagactattaaaggacagtcctgatgacatgtttcgtagatggggtttgcagctgccactgagctgtagctgcgtaagtacctccttgatgcctgtcggcacttctgaaaggcacaaggccaagaactcctggccaggactgcaaggctctgcagccaatgcagaaaatgggtcagctcctttgagaacccctccccacctaccccttccttcctctttatctctcccacattgtcttgctaaatatagacttggtaattaaaatgttgattgaagtctggaactgca

SEQ ID NO: 38132 - DNA, 44639 bp, Homo sapiens
agaagaagaggaagtgaaggctacagggtatccacgtgggttctgagcgtgtttctacgtccctggaagccggtcatttaagctcattcctcgccacggcttagtcaacatgggtcgctcgggaaagttgccttctggtgtctcagctaagttgaagcgctggaagaaaggccacagcagcgacagcaaccccgccatctgccgccaccgtcaggccgcccgcagccgcttcttcagccggccgtcaggtagctgggttgagacccgagcgcagccgggggcggggttccaggcagacctgggtccagatgagtctggggcctctgggagagtgcggggccaggcattggacctttcgtctcttaggatgtcggatctggagccctctctgaagggcagtccttccaatttagcagatacagaaactgaggtccgcagtagggaaatgtcttgtgtaaggtaccgcgggtgtcagagttgagacagatggcttggaccttgggtagctctttacagagcgcgttcaccttcatttattttgcaggccctctgaatgtagctcccagccgattcccagtggcgtttatgccgctgctacagggaagcagaaacttttacatggaggattccctttctccttggtttttcaagtttttaggcatacagtggttttatgagactggctgtgttcagaattcagcctctcgggttggagatttggcctgggctggtttgtttcccaggggttgttctgttctcttgaccaaaaggaggcttggaccttatcttgtgcctctggctctcaggaaggagtgacctgacagtcgatgctgtgaagttacataatgagctgcagtcagggtccttgcgcttgggcaaaagcgaagccccggagacgcccatggaagaagaggcggagctggttctcaccgagaagtcctcgggtaccttcctgagtggcctttccgactgcacaaacgtcaccttcagcaaagtacagcgcttctgggagtccaactcggctgcccacaaggaggtaggggcgagggtcgggagggccataggatagtgaggagaggccaactcatgccttttcttcagctctggccgacaggtctccgatgacaacagctggtatttctggatgatgcgtcatcgctcctcccctttatgtctcctcctagggcaggttctactttctgctttttataagaacatctcctctgcttaagtacttgagggtagaaatattttccaaacatttctctcctcagctatacctaacacagcacttttacacagagtattttcaataaacatatgttgagtaaataaatgctgagtaacagtgattaggaaacgttttatctagcaagaactaaatttatttactttaatttaacttaattcatgtatttattttgagacagagtctcgttctgttggccaggctggagtgcagtagcgcaatcttcactcactgcaacctccatctcccaggcccaagcaatcctcctgcctcagcctcccaagtagctgccattacaggcatgtgccaccacgcccggctaatttttttttttttttttttagtatatttaaatagtgcattattcaagtagctaattttttgtgtgtgtgtatttttagtagagacggggtttcaccatgttagccaggctggtctcaaactcctgaactcaggtaatccgcccaccttggcctcctaaaatgctgggattacaggcatgagccaccgtgcctggccttacttttattattttatctatactataaagttatatatattttttgttattgaaataaaaaatgtcaaaattctaaatgatatcaaaatgatataagaataatataatgtgatggtagatcccccaacttgaatcattcacagagctcctgttaatgggtcattgtctgtcttcctggaccagctctgtccaatagtaatctaaattcaagccacatatgtaatttaaaaatgtttagtagccatattaaaaactgaaagaaacaggtaaaataaattcatctttttatttttttctggagccggagtttcgctcttgttgtccaggctagagtgcaatggcacgatctcggctcactgcaacctccgcctcctgggttcaggtgattctcctgcctcagcctcccgagtagctgggattagaggcgtgcgccaccatgcccggctaattttctgtttttaatagagacagggtttctccatgttggtcaggctggtctcaaactcctgacctcaggtgatccacccgcctcggcctcctaaagtgctgggattacaggtgtgagccactgcgcccggcccaaattaatcttaataatgtactttatttaactcagtatctttaaaatattatcacttcaatgtataatcagtatattttactacagcattatttttatgataccaagtcttcaaaatctagtgtataatttacccatatacccctacttagatgctaaattttcattggaaatacttgatttgtgtctatttagagttcataacatttatggttgtacaagtagatttgcctactatgaattactacgaacctatttgccaggttgttacaaatatatgttttctagtaaatagatcaaatattttaaattatgagtagttgaaatttaaaaactaaattttcaggctggacatagtggcttacacctgtaatcctagcactttgggaggccgaggtgggcagatcatttgaggtcaagagtttgagaccagcctggccaacatggtgaaaacccatctctactaaaaaattagcctggcatggtggcatgcgcctgtaatcccagctacttgggaagctgaggcacgagaatcacttgaaccctggaggcagaggttgcagcgacccaagatcgcaccactgcgcttcagcctgggtgacagaacgagactctgtctcaaaaaaaaaaaaaaaaaaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcaacagagcgagactccatctcaaaaaaaaaaaaaaaaaaaaaaaaaatacgtatatatatatacatatatatatatatatgtatatatatatacgtatttttttttacccaattttgttatttaggtttaccaaaatgtgattagtttcttttcttttcttttcttttttttcagacagagtctcactttgtcacccaggttagagtgcagtggctgatcagccttccaattcccaagtagctgggactacaggggagtgctaccataccaagctaatttttgtattttttgtagagatggggtttgccatattgcccagattggtcttgaactcctgggctcaagggatctgcccacctgagcctcccaaagtgttgggattactggtgtgagccattgtgccctgcttgattagtttattttttatccactgttctgcaactttttccctactgaacgatatttataagttaatatatagttgttctcattcttttgaataatgcactatttaaatttttcattattatataatgatacagtcaggtctctatatttgcgggttctgcacctgcagattcaaccaagcatggattgaaaaatctttttaaaataataataatataccaggcgaggtggctcacgcctgtaatcctagcactttgggaggccgaggcgggcagatcacttgaggtcagaagttcaaaaccaacctggccagcatggtgaaactccatccctactaaaagtacaaaaaattagcctagcgtagtggcacatgcctgtaatcccagctactcaggaggctgaggcaggagaatcgcttgaacccgggaggtggaagctgcggttagcagagagtgcgccactgcattccaccctgggtgacagagtgagactctgtctcaaaaacaacaacaacaacaacaacaacaaaaatacagtataacaactatttatatagcatttacattgtgttaggtgttaccagtaatctagagatgatttaaagtatatgggaggccaggcatggtggcttatgcctgtaatctcagcactttgggaggctaaggagggcagatcacttgaggccaggagttcaaaaccagcttggtcaacatggtaaaaccccatctctactaaaaatacagaaattagctgggcatggtggtgcacacctgtaatcccagctacttgggaggctgaggcaggagaattgcttgaacccagaggcagaggttgcagtgagctgagatcatgccactgcactcttgcctagctaacagtgagactctatctcaaaaaaaataaataaagtatatgggaagatgtatataggttatacacaaatactacaccattttttataagggacctgagcatcctcggattttggtatctttaggggtcctggaaccaatccccccctcgataactgcagtacattagagacaactacagtacattattaatctcctgttgatggcttcttgaccattccaatttgttgctgccatgaacatccttgtacataaatatttgcacactcatctcatgcaggtatttctagaaggttagtacctcatggtggaattttagcaagcattttctgagtcttgttatttgctgggccccctggtatggacctaggccctgaatgttgcctgtcttgtctgtctctgggctttaaccagagattaatctgtgaaggagcaaggaaaggaggttcccctggggtggggttaggtctaaaatagtcacagtgctttctccctcctgtgcagatctgtgctgttctggctgctgtcactgaggtgattcgctcccagggagggaaggagacggagactgagtacttcgctgctctggtgagtgggtgccactggagggtgggtgttcagagcagcaggttatgcaagatttagcgagaagatgagtgcccctggcatgtgggggtagagaaggacaaccttgaccaggtgaaagtgcttcagttattctcaggtggcttaggaaggctggtggtatttgctaccttttaattttctcttttcttttctttctttctttgtttcttttttttaaagagacagggtctcactatgttgtccaggctggtttcaaattcctgggctcaaaccgtcttgtcatcttgcggtggcctcccaaattgttgggattacaggcatgagccactgcaactggctacttattactttttttttttttttttttgaggcggagtctcacactgtcgcccaggctggagtgcaatggcatgttctcaacttattgcaacctctgcctcctgggttcatgtgattctcctgcctcagcctcccgagtagctgggattacaggtgcacaccaccatacccggcttattttttgtattttttagtagagaagaggttttactatgttggccagacttgtctcgaactcctgacctcgtgatctgcctgcctcagcctcccaaagtgctgggattataggcctgagccaccaggcctggtctacttttttttttttttgaaacagagtctcactccgttgcccaagttggactgcagtggcacgatcccagttcactgcaacctctgtctcatggtatcaagcaattctcatgcctcagcctcctgagtacctgggattacaggcgtgcgccaccacacctggctgatttttgtatttttagtagagacagggtttcaccatgttggcccggctggtctcgaactcgcaacctcaggtgatcccccctacctcagcctcccaaagtgctggaattacaggtgtgagccaccatggctggcctacttattacattaaataaataaatatatttgtgtatgtatgtatgtgtgtgtgtgtgtgtatatgtgtatatatatactttttattttgtttttgggtttttttgttgttgtttgttttgttttggagacagggtctcactttgttgcccaggctggagtgcagtggtgtgatcatggctcactgcaacctccacctcctgtgttcaagtgatgatcgtgccttagcctcctgagtagttggaattacaggcgcctgccaccatgcccagctaatttttgtatttttagtagagacagagtttcgtcatgtcgcccaagcttgtcttgagctcctgagctgaatcagttctcccactttggcctcccaaagtgctgggattacaggcatgagccaccatgcccagcctggttattacatttttaaagaattgttaaaacacacacaaaaagaacatacaacagagaccaagtgtgcatgcaaagccgaaaatatttactatctggtccttcgtagaaaaagtttgccaacctctgctctagaataatgaaataaattagatggcagtatatggtgtttggctgggtgtggtggctcacgcctttaatcctaggactttgggaggccaagatcggaggagtgcttgaggctaggagttcgacaccagcctgtgcaatatagtgggaccctgtctctacaaaaaataaaataattagccaagctttgtggcgcatgcctgtagttctagctgcttgggaagttgatgtgggaggatctcttgagctttgaagttcaaggttacagtgagctatgattataccactgcactccaacctgggagaccctgtctctcaaaaaaactatctatctatctctgtatatatatgcacataaacatatatatagtttatttatttattttttttgagacggagtctcactctgtcacccagactggagtgcagtggcacgatctcagctcattgcaagctctgcctcctgggttcacgccattctcctgcctcagcctcccgagtagctgggactacaggcgcccgccaccatgcctggctaattttttgtattttttagtagagacggtgtttcaccgtgttagccaggatggtctcggtctcctgacctcgtgatctgccctcctcggcctcccaaagtgctgggattacaggcgtgagccaccacgcccagccacatatatatagttttaattatgtgtcaggcagtattttatatatattaattcaattaaacctcacaacaacgtataaggtatgtagcattagtatccctactttacaaatgaagaaactgagtcacagataggttaaattactagcccaaaaccacacaatgccagagtcaggatctgaacctctgataccgtggttctcagtcacaactgttctgctgggcacatgttcccccactctctttcctgtttgctcagtgtaagtttttatccattcaaaccccctcaatctggccctcagatgacaacaatggaagcagtggagtccccggagtccctggccgccgttgcttacctgctgaaccttgtcctgaagcggtgagttctgcctcctgtttgaaccccaaggctttttgtggaggggagaagggaatgtggacaggagaaacaggatcagggaattgttatttaaaaagatacttgctcttcatgaacattgtctagaggcatgcagaatgggccagcatgtgacataccgtcgtaggcctctagtgagaaactctaactaaactaggctgtcctgaacccctggtaatagaatcatttacctttatgccaagaaggttgggaaagcaccaaaatcttcacgtggtgtgtgtccaggcagacattcaggagctcgtgctgtgagatctaaagttgttatttgatagtccaaaacaaaaggcatgtctatagggcctgcagtgcttccctggttccatgtgtgctcagtgtgttcatgacagaatcaagtgtgctttccttattgaggagcagaaaatcattgtgaaagtgttgaaggcaaaagcagagtcagaaagctctattgaaaatgaaacttttttggcctggtgcggtggttcacacctataatcccagcactttgggtggccgaggcaggcagatcaagaggtcaggagatcgagaccatcctggccaacatggtgaaaccccgcctctactaaaaatataaaaattagctgggtaggctacatgctgtggctcacgcctgtaatcccagcactttgggaggctgaggtgggcagatcgcctgtaatcccagcactttgggaggctgaggtgggcagatcacctgaggtcaggagttcgagaccaaactggccaacatggtgaaaccccgtccctactaaaaacacaaaaattagctgggcatggtggcaggtgcctgtaattcagctactcgggaggctgaggcaggagaattgcttgaacccagtaggcagaggtagcagtgagctgagatcatgccattgcacttacagccctgtcaacagtgcaagactccgtctcaaaaaaaaaaaaatagaaagaaaatgaaatttgttttgagtaataaaaattaaaagtcatggctggacgcagtggctcatacctgtaatcccagcacttttggaggctgaggcaggaggattgcttgcggccaggagttggagaccagcctggccaacatggtgaaacccgatctctactaaaaatacaaaattagccaggtgtagtggtacatgcctgtaatcccagctacttgggaggctgaggcaggagaatcacttgaacacagaatgtggaggttgcattgagccaagatcaagccactgcagtccagcctgggcaacagagtgagactccatctcaataaataaataagtaataaagtaaaaaataaaaaaccttgattctttaagatgaaaaagttcttgagattggttgcacaacaatgtgagtatacttggctgggtgtggtgacacatacctataatcccagcactttgggaggctgaggcaggtggactgttgagcccaggagttcgaaaccagcctgggcaacatggcaaaaccttgtctctacaaaaaaatacaaaaatgagctaggcgtggtggcatgcacctgtagtcccaactacttgggaggtagaggttgcagtgagcctaattgtgccactacactccagcttgggtgacgagtgagaccctgtctccaaaaaaagaaaaaaaaaaaacccacaacatgaatatacttaacagtactgaatgatataccgaaaaatatcgttgaaatggtgtgttgtttttttcctttttgagacagagtctcgctctgttgcccaggctggagtgcagtggcgccacctcctcccactgcaactccacctcctgggttcacaccgttctcgtgcctcagcctgtcaagtagctgggactacaggcgcccgccaccacgtctggctaattgtttgtatttttagtagagaccgggtttcactgtgttagccaggatggtctcgatctcctgacctcatgatccacccgcctcggcctcccaaactgctgggattacaggcgtgagccactgcgtccggccgaaatgatgttttatcttatgtgtattttaccacaattagaaatttatttatttatttatttatttttgagacagagtttcgctcttgttgcccaggctagagtgcaatggtgcaatctcagctcaccacaccctccacctcccgggttcaagtgattctcctgccttggcctcccaagtagctgggattacaggcgggcgccatcacgcccagctaattttgtatttttagtagatacagggtttctccatgtttgtcaggctggtctcaaactcccgacctcaggttatctgcccaccttggcctcccatagtgctgggattacaggcgtgagccaccatgcctggccagaaattttaaaatacaatttaaaagatacttgtatatcaggtggcattctacaacataaggtcctgggtgactgggtcattataccagggagtgtgagtgttggcccccagaaggggcattcctggagcagtgagtggcagaagggagggaaggagtagttggccccaggctttctggagatgtgaactgccaggggaggtggagagaggattggtgtcctgagtttaggagtgggtagtgggaaggtgagagaggcagggatcccgggtggaaagcacactgagctggctgataaggtgggtgcctattctgactttgttgctcactttctgagtgactgtgccaccagcgccccttgccctgtcctccttagtaccacgaggggctgcaccagctgctcttcagggaccctctggggtgaccatctctgttctttcccacagtgttcccagccctgtgcttattaagaagttctctgatacctccaaagccttcatggatatcatgtcagctcaggccagcagcggctccacctctgtcctccgatgggttagtgtctggggtttagtttctcatctggcgactcccagagcctgtctgatttggtgatgcttagatgttccctgagaggggtttaggcaccctggggacctcagacagatgcgattttctggagtcagtgagaacctgggctcttttccctcctggccgaggctggtggcactgagggactctgactttcttccaggtcctttcctgcctggccacccttctgcggaagcaagacctggaggcctggggctaccccgtgacccttcaggtgtaccatgggctgctgagcttcacggtgcatcccaagcccaaggtgagactactagctccctagaaaatggggcaaggggacagccaccactcagcccagtgcagcccagacttggctagctgagtggcactggggagcttgccctgagtactggcttctgctttctgcttctgaggcaccatgcatttagatgcagaaggcagggcggctcttcctcctccaggaggctgttccctgtcagccctatctgagtctctggtgcctcatcagccattgccctgttgacgtggactctccccatatgtctatttacctcggcagggagggtggcatagttgggggagtcacacagacctgagttggatcctgaattcactgctcgaggtgtgaccttgggcaagttacttaatctctctgagcctcaacttcctgactatgaaatagagataattggctgaatgtggtggctcacgcctgtaatcccagcactttgggaggccaaagtgggaggatcatttgaggtcgggagtttgaaaccagcctggccaacatagtgaaacctcgactctactaaaaatataaaaattagccaggtgtggtggtgggtgcttgtaatcccagctactcgggaggctgaggcaggagaatcgcttgaacccagcaggcagaggttgcagtgagccaagattgcaccactgcactccagcctgggcaacagaacgagactccatctcaaaagaaaaaaaaagaaatagagataatcacacctactttgctacagagttgtggggagactccagtgttccccacaggcctggcgcacctcctggctcacggcaggtgcttggtgagtgatggttccccactgtttcctctggaaatttagggcaggaggtggtaacaataacagtcatgtaatcactcccagtgctaagcaccgtcagcccagatggtctcatgcccccttccctcggtgctcacatgatcttttcctcaccttcagctctcgctgcagtggcacttcactgcggtgacactttcctgaccactgtataaaaagtagcagccccttggctgggcgcggtggctcacggctgtaatcccagcactttgggaggccgaggcgggcggatcacgaggtcaggagatcgagaccatcctggctaacatagtgaaaccccgtctctactaaaaatacaaaaaattagccgggtgtggtggcgggcgcctgtagtcccagctgctcgggaggcggaggcaggagaatggcgtgaacctgggaggcggagcttgcagtgagccgagatccgccactgcactccgcctgggctacagagcaagactctgtctcaaacaaacaacaacaacaaaagtagcagcccctgcttggttatctgcaaagtactttttaaccttctgttatgtatttgttttctgcctcccagctggaaggggagttgcctgctgttcagtgccagtttgccaggacctagaacagtgcctggcttggtggacacacagtgtttgccggatgattaagtgaatgaagaaacccctgttttcaagatgatattgaaactcagaaattaagtagttgggcttgcttaaggccatttggtgagttagttgtagagcagggatttgaactgaggtttgtcttgcttcacagctcaggattctgtacacatgaaggccctggtgtagcactggatctatagtagtcagatcatcattggatctatatttcagccaaagctaattggttggtgcttgtgccggacacccaagatgctggtggaacgctgatctggccttgtctcctgctctccttgcccctcagatccggaaggctgcccagcatggagtatgctcagtcctcaagggcagtgaattcatgtttgaaaaggcccctgcccatcatcctgctgccatttccactgccaagttctgcatccaggagattgagaagtctggaggtggggaacccaaatggagggcaggtggatgggaggcagtggctggcagagcaggacagggcctgcggtagggcggggctggtgtctcaattcctcttctgtataccaggctccaaggaggccaccaccacgctgcacatgctgacgctgctgaaggacctgctgccctgcttcccggaaggcctggtgaagagctgcagtgagactctcctcagggtcatgaccttgagccatgtggtgagctcaggcccaaaagctggagaaagggggacctgcagtggtggcatttggggaactcactggtcagtcaaaatgcagggcctggggtctccctccctgactgtgttcttaagctaaaaccaacagcactacgttactctgtggtgtttggctaggccaggccatatcagagtccccttccagatggaagctgacctcagagatcaggtcagagtcagggtggatctgtagtgggctggtaaaccctccttctgcaccagctctatgtaccctataccaatttttttttttttttttttttttttttgagaccgagttttgctcttgttgcacagctggagtgcaatggcgcgatcttggctcactgcaacctctggctcccgggttcaagcgattcttctgcctcagcctcccaagtagctgggattacaggcatgcaccaccacgcccagctaattttttgtatttttagtagagatggggtttctccatgttgatcaggctggtcttgaactcccaacctcaggtgatctgcccgcctcaacctcccaaagttctgggattacaggcgtgagccactgcgcccggtcgagttttttttttttagcagctttaaagacacatgaaaaatgatttcctgtgtttctaccatttctagcacaattctgtaaatctttatacagtcagctctttgtatgtgtggttcccacagccataaattcaaccaaccttggattgaaaatatttggaaactgggcatggctgcacgcgcctataatcccagatgcttgggaggtggaagtgggaggattgcttgagcccaggaggttgaggctgtagtgagccatggtcatgccactgcactccaacttgggcaacagagcaagaaccccatgtcaaaaaaaaaaaaaaaggaaaaagaaaaaaaaggaaagaaaaagaaaagaaaatattcaggaaaaagaaaatggttggttgcttctgtactgaacatgtacagttttttttccttgtcattattccttagacaacagagtgtagcaactatttacatagcatttatattgtattacgtattataagtaatccaggtgatttaaagtgtatgggaggatgcgtgtaggttatatggaaatactacaccatttaatatagagacttgagcattggtagatttttatgtccatggggggtcctggaaccaatcccccacagatacccccgccaactcactgtgtgttctctctctttttttttttgtgatggagtctcgctctgtcacccaggctggagtgcagtggcgtggtctcggctcactgcaaactccgccttccgggttcacgccattctcctgcctcagcctcccgagtagctgggactacaggcgcccgccaccacacctgactagttttttgtatttttagtagacacggggtttcaccgtgttagccaggatgctctcgatctcctggcctcgtgatccactcacctcggcctcccaaagtgctgggattacagatgtgagcctctgcacccggccttgtatattctcttgtagtgtttatttacatacatatttttaaaattgtaaaatataaataatatgatcattgtttaaaagggaaaaacaattcagaagtgtataaagtaaaaatctccttccctccaaatcctgtttcctaaggtagacagtgcaaataactttctgggtatcctttcagacattttctctttggataaacaaatatacatgataaaacatgtaaaggccaggtgcagtggctcacacctgtaaccttagcacttgggaggctaaggcaggaggcaaggaatttgagaccagcttgggcaacatagtgagacgagactctgtctttataaaaattaaaaaattggccaggcacagtggcatgcacctgtattggtctcacccctgtatccagcaacggagcaagattctgtctcaaaaaaaaaaaaaaaaaaaatacagctgtaacagaccgtttatagcctgcttttttggctgttatgttaaaaccattttgttaatgtttctatctttgtttaagacatttaaagctttttcagtggcttccatgtcttactaaggtggcagtcctcagggtgtctctgtgtggggggcatgtgtgaggttcagggggccctcaactccctagcacacaggtggagttgaggggtccagggccagccgtgggctttgtagttcctttctaagcctgtgtgtccccctccagctggtgacagcctgtgccatgcaggcctttcacagcctcttccacgccaggcctggcctgagcaccctgtcagcagagctcaacgcccagatcatcacggtgaggcctgttggtgggatgtgggggcattaggtcgggggtggtgccttgggaggctgtgctgggggcactggccctgcgccttgtctacagagtgaggttggctgggctgggttgtcctagtggaagaggccagtagaaggggaaggaagattggagaccagccatcaaattcacatcagtgtccccaggagctgggaccttgacccttgacctagttaactttaatgaactgtttcagcatggtctcgtggtgctcatagataccttgagcagggctctcggccttagaggtctgtggatggatattgggaggggggatcagatcccccaaattgttagcaaaatgtacgtttttttttttcaaagaaggcctctggcttttgtcagactcacaaaggagtgtgtgacccatgatactccgctgctcctagaggctgttctcccaaagaattagagctgggagggcttcatggagaagggaaaggcaggagctgggaaagccaagggggctgtgagtgctagggtcacaagcactgtccccaggacattgctggtgccaggatgggaaggggtcatcatcactgggctattgcagaccctgcatgctcagtcacctgcttattcccacttttaggccctgtacgactatgttcccagtgagaatgatttacaacccctgctagcctggcttaaggtcatggagaaagcccacatcaacctggtgaggtacggatgaaggaggggtgcttagggcctctgtccaggctgttgaggtgggggtgctcagggcctgtgtccaggctgccgaggtggggggtcctcagggccttcatcctggctgccaaggttgggggggtccttagggcctgtgtccaggctgccaaggtgggggttcctcagggcctctgtccaggctgctgaggtggggggtcctcagggtcttcatcctggctgccaaggttgggggggtccttagggcctgtgtccaggctgccaagattgggggtcctcagggcctccgtcccggctgaggttgcagggtccttagggtctccgtcctagctgctgaggttgcagagttctcagagcctctgtccaggctgccgagattgggggtcctcagggtctccatcctggctgccgaggttgggggtcctcagggtctccgtccaggctgctgaggttgggagtacttagggccttcatcctggctgctgaggttatggagttctcagagcctctgtccaggctgccgagattgggggtcctcagggtctccgtcctggctgccgaggttgggggtcctcagggtctccgtccaggcagctgaggttgggggtacttaaggccttcatcctggctgctgaggttatggagttctcagggcctctgtccaggctgccaaagtgggggaatccttagggcctccgtccaggctgccgaagttgggggtcctcagggctaccatcctggctgccaaggttggggggtctttaggacctcttgtccaggctgccaaggtggggggtcctcagggcctccctccaggctgcagaggttgggggtcctcagggcctccgtcctggctgctgaggttgtggagttctcagggcctctgtcctggctgccaaggttcggggtgctcagggcctgcgtctggttgctgaggttgggggtgctcagagccccatcctggctgctgaggttggggatgctcagggcctctggcctggctgctgaggttgggggtgctcagggcctccgtcctggctgctgaggttgggggtgctcagggcctccgtcctggctgccggaggtggaggggacgtgagccggagactggagaggctgttcagcctcctggggcctgacggcatctccatgtcaagtgagctacagagcagctcttgtttttgtgaggcacggggtaggacagtgcagctcgttctgacagggtctgattcctgccagagcgtttgccagccagccgggaggaacagcaaggtgggctgcgagccctgcgtcccaggttgaggcctgagtttcaccctgcctcttgccgctccctggctgtgtcttcctgtgcactcagtttcctggccatgggatatcctttctgtggctccactccactctcgcctggactggcggctccgttctccaggttccgtagtcccgtgaaccgactttctgctttgtgtctgcatactttcagggttcaggcttggccacttaatagtaattccacttttctggaataaggctgagaagaaacagtatacagtaaccagttggtgacctgcatggagggaggcaagggcctcttagacctcgtggctctcttttgctgggtttgtcttctcagctaagggttccaacggcctgccctcacccaggcagcctgctgtcacccaggcgtgtgccaaacactgttcatctgtgtttcctttcactagtcacagcaaccccatgaggaagggtttagccccaatttataagccagaaacaaaggctctgtgagtgagctagtcacacagccctgatgagtaaggccaggtctctggcccaggtctgcccagcccacattctttttcctgcatcaaaccgcctttactgggaggtgtacaaaaatggcaaaatcaccccattcaccacttctcatgcttcagcccgcaggagcacacccacagttaggccccattgtgcgtcccgggatgcttatcatcgtactctaggtaacatataaaaactggaagcaagctaagtgtcccacagaggggtgaaatataaacaatgaagtactgtgcagccattagaaacaatcaaagtgggcctggcacagtggctcacgcttataatcccagcactttaggagaccgagatgggcagatcacttgaggccaggagtttgagactagcctggccaaaatggcgaaaccccatcttcactaaaaatacaaaaattatctgggtgtggtggtacacacctgtaatcccagctacttgggaggctgaggcacgagaatcgcttgaacctctggggtggaggttgcagtaaactgagatcgcaccactgttctccagcctgggtgacagggtgagaccctatctcaaaaaaaaaaaaaaatagaaacagtcaaagtggttgtatgtgcacttatatggaaagaactccaagatatattggagaaaaagcaagacatagaatagcaggtatgatgtgattgtttctctatgtatactctggaaccacattgctaagggtgtgaatcctgaccccattaccaagctgggtggccttgggcaagttatttgacttctctgtgtctttcctcatctataaaatggaaaaataataggatttatctcattagttgttacaaggtttaaatgaatgtatgttatatcagtgattggtatatgataagagttacataaatgctaccaggccaggtgcagtggcttatgcctgtaatcacagggctttaggaagccaaggcaggaggatcacttgaggccagaaggtcgagactagcctgggaaacacagtgagatcctgtctctacaaaaaataaaaagattagctgagcatggtggcatgtgcctgtagccccagctactcaggaggctgaggtgggaggatcacttgagcccaggagtttgagactccgtgagctatgattgtaccactgcaaaaaaaaaaaagttagcagaagttactgttttcatgtttgtgcattttagaacttctggaagggtatttaagaaacttaaccttgattttcccctggaagtacatataagggtcaggccagaagggtgagttagggaaggcatgcccttcattttacaccttgaagacctgtttgaattttctaccacatgtagttattacttgaacgatagtgcctttttaaaaaccacccaccagaagggccctacggagccctgcagatcactgggtttgtgactgttttcagagctgggccgtctcagccctgagccctggttgcccgggtccccagggctcaggccaggccccacagaaaccttttgtcttgacaggttgcagtgggacctggggctaggccacctccctcgcttttttggaactgcggtgacctgcctcctttccccacactcgcaagtgctgactgctgctacgcagagcctcaaggtactgcaactttagctgaggaagcagagagcacagggggttctatgggctgccctgtctttcccagcactggccccaggctaccagctcgggcccagagaggccgctctcaaaatgggagataggtttcttcgaagctttcttagactcccaggaaactgttgcctgggaggggagagtggtcctggggggctgccttgggcccagaaagcctgtggcctctcttcgcaggagatcctgaaggaatgcgtggctccccacatggctgacattggctccgtgacctcctcggcctcaggccctgcccaatctgttgccaagatgttcaggtgaggatatggggtccatgttaggaagggatggtggtaccttgaggaaagttctatataatacgaatgctccactctccacctactgtgggccaggcctgcagtggcagtgctttacgggattgcaggctgcttactgaacatctgccggagcagctaccgtggacttgagcacctgccatgttttagccacacctcacctcttggtttcctagaggtttccccatctgaagttgggtcagataactacctcattggtttttctttaagcactagcattatctaaattaaactcttaacatagggagtgtgggcatgtcacaaatgttagttctcttctgttgtctctcctggggccccattcttgctggccagctagcgtctgtagctcagggtgctggccgttgactttctctggtggggggcacagggtggtgtgaccgtggccctgactgtgccgcccccttggcagggcagtggaggagggcctgacgtacaaattccatgcggcctggagctccgtgttgcagctgctgtgtgtcttcttcgaggcgtgtgggagacaggcccaccctgtgatgaggaaggtgagtggggagcggctggggccagggcaggaagtggtgctggctcttggactatgggctcctggagggcacgtgtctctgttatctctgcaccctgctccgcaccccaccctgacagggccatagcaggtgccccatgcagtatcccctggaaggtgactgggccaacaagggaggggcaggaaaaagggtggcagtccccccacctgctcactagtctttgctggagttactggttttgaaacttagggagtctatttgctttcccttatccccaccccttatcttttaaattttaattatctaagtttcctataaccagtgagtatagcattgaagttctaaacagccctaggtcccacggaggttcctccagtccagggttaaccatttaaggatcagggatcactcagggatcctgagcagaccgtagtccaggagagagtgggggcctgaggacagcccccagactggtcccgcatcagcagagacagcagctcctggcctcgtggggccttcctcactgactccctcccattgctggaaaaaaggaaccctggtgggaggacagggtctccatcaagaggcctggcctgagccctgataaattaggttgaccagtttggctttatacaagaggccaggcagggccttgaaagtgtggctgggggagggctgtggccatagtgaacccaggggtgcacctctgtctcctcagcgcctgctgatttgctaattgttgcatgcagacaagatacatttgtcccattttcgaagataaattggaaatctacatttgtgtgtgaaactttctaatttttacatgttgttaaatgtaacagaattttgtaaaatcctaggccctgggattttacagtcaccagtggttaattgggttctcagtctgtaccctctggtgtagcgttgaacccaggcccagaattccagcctcatcgttcagcggggtcttgtcatgggtccctgctttcgagcatgtcttgatgtgtggtcactcatctctgctgcagtgcctccagtccctgtgtgacctgcgcctctcccctcatttcccccacacggcggctcttgaccaggcagtgggggctgcggtgaccagtatgggacctgaggtggtgctgcaggctgtgcctttggaaattgatggctctgagtaagtgtggccctggctggcttcctgacaagccccaggcttgttctctcccctggaaaggatgtctgctgctgtgggctaaagtctgtgtcagtgcagggctcagcaggaggggccagaggaggtcttactctgtcctgggctcagtatgctatgcactgccctcagggctgtcccctcatcctcattgggttcttcccattctcttcccagggagactctggatttcccacggagctggctgctgcctgtcatccgagaccatgttcaggaaacgcgacttggttttttcaccacctacttcttgcccctggctaacaccctgaagagcaaaggtaggagagacccttgcctgtgtgtgacctgaggctccccacagtcctggaacctccacagaagggattgggaagggtgctgagtcccacacacccagccttcaagacgtttggcaacatccctctgccgagcaggtggccagccagtgctggagtgcctgtctccctccctgctgctccaaggcgaggccaggtggccctccctgtggcagagcttgccctgtgagacaggagctgcctccacatggagctgccccaactgggccttgttcttcccctttggatcacagagaacagctgtgccccttcttcctcatgcaagcccttgagattgattttgtaaaaatttgtgatatgtttgtttatatgtatatatacttttatatacttctaggtgtatttatttatttatttattttattattattattttttgagacggagttttgctcttgttgcccaggctggagcacagtggcgcaatctcggctcactgcaacctccgccttccgggttcaagtgattctcctgcctcagcctcccgagtagctgggactccaggcacccaccactgcacctggctaatttttgtatttttagtagcgacagggttttgccatggcagccagactggtctcaaactcctgacctcaggtgatctgcctgcctcggcctcccaaagtgctgggattacagatgtgagccaccgtgcccagccaggtgtatttatatatatgagtatatatgtatgtacacatacacagtcacacgccacatgacgtttcaatgatggtggtctcataagatgataataccgtattttactgtacttttcaatgtttacgtgtgtttagatatacacatacttagcattgtattacagttgcagcactcagtacagcaacatgctgtccaggtttgtagcctaggagcaatagactataccacatagcccaggtgtgtaggggctgtgccatctaggtttttgtaaatacactctatgctgctcacacaataaaatcacctaccgatgcatttttcagaacgcaccctgtcaagcgatgcatgactgtagatcatatgtatgtatttgaaaatgattaccccagaggtgttctttcttcaggctgcacatccccagtcccctgcccctctcctttcaggcatagtttcttatccttcgtgatcatggtctcctctctctatttatcttctagtttactcctgacctgtgttaggcagactcaggccttaggcagactcaggcctacgtgaggataggcagagcatggggttacattgctcagcctagtgatggcttcagaagcttttcgttttcattggattttgtggattttgaggatgtagggcagcattgctaaactatttcatccgctgtctgtttttgtaaataaattttctttttttttctttttttttttttttttgagatgaagtcttgctcttgtcacccaggctggagtgcaaaggtgcgatctcagctcactgcaatctccgcctcctgggttcaagagaatctcctgcctcagcctcccaaggagctgggattacaagcacctgccaccacacccagctaattttgtatttttagtatagatggggtttcaccatgttggccaggctggtcttgaactcctgacctcaggcggtccacctgcctcagcctcccaaagtgttgggattacaggcgtgagccactgtgccaagcctgtacatacaattttattgaaacacagacacatacacatttattcttgttctgtcacccaggctggagtgcagtggcacgatctcagttcactgcaacctctgcctcccagattcaagcgattctcctgccttagcctcccaagtaggtaggactacaggcatgtgccaccacacctggctcactttttaaaaatttcttgtatttttagtgcagatggggtttcaccatgttggccaggctggtctcaaacacctgacctcagaaaatctacctgcctcggcctcccaaagtgctgggagtacaggcatgagccaccatggccagcctgtcacactactttttaatgacagagttattgtgatagaaatcatacgtaccgtgggctgggcacagtggctcacacctgtaatcctagcactcggggaggccgaggtgggtggatcacctgaagtcaggagcttgagaccagcctggccaacatgatgaaaccccatctctactaaaagtacaaaaattagccaggcatggtggtaggtgcctataatcccacctactcgggaggctgaggcaggagaacgcttggactctggggggcggaggttgcagtgagccaagatcgcaccacttcactccagcctgggcaacacagcgagactctgtctcaaaaaaaaaaaaaaaagaaaagaaagaaattgtatggcctgccgagcttaaagtactggtccttttgcacaaaaagttggctgactcctggtctagggcagtggttctcaacaaggagggtgattttgctgcctgtaggacattcagcaatgcctggagacatttttggttgttaccgttgggggatgggtgctctggcatctagtgggtagaggccaggatgctgctaagcaccctgcaatgcacaggacgacctcacacaacaaagagtactaggcccaaaatgtccacattgtcaagattgagaaaccctgctctagggcagtttcctgatttcacacatgatcttgtagaatatacaggaagtgcttaaagaagaaagtaaggccaagcgcagtggctcgtgcctgtaatctcagcactttgggaggctgaagcgggcagatcatgaggtcaggagttcgagaccagcctaaacaacatggagaaaccccgtctctactaaaaatacaaaaattagctgggcatggtggcacgcacctgtaatcccagctacttgggaggctgaggcaggacaatcgtttgcacccaggaagcagaggttgcagtgagccgagatgacaccactgcactccagcctgggagacagagcgagacttcatctcaaaaaaaaaaaaaaaaaaaagaaagtaaaagtcattcagtcttcccacccagaaattgttactactcaagtttttaatgtattttcctttgctttgtttgggtcggtttgtttgtttgtttgtttgttttgagacagagtcttgctctgttgcccaagctggagtgcagtggtgcgatcttggctcactgcaacctccacctcccaggttttcaagcaattctgcctcagcctcctgagtagcttcgtctacaggcgtgtaccatcacccctcgctaatttttttatttttagtagagacaagttttcgccatgttggccaggcaggtctcggactcctgacctcaagtgatccacccgccttggcctcccaaagtgctgggattacaggtgtgagccaccatgtctggctgcatttttttctgtgtaaaaatagtattgtatttctactctgttggaattaatgtgcacatattagtaacttaaagtttttcctgatattaaaaaggaaaaatttgttctattttcaatagaaatatatgcccatcaaagaaaatacagatgaacccccaaaatgagggtcattaccatcattaatgttacctataaaccctggcattattcttaaggctgatgttatgtattccctttgtcctggtaatactacacgcaggtatctgtcctgagaagatagacaagtgcgtactgatttatgttcctagcaaagacgtgcctgacagtattggcttatactggcaaaaactgtaacacatctagtatctttctcattagggttccagttaaattagttatggtaaagccctacttttggccagatgcagcagcttacgcctgtaatcccaacactctgagagtctgaggcagaaggattgtgtgaggccaagagttcaagaacagcctgggcaacatagcaagaccctgtctctataaaaattttttttttttttttttagttagccaggtgtggtaggctcacctgtagttccagctacttgggagactgaggaaagaggatttcttgagcccagaagttcaaggccagcctgggcaacagagtgagacctccgtctctacaaaaatattttttaagtcccactttgggatatgatgtaggcattataaagaaagaaagaaaccactaggtagggacagacaagtttagcagatggtgagtcgaacagacacggtttatatcccaactccgccgctccacagttcgtggcttggggcaggttttgtttaatttcccagggtctgctcctcatcttaaaatgggcaagttttgtgaggattaaatgaaaaagtcatgtgaagtgctcattacagactaccacatagtacttgctcagtaaatgttaccagctttattgtcaagtaaacaaggttacagaatgctatatatatagtatattcctccctatggttttttttttttttttttgagacagagtctcgctccgtcacccaggctgttgtgcaatagcacgatctcggctcactgcaagctccacctcccgggttcactccattctcctgcctcagcctcccgagtagctgggactacaggtgcctgccaccactcccggctaattttttgtatttttagtagagacggggtttcaccatgttagccaggatggtctcaatctcctgacctcatgatctgcccgcctcagcctcccaaagtgctgggattacaggtgtgagccactgcacccagcccctgtttatgttttacaaagtgggcatgtggctgggtgcagtgttgcacacctgtaatcccagcactttgggaggccgaggcacatggatcgctcaaacttaggaattcgagaccagtctgggcaacatggtgaaaccctacgtctacaaaaagttaggtgggtgtggtggcatgcacgcctgtagtctgcttcttgggaggctgaggtaggaggatcgcgtgagcctgggaggtcaaggctgcagtgagcccagattgcgccactgtattccagcctaggccacaaagtgagaccctgtctcaaacaaaacaaacaaacaaaaaaaattgggcatgtgtttaaagaagtataaaaaagtaacaagaaacagaggctatctctgggggagtaagagtatggagagacgtttgctttctgtttattataggttcatttgagtattttagaatgaacaagtatgatttaattcatggagatggggggaagtcacccatattcctgtcctcatcattgggcttttggtttggtttggtaaataaggctgttggccaggagggtgctgggctcacactctgtccctctgtcacactgcagccatggacctggctcaggcaggcagcacagtggaatctaagatctacgacacactccagtggcaggtaagggtcagctgggggagggcgtggggagaagcacacaggggcacaggtggctgcgtgtcaccttcctttattgtcccctccttctccagatgtggacactcctgcctgggttctgcacaaggcctacagatgtggccatctccttcaaagggctggcacggacgctgggcatggccatcagcgagcgtccagacctgagggtcaccgtgtgccaggccctgcgcaccctcatcaccaagggctgccaggcaggtacgtgtgggctgtgggagtgggggctggggaggatgacacaggtccctggccccatcccctggcttgctacactccttgccaggcagagccacagaaactcacctctggagctcatcctttgctgcttctgctgcagaccccaggggataactttgctggctccctggggttggagccatcgaggaccatgggccactggggcaccaggctctccatgccctggctcagcttctgccacagagagccccaaacccatggattccaagtcctgccagctcccccaagagagggcctctgggccacagccccagcagccactgaggcacagtcagctcctgtgcctttagtgcaaactttgatccttttaccagaggctgaccgtgctgaagtgagtcgctttgccaagaactttctgccgatcctcttcaacctgtatgggcagcccgtggcagccggggacactccagcccctcgccgggctgtgctggaaaccatcagaacttacctcaccatcactgacactcaggtgagccacggaagggagggaaggagggaggaggggagctctcaggtgggcagggtcagagaggccgagaccctacccaccagggctcacgtgggtctctgtgttttggagcacataccagcagtcatggcttgggcagggctgggggctgatggggaggccgctctgggactgctgccattgctgctttctttcgctcctccccaatgactctcttctcctcattccctcggggccacaagttggtgaacagtctcctggaaaaagccagtgagaaggtgctcgaccctgccagctctgactttaccaggtaacatgctcagggcctcccacttgagctggagcagcccagggagctggagggtgcatctggcagaagcactgtgggttccctcttgcattatttaaggaagccttgaagtattaactctccaggctgtgctgagaggctgtgctgactagttccttcttcctggagaggccatttagtctggtagggaggaacaaggacccaggagatacactgcccaggttctgatcccagccccgtcactcatgggctgtgtgaccttggacaaattacttatccattctgcctctaaggcctcatctgtaaaatgggcacgataatagttcttgcaacaaggttgctatgaggattgaaggagttagcaggtgtaaaacaccaggaacggtgactggtacatcatgaatgctcagttaggtactagctattattattgttcatgagctccttcaagccccttgtcctcaccctgacttctcccacctccccatacccagtagacgtaagaacactggtagtctgcgcccttctccagctccccatccctctccttgtcctcctgccccgagcagattgtctgtcctggacctggtcgtggccttggctccgtgtgctgacgaagctgccatcagtaagctatactccaccatccggccctacctagaggtgagcctcgggggccaggagcgccacacagccacgcttgggggcagatgggctgtgggaaggtggggcctgtcttcatgtctttgtcccttgctgcttcccgagatcaggtccctgtctgctttctcctgcagtggcttctctttgtgtcctgtgtagcccatctgtcttgcaggtcccaaagggactgaaatgcacagctgtgcttaggccttgcgtgctgagtgactcttgtagaaccaaggccatgctcctttgcctggctcactccccaggcccatcccagaccggcctgagctttatcccacccagtccactctctacttctgctgcagcctccttcagctgccttaagcctccctgatataacaggccctgtctgtgcctttgcagggtttgggtcctcagcttgaaatgccctctgctgtggccagcaaccctgcagatctcagcccagcagtgaccccctgaaagctgcccccattgccacagtttagtagcagttacctaacagtgtgagaagtgctctggggcagcactgcaggtggacatggaaatccagggccaggccacgtcacctcaggaaaggtgtccggcgttgggggttgggggagtgtgacagagagctggtttggaggagcaaggagttgtcagtcttggaaggagagagaagagtgctccggctagaaagagcagcagatgtgcaggccttggcgcgtgccaggcaccatgagctcaggccactggagtgagcactgtccagagctgggtgagtggagtggattggtgggccccacggcacacacccccaacccctgtgcctcgcccaggagttagccactcgctgtccacattccactggtcctctgtcaagccacatgagcccccacggacccctgctcagaatccctccagtgctgggggatgctccgtggatagcattggacagggagtgagccccaggcctccctcaccggttcctgtctgccagagcaaggcccacggggtgcagaagaaggcctaccgagtgctggaggaggtgtgtgccagtcctcagggccccggggccctcttcgtgcagagccacctggaggacctgaagaagacactgctggactcgctgcggagcacctcctcacccgccaagagggtgagggctctagggccacccgctctgccgagggagcctgggcaacaccaggaaaggagccactgttgaggcttgttgggtggaggtagcattgaggggtcctgactggtagccctttgcccacagccccgtttgaagtgcctcctacacatcgtgaggaagctctcagctgaacacaaggagttcatcactgccctcatcccagaggtgagtgtgcgggtgtgttttagaggggggtccctggaatgtggctcttaagggcctcaggatccagggagggcagtgatgggagtgggaggactcgattcgcttcccgggcagatggctcagggagcagatgctgatggagttgtcttggccaggtgatcctgtgcaccaaggaggtgtcggtgggcgcacggaagaacgcttttgcactgctcgtggagatgggccatgctttcctaaggtttggctcgaaccaggaaggtgaggcccagggggctgggggtggacactctgctcatagactgggtggggggaagcacccctcaaaaaaggtggggagagctctgtgccctggccctgggcaggctgctcctctctggccctcagcccccctacctggtgggtccttcctgcttgacccacgttggtctctgtccccagaggccctgcagtgctacctcgtcctgatctaccctggcctggtgggcgcggtgaccatggtcagctgcagcatcctggccctgacccacctccttttcgagtttaaaggtaaatgcttatttcctagaaggcctgagaagccctcagattaggaagatgcccaaaaggtcaggataaagtggctcctggaactgggaaaaggtgcctggaggaagtaagaaaagccacacccagcccagtttgcctccctgtctcccttcctgcgggtcgctgcctcccgcccttgcggctatgccaaggcaccttcctcaggtctgtccccacgtgtgactgtgcagtccagtggccctgcatcccattgtcagagtggttaggaggtggttagggctgatgcctggattttagtcctagtcctgcctcttggcaaccacatgagacctagaacagcttgattagcctcttagcacctcagtttcttatctctaaaatggaagcaagaaatagcacccacctcagggtgacgaaaggacccaagaccactccatggagcgtgattggaaccatcccgggcatacggaaaggctctcaatgtcagcttttactgacacttgagtggctgttttccagtggggaaggtttgggtctgagtggggtcctgggtgtcttagacagtgaccccctcactgccacaggtctgatggggaccagtacagtggagcagctgctggagaatgtgtgcctgcttctggcctcccgcacccgtgacgtggtcaagtctgcactgggcttcatcaaggtggcagtgactgtcatggacgtggcgcacctggccaaacatgtgcagctggtggtgagtgtccccgttccccttagcaggtagcagggtggcctctgagctgttggcatggacctggcaagcttcgaggccagcaagtttcaaactattttttttgtagccagaggtcattaaggagccctaaaagggaccataggggaatgcctgtcaggtggaggcgaggagggggcacactgcccaggtggctttcttcaccccagagccctacatggaaagcaacaggggctcttcagggcaaaggcccatgggcagggccactcctcattttacagatggagaaactgggccagagattttccagatcatgggactcagacgctgggctctccctccacaggaccccctcatcttgcctttttttttttcccatcttgcattttgaccttgctggttagaggccattcctttgggtcccctgctgggctgcagaaggatctgaagagccccttggtatagggtccctggccctctcctgcccaagagaagccttgcccaggctggcgtaggcttccagccaagctgtgcactgtacctactgcctcagtttcccatgtgtgactggcttgagtcacatcagacctctgggtccctcttgcatattttctttgggtctggccttgggttcaagataggaagggacagatgagaatcagcatgccctcccgctgccctcggagcctgcagcctactagggaccaaaggtggggagaacagctagagcagtgatccatcatggagttattcgaatttatacaagccctggccggctgcagtggctcacacctgtaaccccaccactttgggaggccaaggcaggcagatcacttgagttcaggagtttgagaccagcctggccaacatggtgaaaccccatctctactaaaaatacaaaaattagctgggcgaggtggcaggtgcctgcaatcccagctactcgggaggctgaggcaggagaatcacttgaacctgggaggcggatgttgcagtgagccaagattgcaccactacactccagcctgggtaacagagcaagactctgtctcaaaaaaaagggatttatagaagcccttccaagagtggttggggaggccaggagcggtggctcacacctatattcctagcactttgggatgccaaggtgggtggatcacttgaggtcaggaattcgagaccagcctggccaacatggtgaagccccatctctactaaaaaatacaaaaattagccaggcatggtggtgcgcgcctgtagtcccagctgttcatgtggctgaggtgtgagaattgcttgaacctgggaggcggaggttgcagtgatccgagaccatgccattgcactccagccagggtgacagagcaagactctgtctcaaaaaaaaaaaaaaaaaagccaggcacagtggctcacacctgtaatcccagtactttgggaggccaaggtgggcggatcgcctgaggttgggagttcaagaccagcctggccagtatggtaaaaccctgtctgtactaaaaatacaaaaattagccaggcgtgatagcaggcacctgtaatcccagctattcaggaagctgaggcaggagaattgcttgaacccaggaggtggaggttgcagtgagctgagatcgtgccattgcactccagcctgggcaacagagcgagactccatctcaaaaaaaaggagtagacgtggaccctatcccctagccggtttgggagtcactggagataagaagatctgccacctgcacatgtaacccaaactgggccagatgaaggcttaagaggaatccagccagagcagaatgcagtgagatggaagggacataggggaccaagagaaatcttggggtgctaggggcaaagcgggagccgcagcattagatgagtctgggctgaactcccacctctatggccatttagcaaacactttatcctctgtgccgccgtgtcctcttctataaatagggggtgatagcatgtatctcaggggtagtccaaggattcaaggagaggatatatgtcaagtaccaagtgctgttgagaagactaaagctctcatcctgcgagggtgctcaggcctgtgtcctgaaggagggtgcaggggaaagatggggcctgcccacccgagggaagcatgactgggccagggtgtgggccaggagcagggccgcgctaaccctcccctcagctgggcttgatcatgctgcgtccctgggctggacagcagtaaagggggcgcagcatggaaggctcgcctccctgaaagcctggtgctctgtccggcagatggaagccattgggaagctttcagatgacatgcggcggcacttccgcatgaagcttcggaacctgttcaccaagttcatccgcaagtttgggtctgtgcactgagcaggggcgggggtagggcaagcgaggggccgaggatttccagtcctaccagggacactacatctgggtcgtgctgtctggccagtgcctctcaccagcccttccttgccacctccagatttgagctggtgaaaaggctgttgcccgaggagtaccacagagtcctggtcaacatccggaaagctgaggcccgggccaagaggcaccgagccctgagccaggctgccgtggaggaggaagaagaggaggaggaggaggaggagcccgcccagggcaaaggtgacaggtgagaccatgttagggccatgggacccggtgtccccccaacccaagggcctgcccaggcaatacccgctgacccccgcctctcctgggagcactctgactgggggctttttgtccttagcattgaggagattttagctgactcagaggacgaggaggacaatgaggaggaggaaagaagccgaggcaaggagcagcggaagctggcacgacagaggagccgggcatggctgaaagagggcggtggggacgagcccctcaacttcctggatcccaaggtggcccaacgagtcctgggtaagcacagggctggccagtgcactcagaaaacagacttgccatggtgccaggttctcaggtggtgggtagggggtggcatccatggcaggcccatggacagggctgagaggcgcccgtttgggatccctgagccgggcttgttggtcatgatgagggtgagtagcatgggactggccttccacctcctcatgccaaactctacaccccagccacgcagccagggccaggccggggcaggaagaaggaccacggcttcaaggtgagcgccgatggccggctgatcataagggaggaggcagacggcaacaagatggaggaagaggaaggtgccaaaggtgggcccaacgcgcttgtccattcattcaccgtgttcacttattccttcggtgatcacttgctgaggaagcgtggctaaaaacagaccagagaaactcttctctcggcagcttcctcaaactttttgagtttctcaaactttttttgagaaacattaagaaatctttttatgttgtaaccgagccatttatacaatacatatttaacttaaaggaaactatcggaaatggtacttccccttactgtgtgtgatacgctgttagtctcttctgtttttctcctcctcctccccctcctcttcctttctccttttcttccttcctcttttttttttttttttaatgcaaacttggctaaggccctgaagatgatttagaggcagaaagagccagaggctgaaaccctcccaacttcccaatcccaatgtctcacattgcccgggagtccctccggtgtggcatctcggagctctctttagtctttcctggcccctctccacatatccagccattagctaagaaacacttaggtcttcgccaggcgtggtggctcacgcctgtaatcctagcactttgggaggccaaggcgcgcagatcaggaggtcaggagatcaagaccattctggctaacacggttaaaacccatctctactgaaaacacaaaaaattagctgggcgtggtcgcgggcgcctgtagtcccagctactcgggaggctgaggcaggagaatggcgtggacccaggaggcagagcttgcagtgagccaagattgtgccactgctctccagcctgggtgacagagcgaaactctgtctcaaaaaaaaaaaaaaaaaaacacctaggtcttcaagaacacacctgtcatccctttgtttggttcccagtgctgcgagctctgggcccttgtctcactgcacctcctaactggagcctcactgctccacatgcacccaactcaccagccacacgactgcagccgctcggtcagcctctccttagctccgtttccttgcttcagagtggatatcatacaatcctaatacccacttttccgggttggaatgaagatgaatcggtgtaatggggacagcgtatgtacttggtgtacatgtgcctgttatatttccgtgtctagtgtcttctctgctcctctctcgcccctgtatactttcccatctcctgtcccccttggtgcccaggcattcctgaggctgtcaggacccctcccctctctctctgcctttccaaacccccctgctcttcaggattcagctcaaagctccttttgtagcccttcctgggcacctcagcctttaggcctgattcccccagaactcctgccaagcccagaggaaacccagtcttcagcccttggtcatgtgctttctttggagatagagtctcgctctgtcactcaggctggagtgcagtggctcgatctcgactcactgcagtctccatgtcctgagtttatgtgattctcctgcctcagtctcccaagtatcggggactacaggcgtgcgccaccatgcccagctaatttttgtatttttagtagtgatggggttttgccatgttgcagactggtcttgaactcctgacctcaggtgatcctccctcctcggcctcccagagtgctgggattacaggtgtgagccaccacacatggccggtcacgtgctctctatcgtcttttggttgttgattgactttgcctgagtttctcttccctccaattggtcagtttcatactttatattcccacatggagcccagcacatactgcatggggcagagatttcaaacaggagaatgaagccttcctggcacagtgggggtgtgtatggggctgcaggagcgcctgactcccccggaaacctggggctttcttcaaatctcaaacagatgaagggtgggtgagtgggaaaagaaaagtttcaaacgaagccatattcacctcaaaagtaggatcaccgcttctttgaggggccgttatccctagggcctagggtgggaaggagaaaggggcagtgctcaggggtctcatctcttctagcagaaggatgatattggtctgaggaaggcaattttctggggccggagttggtggccccgcagcctggtgagccaggagggggcagaaggaaagggtaggttttgaggagctcccacagcgctcatgggcctctcttttttggctccaggcgaagatgaagagatggctgacccaatggaagatgtgatcatcaggaatgtgagtagttcctgcagatggggggctagggcttcagacctaagcctgggctccacagcttctcacccccaccacacgtagacattggaactgccctgtttctggaatgctcggtgcatcctcacaggtgtgcatagcaggcggtccagaaggttgtgggtgccaggcaggacagggtgatggttgtctagttaaaggagaaagaaggcagagacccttgtctctctagcgagggcatgtgctatgcaggggcaagggcagcagcttccctgtgtgctcctgcatggggtgggggcatccaccgtaggggagcatggctgtgtgcccagcactgtgctgagggccccacatagcctcacgaagatagggactccgttgtcccagtgaccagaggagcgtacagaggtaagtagcctgcccagggtcacaggactcagtctgtgcaaaccaggaatttgaaccctggttttccagtctcctaagcccaggaattcaacctctttgccaccattacccctgttgacctggcagtgctgcctgccaggatggaaacagcctctcagctgccccacctgaaccaacaagggtgaagtgggcccaacccatcacccaacacctgtcagtctcaagctcagtggaacatttccattctggagcagtttcttccctctctgcccttccagactatgccccagcccatccagccttcctgggcaccacccgtaggtgacagagcctacatcagggtatagtgatatcggtggggaagcggcagactctggggtcccatcttggcttcagcctaaccttttaaagcctcaattcctgatctgtaaagtggggttataaatagaccacctggtggagtcattgggacagtttggtaagattgggcgtgtaaagtgcattagcatagtgcctgaagtgttacagacttcccccacatccccgttttcattggcgtcatgtttgtcaatgtctgcccatatgccttgccaagtgtccatctgcccagtgtggcccgaggaggagtttgttattagagcattgtgacagcgcagaattctgtttgaagagctgagtacatatccagagtcttgggtcagagagtagctgaggacctgagcagcctctgatgcgggaagcccctctgggatgcccttgaggaaaagcagtggggcttctgctgaaaaccctcctgcccctctctgcgcccaggcaaccactcctgtgggacagcttcacctactgggagtccttcctctgcttggtctgacatgggcccctccgagaggccaccctcaggccagtctagtctccctctccaggtgatggcagtcgtctgccaaacgtgtgtctgggcccagactgcctgggctcaagtctttgtttctgtgtacagtgcttgccacttagtgatgcaaagtaagccattgtgacttgattattcacttttcctggaaatctttttccattcaaagcctcctgggttccttaagcacatcttcacatgtggctttgcagatcctcggcagcctactcctctccctggccggggagaaccgaccacggctttctaaggatgtcccccactgccccgggcagagcgggactgagcagatgccttgtctccaggcactgagagggccccagggcagttgcattctgtggctggctcctgccactgagacccccagagggtttcttgcatggcacttagttctaactctttttttttttttttttttgagatgaagtctcactttttcgccaggctggagtgtagtggcgcaatctcggctcactgcaacctccccctcccaggttcaagtgattctcctgcctcagcctcctgagtagctgggattacaggtgcatgctaccacgcccagctaatttttgtatttttagtggagatggggtttcatcatgttggtcaggctggtctcgaactcctgacctcgtgatccacccacctcagcctcccaaagtgccaggattacaggcgtgagccaccgggcccggccaagttctaactcctcggccaaccattgtggaagcatgaagtgctggggttcaagtagctgcctccattcagggccagcaggctgggctgttggccaagcaccagctgaaccaagagccagctcagccatcatcccctacattgcagtcggagtcagcttcctcccggttcctgtttctccactaggagcccactcagctgggcttcggccagtggacctggagtcccccgtctcccaggcacaccctgtgtgtgctgcagcctgttcgctctgcccaggccgatccctttacctggcatacctttcccctggttggcctctggatcccctgggtagctggagccctgggaatctgcagtttctagaggtttctggggcacagtggcacagaccacagtgcagggaccagccttgccagctggggccacctctgtttgcctgccctccctgcacagcacgcctctgcctggcctggttgttggttctaggctcacatctgatgggctggggccgctgtcgggctctccctccttcccttggactgcctaacacagtgccaggcgcacagtaggtgctctgtcacttcctgttgaatataattgacgagctgacgtgtcttactgtccatgatcatacctgctgggatggtagcattgttgaggatcagtgatgactggcttgagcaggggtctcccacccgcctgagagcccgtggagcacaggaactagatcttgtgccctgtgtccccagggcctggcacttagtaggggatcagtaagtgagtgattaatagggagagtggggtggggtttgtgtgaagcaaagaactggtaaagctattctctctgaagaggccagggacctcattttccccattaggaaggctgggtaagctgatgtcagaagccctctgggcaattgcaggcctgggtggggcccagagtggaaaggaagagcaggaacggccgccaccagcccggcagtcaggacatggccagagcttctcttctgcactgcctggctttgtgatcttggacagttccttgccctctctgggccttagtttccccatctgtaagtgagaggtggggtgcttagcagagggcctctcctgcttgatgcagggtactctgctgttactgttggcattcccgagggtgggcacatcccctggttcactcactacccacctattctctctctatagaaaaagcaccagaagctcaagcaccagaaagaggctgaggaggaggagctggagataccccctcagtaccaaggtgaggcttccactcctctctcctgggacacatggatccctgtcacctgcattagggaggggagtcacaggaaggggtggcagggccatgagggtgcacagcctggttgcactcacttggcaccaacagaggttggctgatatgacactcaagatgggcctggagtctaaggggccctgggggtgtgagagagcctatgggttaggagatctgtgcatggaaccaccagccttctgaggagccctgagccacagctccttcccacccgcccaggcctcccaagaggcttgagtctgtcccttctgcgagctgcttgcctctcttggtcaccctaagagcaccaaccgagtcaggctgggtttagagaagccacttggccggtgccagggctgggaactgggaaggttggtattgggtctggccagagggttcccctctatttctatctctgggcccaccagctgttgccctcctagagcagctgctagaagtgccaaggtggcttcacctctgcttccttcctcccagggtagccttgcaggacccctgcccccaagcccttgcagcagagcccttgctttgcatctggaggtccaggggctcctgtgggaagcctctgattccagtagctggtgtgtcctcagccctagagcatcataacgcagctgcacaacctcatggctcttccgcctgtggcacccatgagccagggccagctcacctactgtgccctgggatggagtgatgctgaggcaggagtacctgccaattgatgaggcagagacctggggtcagggctgcttgcccaacctctgcttagctgtttgaccttggcctggttacactgtctgtctctgagcttctagtttctcatctgcaaaaacatgaggaatgggggtggttcgtgttggtcgtctcagagagtcctcctgagctggcatggtaggattccatccacaacttgtcgttgaatgttgaagtccaggctggagaagacagctgaccttgggcaaggatcttgatctctctaagccacagtgttcacatctgttacaatgggttaaatagctacctgctatctcagtgtttgtgtgaaacccaaatgagataagaagggaaagcctaaaatggcttctcttacagatgaggttaagaggcttgcctgaggttggagctgtaagtggcagagctgggagttgaacctggctggctggctggctgaattctgtctgactttggagaatatgggttattttttgttagtgtgttagcggagaatatatgtgttcccagaggtctctggtaagctgtaaggcttctgggtcagtctgaggagcccagtgatctaactgtcaaatcaccagacagtccctcctcgaggaaggtctttgtcctggtttgataggggacagagccaagttcctggccttcactcatctgctcccttgcagctctctcagagagggtgcccattgcctttctggagggggctgccctggctttgcctgactcatggtcctgtgttctccccgtagctggaggctctggcattcatcgccctgtggccaagaaggctatgcctggggctgaatacaaggccaaggtaagtgctgcatgtagggcatggggtctcctggcactggacaggtgccagggaggggcaaggaggagctgtgcccatcactgtcctgagaggcaccttcctggaactcaactgaggccaggaaagaagaaggggttcagatgctaagaccttgtggcatctgaaatgggggaccttattgaatggccttccaaggatacaggagctctttggcaccacctaaggcagaggatgaagggaggttatggggcctgtcaagtctagggcagggacagaaggggaaccccaccctcctagctgactctgtttctctgggcaagcagaaagcaaaaggtgatgtgaagaagaaaggccggccggatccctatgcctacatccccctcaacagaagcaagctcaaccgcaggtatgacgctgtgccaggcaggctgggggctggaggatgggtggggatgagggagcagagtgctctaaagaagggaaggccttattaaactctcagctcaatttgagtctcttccagcttttttttttaacatgcacctatatcatgtagctggtacctacctgtattactgacttgaactgcttctttatttttttatttttttgagacagagtcttgctctgtcgccaggctggagtgcagtggtgcgatcttggctcactgcaatctctgcctcccaggttcaagctagtcttctgcctcagcctcccgagtagctaggactacaggcgcgtgccaccatgcccagctaatttttgtatttttagtagagatggggtttcaccgcgttggctgggatggtctcgatctcttgacctcatgatctgcatgcctcagcctcccaaagtgctgggatcacaagcacgagccaccgtgccccgccctgaactgcttctttaaacatgatattatgtcatacagatgttttctggtatttacatactctacatagtcatcttttttttttttttttgagacggagtctcgctgtgtcacccatgctggagtgagtgcagtggcacgatctcggcttactgcaagctctgcctcccgggttcacgccatactcctgcctcagcctccggagtagctgggactacaggcacccgccaccacacccggctaatttttttgtatttttagtagagacggggtttcactgtgttacccaggatggtcttgatcccctgaccttgtgatctgcccacctcggcctcccaaagtgctgggattacaggcatgagccaccacgcccagccatagtcatcatttttaatagctttgtataatttgcttttctaatccctttattggtaggaaattagagttgtttccgactttggcccttaaattgggttatgtgtaggactgctttggaaactaatgttactagggaaatggtgttgtaaagttctagcttctgcgggttgtaagttacctttcaatggagggatgggtgggcagagggagctttgaccttctctggacatacattagaggaaaaatggaagggaggcctgtttccagggggataattgtgccaaagtggaatgtccaggtcaggacatgagccgtgtggaagctggaaccacgtgaggtctgcctagttcatgtgctggccaccacctggaggcccccttctcatccctgctggcgctgggggtgagccatcatttggcaacaggagggggcctcctattctcagccagatgtgacccttccgttccttggccctgcaggaagaagatgaagctgcagggacagttcaaaggcctggtgaaggctgcccggcgaggttcccaggtgggacacaaaaaccgcagaaaggatcgtcgaccctgaggcccagggcccctgggctgccctgtggtccagtctgaggccctttcagcccccaggctgccttgccaccagctccaggtgctcaagattctggcagagcctggactcaggatgacttggaactagggcttggctctcagaagtcctggattttggaaactccaaatggaatcacccttcagagacatccctggtgcctggagatgggaatgtggcctcagtgcctctgagtaggtgccatgaggcacctttgctttctgcccagagtggccatgagcaccagaacagatgatctccatttccgccagctgcctgtagccacgtggcatcctgcctgtggtctgggtgagatttactgtgaccagatgtagaataaatgtgtctcatcctgc

SEQ ID NO: 38133 - DNA, 10430 bp, Homo sapiens
gagatgcgtgacgagcgaagcgcgtgacggaggagcggttggccaacgcagtggcggcagtcggtgtaaacaaggcctcgcgccgctgcgggtcctgcgaccgctcctggctggtgggtggtctcgcgtggggcggttaccgccggcttcagtgggaggtgcttctcggcttcctccccctcatggcgtacacacccccggcgcaccacgtgggcgtgaggcgaggaaggaggggtgttaggccaaattctattttcattggctgtcactgctgccggcctttgtaagggggcgctctgattggtcgataaggtgggggcgtcgagggtctttgagtcctaaggcttctaattggttagatgagataagctagtgaagcgctttcttccgagagggatttcgattggtcggtcagagaggttacctggaaatccaacaccgcccaacacccctcccgctccccagtccggggacttcgataggtgagtttggtgtagaaaacaaatctttcttcagttggtgagctagggtagcgcactacggttcactcttgctttctttgcttcacaggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcaggtaacttaccctctggtgtgacccccagcaggtgctaccacagtgccttgatcccaactccaggcaggaaaattacagaggttaggaaatgggattcgctcaggacagctgttctgtttgagctgaacagcctttccctgctgggcacccatggcactcagctccatacccagtaagagtggttcttacctagggagggtcaccaagaggacctgctcatgtgtttgaggggctattcaagggagcctgtctctgtgactacacaaatatagtctattttccaagtaagcttgaaaaaaaaaaggggggggtcctagtgggaaaggagtgatgtaaggggtgaagagatgggaagggagtgttgaactttttagtaaggcagttgacacatgatatgaggccacttcgatttacttgaaaaacaagtttaatttgccctgactctaacctgttcttgaggaaagaatgccttgaagggagagaccacctggaattgactggaaaagggtgcagctggctttctttctttgcttatggctctttgaggagaagatgggtttgggggtcccttcagaatattgtattcttttttgtttgtgttttgtgttgtttttagtagacatagacagggctcactgtgttccccagtctggagaacgggctattcacaggtgtgatcaagtgcacaccacagcctgcaactcctgggctcaagcaatccttgcctcccaggtagctaagactacagttgcacacaccaccgcacccagcttagaatattgtcttctgtggtggacttctcaggcagaggctcagaaggaaatgctgtgaggatgtttagcttgttgggaggtcaacttagtaggtcatgtccacagcgtattggtcttgctcttgttctaaggaaatgatgttagaatgtttagctcgctgggaggtcaacttagtaggtcacgtccacagcatgttggtcttgctcttgctgtaagagtaaaactctctttcctactgtgttttataggagaccaaaaataacagccaaggtctagtcagcctcaaacctcaaaatgagtaccaagtggtctaagagctagatagccattgactctgaatttggttggtttgggggaagaagtcccctcctttataatgggggtctctccacagaggccaagtgaggttggtgcagggaggaggtgcagcaaatttacaattcattcaggccctcttggactcagaggaagagaatgacagagcttgggatggtcgtcttggggatcgatacaacccacctggtaagaggaaaagcccctaatgttggaagacttttactagaaaaccttttagtgatattttgaatgataggttacattgaaagaaggtacgataatttaaggaataaggagtccttacagccccagtatattcagccacaggggtgggcttgggtacagttctgctaactgtcctctgaggctggcagacctaggatgaaacttctccttggtactcacagtggatgctacccctgacacccgggagctggaattcaatgagatcaagacacaagtggaactggccacagggcagctggggcttaggcgggccgcccagaagcacagctttcctcgaatgttgcaccaggtaggcctctccacctcccagcctggcagcaggcctgccaaagcagccagaagctctgccagccccagagaaaaaggaagtcaactttccaaagtagaagcctcaagcgctggggctggagagttaaccagcctccatcggagttctgtgggacagactatgatgtgtgtgtccatttctataacaagagcaatatctttggaggagggggcttgatatggctgaagtggccctctatttctgctagcaatattccccaatcccttccatttagagagaacggggcctctgccatcggggaagcttctcccttggagaacagtctcgagtgatatctcagtgagtatggggcttggtgaagagactctaagggccagataggtcttatctcctaaactttgaaggggtaggtgttaaaggagcctcagagatattaaaggttaggttaaatggggttgaaactttgagagtaaacaaagtagaaaagtgtagaaaattgtagaaatttagaggatggtggaatggttgaaagacgggattgcactcacagccaaaagggaagaatgactgttctgatattccagctctgttaggattctgctgattgggacactccttatcctgagcacccctcaccctcactttctctctccttccctagcttcttgcccaatgatctgggcttcactgatagctactctcagaaggctttctgtggcatctacagcaaagatggtcaaatattcatgtctgcttgccaaggtaccagaccctggtcctataaactatcttttcctggaacatgggacattccccctgactgaggctagaaagccacagacggggagctcagacctggcttaaggatgcttagccagaccatgtttcccatgataaagggaagactccacaggtacactgagtgggagatgtctaatctagaaaagttacaaggaaactgtcccataattctgcctgatctttacttacacagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacagtgagtatgcaccaggcttccactgactctccagcctgggacctgaggtttccatgtgcctgtcccctctgagccaggatccctcactttgtcctgggaaaatcactcccaaagtgctccagtacccttgtcccctgtttgatctcttccctagcttcacttccactcttcttcccccatccctgaaagattcttgtttttcttgcttctcttagttcatatctgcaatatctatggtgagggagatacacacactgccctggatctcaggtactggcttccctttctggtcagactcatcagaaacttctcaagggaagctctttgggagcaaacctcttgagttggaagttctgtttaggggaaaaagtatactggtgggtctgtgtgcattcctgggagggaagcaccatcttgtcagccagaggactgggtaaaatagatggttgcaggatgatttctgggttctcactgagcatctgcattatggtgcatgttagccagacttcttttttcccctggggatgtgccttacaaccgttgtcagattttatgtagattaacaaaagctgaaggaagtccacttaacccagctccttcttgcttttaggccagatgagcgtcgctttgctgtcttctccattgctgtctcctcagatggacgagaagtactaggagggtaagtgcttgtggggtatgtttccctcaataacaagatgggggttctgccagagatgagttctgctgttacacagatggcactggcagctgcagagaacaaccagaccttctcccaaggtcaggatttacaagttgcttcaccccttgctctccatttccccagcacgagattggaggtgtcaagcctccttgaaacacagctaactcttcccccacttcctgtataaaaagagcaaagggcttgacccagagcaggatttctcagtggaactctctagagcatataccacgttggtcctctcgatcatggctccaggaccctcctttatcccttccctttcagggccaatgatggctgcctgtatgtctttgaccgagaacagaaccggcgcacccttcaggtatggctcctgagatagagcctctgcctcctggtttttggctttttataagacctagaaagaggtcttatatcctggcctccttttcgcctagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaaggtgggccagaagtcaggactgtacagccaggccgctaaggttctagttgcccaggagggcatgaaagcggactggtgtgggaatttgacaagctccttattaaccaaggtttgtaagagttggagtttagggaaggggctcaagccagggaacatgaattccatctgtactcaccagtcctcaaggagcagggcagggctttccgtacaagaaaaatggaagaccggtcaggtacagcggctcacacctgtaatcctagcactttgggaggctgaggtgggaggatcacttgagctcaggcgttccagaccagcctgtgaaacctagcgagacctcatctctatttatttaaaaaaaaaaacaaaaaaaaaaaactaaggccagatgccgtggctcatgcctgtaatcccagcactttgggaggccgaggcgggcagatcacgaggtcaggagatcgagaccatcctggctaacatggtgaaaccccgtctctactaaacatacaaaaaaattagctgggtgtggtggcagtcgcctgtagtcccatctactcaagaggctgaggcaggagaatggcgtgaacccgggaggcggagcttgcagtgagccgagatcaccccactacactccagcctgggtgacagagcaagactccatctcaaaaaaaaattagttaattaaaaattaaaaaaagaaaaatggaagacaatctgattaaggctagaataggaaagccggccagtagcctgggcaaggaaaggaaaacctagccaggtggtaggatctgaggcagaacgctggaaatgagttcacctggatgaagagaggcaagtaaagccagaggccagagttcttctgctcaactagagaacgggaactagactgacaggcgccgacatttgcaagctctgatgcttcactatccacctttggattcatagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaaggtgagactggaagtacaggcacagtggatttgtctgtagcctgggagccctggaggacctccccctcagccctctttgccaggcattaactctttatttgctaaatcatggatggaatggccagaggttcctaggattggggcctgggtgggggtcactcagaatcaaccaatataaaagtatgtgagtgtaatgattaaccggcagggccatattggagactgtccactgactattaggtggagaaagagccaccacttgaagattggaaaggcatttgtctctgggcatcgaaccttgctcaggactggtggtacgaaacaatcccaaagcagatttcctaacctagggtttactctgcatccctacccagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttggtaaggattgtgtcagaacagggggcctcaggaagggcaggaatgactccttgccattccacctataacgactagtgaccaccttaaaaagcccagtgacagctacaggtaaaatcaaacttagcttggaggcttaaacagagaaatagaaaccattctatttttcagtgttttaaattaagaaaaggaacatagaattctagacagtaaatataatagattgccaaaaatatagttggttctgtttttcagccagtcaagaaagaggttgcagatgaaaggtaggagggaacagagacaaaatgacacaggaagatggtagcaagtagttaagggacatgcagtcgctaaagcagaaaagcatagaaagaaataagctggctgcagtggctcatgcctgtaaccccagggctttgggaggccaatgagggcagatcacttgagcccaggagtttgagaccagccagggcaacatggagaaaccttgtctctacaaaaaatggctggacatggtggcacaggcctgtagtcccagctacttgggaggctagggtgggagaatcacctgagcccgagactgcagtgagccatgattgtgccaccgcacttcagcctgggtgacagagtgagaaactgtctcaaaaaaaaaaaaaaaaaggtcgggcacggtggctcatgcctgtaatcccagcaccgtgggaggccgaggcgggcagatcacctgatgtcaggggtttgagaccagcctggccaacatggtgaagccccatctctattaaaaacacaaaaattagccaggcatggtggcaggcgctggtaatcacaagctacttgggaggctgaggcaggagaatcgcttgagcccaggaggctgaggcaggagaatcgcttgaacccgggaggcagaggttgcagtgagccaagatcgcgccacggcactctagcctgggcaacaagagcgagactccatctcaaaaaaaaaaaaaaaagaaaaagaaaaaaaaaaccagaagcacagctgcagatacaaggagcctaaggcagtgctgtccctagagagacactcacagtcccatgacaaaagaaagatgcaccctgtccagataaggtgcagcaggtgcacacacccccagacagctcattgttcacttttgtggtgccttccatatcttactaaaatcttcaaagccagtgcatttccttaactgtagcccctatgaaatttagctaagggccagacatacccacaccactaaaccataccctcaacccaaggtatggaaaggaacagggatagaagcagaaataacacagtcttctggtgtgggctttgctcccatgggaacatgggaagttgcctgagaggcaggtcagtggtgctactcatggggaggtgagggatagtttagatgtcttgtggtggtccctctccactcttgcctgtcctggacagtgtacgaccttctaagtggccacattgtgaagaagctgaccaaccacaaggcctgtgtgcgtgacgtcagttggcacccctttgaagagaagattgtcagcagttcggtgaggttgcaagggttgagggtgctggcacatgtctggggcttggacttgggtgggggcagcacatcctgactgcttgccaccctctgccctgcagtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctggctcagtgtctgtctctctctctcactctctgtttttcctatctgaggtctttcatctcctcacttcaggaaaacacagttcagcaaagtcttcagatgcgatcctgtgtaggagaaaatacccttctggtgccccatgaaaaagggaaataccaaaaccatttgttcactgagccttgcaataggtgctcccttaccaatttcagaagcttccctgcaagtagatatcgagagagcacactttccattagagcctggtaatacccatatcacctctgctctgaggctgggcctgcagctgtgtagtctttggaagaggtagcccctgaacgcagagcctaagagaagcaagtcggccctgacgccaggccccagtgggcgcctcacactcagaacctcataccccagagcaaaccgatggtcagggagagggctagagctcacacccagctcggaatagatcttccctgatgacatttcatgccctctaaggcagtttttaaatgaaggtacacacatccaggggtgttcacaggctttcacagcaagggtacctatttcatggcaaaataggcagttttaaaagaataaacaagctaggtgtggtggctcatgcctgtaatcctagcactttgggaagccaaagctgatggatcgcttgagcccaggagtttgagaccagcctgggcaacatggcaaaaccccatctctacaaaaaatacaaaaagtaggccgggcacggtggttcacacctgtaatcccggcattttgggaggccgagataggtggatcacctgaagtcaggtgtttgagaccagcctggccaacatggtggaacccaatctctactaaaaatacaaaaaaactagccggatatggtggcgggtgcctgtaatctcagctacttgagaggctgaggcaggagaatcgcttgaacttgggagcagaggtgagctgagtgcagtgagccaagaccatgccattacactcaagcttgggcaacgagagcaaaactctgtctcaaaaaaaaaattagccagatgtggtgacgcatgcctgtagtcctagctactcaggaggctgaggtgggaggatcacctaaggccaggaggtcaaggctgcggtgagccgtgattgtgccaatgtactccagcctaggtgacagagtgagaccctgtctcaaaaataaataataaataaataaatgttcag

SEQ ID NO: 38134 - DNA, 49435 bp, Homo sapiens; identical to SEQ ID NO: 37162

SEQ ID NO: 38135 - DNA, 29065 bp, Homo sapiens; identical to SEQ ID NO: 37737

SEQ ID NO: 38136 - DNA, 135 bp, Homo sapiens
atgtctgacaaatccgatatggctgagatcgagaaattcgataagtcgaaactgaagaagacagagacgcaagagaaaaatccactgccttccaaagaaacgattgaacaggagaagcaagcaggcgaatcgtaa

SEQ ID NO: 38137 - DNA, 75611 bp, Homo sapiens; identical to SEQ ID NO: 37416

SEQ ID NO: 38138 - DNA, 1877 bp, Homo sapiens; identical to SEQ ID NO: 36788

SEQ ID NO: 38139 - DNA, 194239 bp, Homo sapiens; identical to SEQ ID NO: 36902

SEQ ID NO: 38140 - DNA, 12857 bp, Homo sapiens
ggcggacgctccacgtgtccctcgccgcgccccgtctacccgcccctgccctgaggaccctagtccaacatggcggcgcccagcggagggtggaacggcgtcggcgcgagcttgtgggccgcgctgctcctaggggccgtggcgctgaggccggcggaggcggtgtccgagcccacgacggtggcgtttgacgtgcggcccggcggcgtcgtgcattccttctcccataacgtgggcccgggggtacgtgccaccgccgtcccggatatttgagtgctggcaggcccggggagggggcgcggagcattgggggcggggcccgaggagggggcgcggaccgcggaggtgggtactgaagaaggggtgcggattgttagggtcggaggctgagtggggggcgcgggaccgtgaggccggggtcatcactggggcaggactgaactcatagggagcggggccttgtgggccccggcggcgttgagggggcgtgatcacctgtcacctgtcgcctgcctggagtgtccaggcacccctgccctccagacgcagaggtggggaggggtcagtgatgggagcggcaggaggctaaagggcatctgccctcctgggcctgaaggaaatcagtcgctgcagctccgaagagggaggaagtgctccttccttccattgcacaaggtcccccctcaccgagggtgtgaggccgggccctcagccctgtactcagcttgtcggcaaagtcctttcccctctcagcctccctttccccgcctgtaataacagtatctttactgttttttgactatttctttttagacttgcgtgcagtggcgggatctcggctcactgcatccttagccttctgggttcaagcaattcttctgcctcagcctccccagtacctgggattacagacgtgtgccaccacacccggataattgttgttgttgttgtttgagatggagcctcactctgtcgcccaggctggagtgcagtggcgcgatcttggctcactgcaacctctgcctcccaggttcatgccattctcctgccgcagcctcccaagtagctgggactactaatctttgtatttttagtacagatgggatttcaccatgttagccaggctggtcttgaactcctgaccgcaggtgacccgcccacctcggcctcccaaagtgatgggattacaggcgtgagccactgtgccaggccagtttgttgactacttccttatagttaggtgtgatgccaagtcctttatatgttaggcccaagttacagatgagaaaatgcttcacataaaaaagagaaacagagagaaactagaggctcagaaaagttttcacttgtccaggtcccatggcaaaacccatctctacaaaaatacgaaaaattagccaggtgtggtagcaggtgcctgtaatcccaagtactcaggaggctgaggcaggagaatcgtttgaacccgggaggcagaagttgcagtgagctgagatcatcccacttcagcctgggcgacagaacaagactctgcttcaaaaaaaaaaaaaaaaattagtcgggtgtggtggttgcgtacctattgtctcagttacttgagaggctgaggcaagaggattactcaaacctgggagttcgaggctgcagtgagctgtcattgtgcccctgcactccagcttgggtgacagcaagaccccgtctcttaaacaaaataaaaatttccttctaccaaaccttttttttccttccattctctaggacaaatatacgtgtatgttcacttacgcctctcaaggagggaccaatgaggtgagttgttcaaaattccctctagcttactgtgacagtatccattgttgtagggagatgttctgtagcagacagcagggttgggtctcacctatatcaccttacactcattgaatgactcttcctaaaccaataaaaagggagagtattggcattaaacagtgacgacagattctgctgttattattctacagagcaagcaaatgtctggacagaaggagggaggggagatgggagtctgccatccccatgagcatctgttgggatgttgtattttatgtgcagtgcaacaagttatcacagcttaggggcttaaaacagcacccatttattatctcatagctttgtaggtcagaagtctgggtcagctcagttgtgtgcttcataaaaccaaactcaaggtattttgggaggctgaggcgggcagatcacctgaggtcaaagttcgagaccagcctggccaacatggcaaaacctcatctctactaaaaatacaaaaattagctgggcatggtggcacatgcctgtagtcccagctactcaggaggctgaggcaggagaatcacttgaacccaggagacggaggttgcagtgagccaagattgtgccactgcactccagcctgggcaacagagcgagactctgtctcaaaaaataaataataaataaataaaggtatcacaggcaaggcatggtggctcatgccccatctctacagaaaataaaaaaattagcccagcgtggtggcgtgcacctgtggttccagctacttgggagactgaggtgggaggatcgcttgagcccaggaggtcaaggctgtagtgagccgtgattgtgctactgggcaacagagcaagaccctgtctcaaaaaaaaaaaaagtctctgggctgggagaagaatcctctccttcaagctcttagttggcagaattcagttacttgtggttcagggaccaaggtcccggtttccttgctggctgttgtctccagctggtggcagaagagccagtaaagatgatttgggccaggcacagtggctcatgcctataatcccagcactttgggaggccaaggctggcgaatcacctgaagtcaggagctccagaccagcctggccaacatggtgaaaccccgtctctactaaaactacaaaaattagccgggcgagccaggcgcactggctcatgcctgtaatcccagcactttgggaggccgaggcgggtggatcacaaggtcaggagatcgagaccatcctggctaacacggtgaaaccccgtctctactaaaaatacaaaaaattagccgggtgttttggtgggcacctgtagtcccagctactggggaggctgaggcaggagaatggcgtgaacccgggaggcggagcttgcagcgagccaagatcgcgccactgcactccatcctgggcgacagagcgagactctgtctcaaaaaaaaaaaaaaaaaaaaaaaaagggtgatttgaagcacatggacacatacgccactgctgcccttgagggaactgcagggcagggaatacacgcggcctctaggagctgagaacagcctctggctggcagcaaggaaatgaagacttcagtcccgcaaccaagaggaactgaaatctgccacaaccacaagagcttggaagaggaccttgagctaccagtaagagcctagcccggtcaacaccttgagatgggtttcgccatgttggccaggctgatcttgaactgctgacctcaaatgatcagcctgcctcggcctcccaaagtgctgggattacaggtgtgagccaccggtgcccggcctcctagagatttttctgtatcctatgtaaagcgcttcagttgcatggacgtgtggagttgacaatcccgtactaatggattgagggttacttccaacccagtccgtgaataaccttggccagggttcattgtacaagtgcagttacatctgtgggaaaaccacccagaagtgggattcatgggtccattttcttaaaagtaaaactgggctgggcgcggtggctcacgcctgtaatcccagcactttgagaggccaaggcaggtggatcgcctgaggttgggagtttgagaccagccttgctaagatggtgaaaccccatctctactgaaaatacaaaagttagcagggcgtggtggcacgcgcctgtaatcccagctactcaggaggctgaggcaggagaatcgcttgaacccacgaggcagaggttgcagtgagctgagatcgcaccactgcactccagcctgggtgacagagcgagactccatctcaaaaaaaaaaaaaaaagtaaaactgtatgttttgagatcatggtagatttacattcacttgtaagaaatcctacagagagatccaagtaccgtttaaccaggttccccggtggtaacatcgtgcaagaggccagtcattttagagatggggtctcgctatgttgcccaggctggtctcgaactcttgggttcaagtgatcatcccacgttggcctcccaaagtgctgggattacaggcatgagccaccatgcccagcctgcattttccattttgcttgtacctgttgcagctccaccgacaacctggaatagtcttggttttcacacccatatggtgtgttagcagacaggagggcttttgcccttctgacctgggagaaaaaggtatctcacgatagttcagcttgtgtttatttatttttcataaatgatatgggacatctttttttttttttttttttttttttttttttgagacagagtctcgctctgtcgcccaggctggagtgcagtggcgcgatctcagctcactgcaagctccgcctcccgggtacacgccattctcctgccttagcctcccgagtagctgggactacaggcgcccaccactgcgctcggctaattttttgtatttttagtagagatggggtttcatcatgttagccaggatggtcttgatctcctgacctcgtgatctgcctgcctcggcctcccaaagtgctgggattacaggcgtgagccaccgcgcccggcctggacatctatttatatgtttaagagttgttcttaggcctggcatggtggcttatatctgtaatctcagcactttgggaggccaaggtgggaggattgcttgaggccaggaggttgagaccagcctgggcaatatggcaagacagtgattctacaaaacacaaaaattagctgggtgtggtcccagctacttgggaggctgaggtgggaggatcgcttgagcccaggaggtagaggttgcagtgaggcgagatcgtgccactgcacgccagcccaggccacagagagagactccatctcaaaaacaaacaaacaaacaaacaaacagcgttgttcctatttccccatccgtgggagccactttggggtagttctcattagaggcaccacttttatgggaaggatgtggtgcaggcaggctccctgatcacagatgacagcaaaccccaggccaccaggagggcggggcaggggatttagtggccagcccctgaatcgggaggtacagaagaggtggcctgactgtagaatcagaggcacacctagaagtctccgagagcagctgtgtgtccggggctgacccgcgctgtcttctctccccagcaatggcagatgagtctggggaccagcgaagaccaccagcacttcacctgcaccatctggaggtgagactcggggtggggatggcatttccggctgccgttggcctgccctgtggcctcaggagctgctttggaaggcagggaacgagggctgcacccctggaggggaagacagaccagcagggagactcatgcacgtgcaggtggggggtggcagggtcgctggggtgggagtgctccccaaggaagtgcactgatgcagagactgagaaggtctgggggagacggggggagcctgtgcggggcaaggtcccaggaaaaggagaagcagctcagagggtgcggagcgtggaccagggcccaggaaggccccaaggggctccaccctcccctaagggtgagacgaactcaccaaagggctttttggcaatttttttttttttttttttgagatggagtctccatcttttgcccgggctgtagtgcagtggagcaatcttggctcactgcagcctccgcctcctgggttcaagcgattctcctccctcagcctcctgagtagctgggattacaggcgtgtgccaccatgcctgaccctttttggcaatgtttaaaaactgagataaaattccataaagcacagcattttaagctcacaattcagctgcatggagtactttctcagaggtgtgcagccagacctctgcttccagaacattttcatcccctgaaaataaactctgttcccatcagagtcattctccttcccagcacatggcagccacgcatccccctcctgtctctgtggatgggcgtgtcctggacattgcatagaaatggggtcaaaccttccctgtgtggcctttggtgtctggcgtctctcactgaacgtgacgtcctcaaggctcatccatgctgaggcccgtgtcagcctcatttcttttcctggctgagtcctattccagagggctccctgcaggaacatgtggagctcagatccccccggctgaaggaggcaggctgaggcagggagcccctccaggcaccaaccaggatggagtcgggggttgggggtggggcgcagattgaagcctgtgcagaatgaggatggggtgggtggagagggcacagattggaggctgtgtagaatgaggatggggtgggtggggagggtagattggaggctttgtagaatgaggatggggtgggtggggagagcacagattggagactgtgtagaatgaggacagggtgggtggggagggtatactggaggctgtagaatgaggatgaggtggggagggtagattggaggctgtagaatgaggatggggtgggtggggagggtagattggaggctgtgtagaatgagggtggggtgggtggggaggatagattggaggctgtgtagaatgaggatggggtgggtggagagtgcacaggttggaggctgtagaatgaggatggggtggggagggtagattggaggctgtgtagaatgaggatggggtgggtggagagggcacagattggaggctgtgtagaatgaggatggggtaggtggggagagtagattggatgctgtagaatgaggatggggtggatgggagcgtagattggaggctgtgtagaatgaggatgggatgggtggagagggcacagattggaggctgtagaatgaggatggggtgggtggggagggtagattggaggctgtgtagaatgaggacaggacgggtggggagggtagattggaggctgtgtagaatgaggacaggacgggtggggagggtagattggaggctgtagaatgaggatgaggtgggtggggaatgtagatcggaggctgtagaatgaggatggagtggggtggggagagtagattggaggctgtagaatgaggacggagtgggaggggaaggcacagactggaggctgtgtaaaatgaggacagggaggaggggagggcacagattggaggctgtggaatcagctagctggggtaggaggaggaggaaggtgctgggcagagtcctggtggaactggcggagctggtgcaggtctgggctggggacgagctaggcaggtggcaggtgtgggagtctgtggggtagtggctgtggaggtttggatgatgctatctcccggggaatgtgtcccaccagaaggggccccagctgtttcccctcaggcaggtctttaccagcatgttctctgaaggaccagcctgatggctcatagccttcttggggtgcagacatctgggaatcagacaaaagctgtgcactctcttccacctgcccgaacacacatgcatctgggtccacagcccctccccaagtctccccagacaccgcccgattctgcccctgccgccatcctctgtcaggctcatggtttatgggcttatcccggctccactcgccccactcattctcgtaaccccactgcctagatcccagctcgatctgggcaaggtcatgaagggaaggaagccgtcaggccccccggtggggagggggtcgggggcttcaggaatcttgtcccttcttccctgatccttggcccagaatgtctcagcccaaacagtgggtatttcttgagcctttattttgtgcagacactttggagggagaagtccaagctatagctccaccactgcggtcaggttaaagcacgttgacaaatgggaggcagagatcagggagtggcgacgtttaactgaaggacagggtgtgatttgctgcctcgtgtgggtgttgtcccgccgtgccctgcggggcgctttacaaacagcaggtgtttctggggagattctcacccactccatggaactggctgcatcacaggcaggccaaggccccaggaggcatcaggagggtcattgagaggagataggccccatcagcccagagagaccctgcagaggccgccctgtagtcttggggaagcccacggtcgccatcgtctgtctgcaggccactgccctgcatggacccctgagtgccagctccccagagggcatctgggcaggtgcaggtctggagcagttgggatggtggctgggctcaccttgagcctgaatcctcctgtccaacccccacaaaagctccccaggggcatgctcagccccggagacctgccaccccaggcctcctcatctcagacagtgactggaccctccctgaccagggctgttggcagtgctagggcttaaagaagaatctagggctccctggatacccccgccccacccatgcacatagaaccccagccagggcttccacagaaatggcccccctgctgcccctccatccccatcacactctcttcacaccagagatgccatcatcccctgctgtcaccttccgacaccttctgccactccagttccttagaagcctccgttagcagccttctagagacctgggcagatgatcctccccacttcttaagttaactcctgtacttcctagtcaatgccctctgagaagcctttactggcctctcattgcccagccccagcccccgtcgtagtacctggattgctgtcagcaaccaagaagccatgtgcagtgaatggacatggggtcctgtcccagagcagctcccagcccacaggggagagaggcgtgtctatgaatgagctggaagaacattctggcacaaaggggccaggcacagtggctcacacctctaatcacagccctctgggaggctgaggcgagtggatcacttgaggtcaggggttcaggccaggctggccaacatggtgaaaccatgtttttactaaaaataccaaaattagtcagatgtggtcgcgggtgcctgtactcccagctacaagggaggctaaggcaggagaatcacttaaacccaggaggcagaggctgcagtgagtgagattgtgccattgccatccagcctgggcaacagagtgagactcgtctccaaaaaaaaaaaaaaaaaaaaattctggcacaaaagaaagagggtctgctgttgagagggccccatccatccttcccagtcagcaggtgctcgtgctcgggaatggcgtccatgttgagaagcaggcacgagacctgctgaccccagcccgagtccctggcggggctccttccagggcacacagacccagacccagcaggcctggcctgactccctcgccccctcttcctctgcaggccccaggggaagtcctatctgtacttcacacagttcaaggcagaggtgcggggcgctgagattgagtacgccatggcctacgtgagtatcttggagtggggcaggctccgggtgtggcttctgtgcactggggcagctgtgagatgtcctgccacaagagggctccatggggacagggaggagaggggacagcgaatcctgcagaggtagggtgtgtaacttgcaggaacctggcacacagacgcccccaggccaggggcacgggggtttggtaacctgttgctgctggcttctcttgtatatgccagaaaagacttctccaggccaggcgcggcggttcacgccagtaatcccagcaatttgggaggctgaggcaggaggattgctggaggccaggaatttgattccagcctaggcaacatagcaagaccctatatctaccaaaagtaaaaaaaaaatagccaggcgtgttggcatgcacccatagtcccacctactcaggaggccgcagcaggaggatcacttgagtccaggactttgaagctgcagtgagctatgattgcactgctgcattccagcctggacagtagagtgaggtcctggctcaaaaacaaaaaagtctcctctccatctctagtaaaagtagaaagctttagtctgtgcttctctggaaagcaaactcaatcgttttcctaatgatgagcattgaactggccctggtaaagtttccactcattctttttcagtctaaagccgcatttgaaagggaaagtgatgtccctctgaaaactgaggaatttgaagtgaccaaaacagcaggtacggaaagatggggatggggtagaggtgacgccacccccatccaagggtgggcaatcggggcagtttggagaggggggtcagccataggggtcctggagactgtagaccaggcatccacaaactgattctataaaggccacctcgtcaatatcttcagctttgtggcactgtgggttctgtctagagctgtgccattgtggcacaaagctgctgcagacagtatgtccatgcgtgggtgtggctgtgtgccactagaactttatcttagctgggcgcggtggctcatgcctgttaccgcagctgctcaggaggctaaggtgggaggatcattggagcccaggaggtcaagaccagcctgggcaacatagcgagaccctgtctctacaaaatttttttaaaaatcaggctgggtgcggtggctcacgcctgtaatcccagcactttgggaggacgaggcgggcggaacacttgaggtcaggagttccagaccagctggccaacataatgaaaccccatctctactaaaaatgcaaaaaattagccaggcgtggtggtgcgcacctgtaatcccagctattcaggagaattgctggaacctgggaggtggaggttgcagtgagctgagatcatgccactgcactctagcctggaagacagcaagattctgtctcaaaaagaaaaaaaattagccgggcatggtggtgtgtacctgtagtctcagctacttaggaggctgaggtgggaggattatttgagcccaggaggtcgaggctgcattgagctatgatcgcaccactgcactccagcctgggcatcagagtaagactctgtctcaaaaacaataaacagggctgggcatggtggctcacacctgtaatcccagcactttgggaggccaggagttccagaccagcctagccaacatggtgaaaccccttctctactaaaaataccaaaattagccaaggatggtggcacatgcttgtaatcccagctactcaggaggcagagacaggagaatctcttgaacttaggagcaggaggttgcagtgagtcgagactgcaccactgcactccagcctaggcaacagaggaagactctcatctcaaaaaaaataataaattttaaaaaataaataaatgaaataaaacaaagtagaaaccatcagggctttgaggttgggactgtggcatgccgaggggaggctgcaggggtcactgggaaacatcagggtccttcttcggttgcctgagcagcaccggtgtcctcaagccacattcagctgcatggcgccaatgctaagcagaaagaggaatcggaggcgccgagctggggcaagggtgggagccaagggagtggacacagcaggtagggccgggagacttgggtgaagcagtggaagccagagttctgaccctgctggagaagtgtcatgagggcctcagacaggttcacccactgagcaggaggtcttgcagcctgacccaccctgcatcctgttcaggccgggatcatctccttcctgggcttcttctggcccctttctgcatctcttcttgacaacatggcacaaatgaccagggttcttcccacctcaggtctttctgtggcttcctgctgcctgccatctatgttagccccaccgaccttaccctccacatcactgttttcctgtctgtcacccgtaagactttcagtgcctggggccttttcacatgggagtctgctttggagactgctccccttgcctgcttagcccccaccatgggccccaccccaaatcctccggacttctgagaattttcaatgttgagggcccaaccatgtgtttctttcttgcagtggctcacaggcccggggcattcaaagctgagctgtccaagctggtgattgtggccaaggcatcgcgcactgagctgtgaccagcagccctgttgcgggtggcaccttctcatctccggtgaagctgaaggggcctgtgtccctgaaagggccagcacatcactggttttctaggagggactcttaagttttctacctgggctgacgttgccttgtccggaggggcttgcagggtggctgaagccctggggcagagaacagagggtccagggccctcctggctcccaacagcttctcagttcccacttcctgctgagctcttctggactcaggatcgcagatccggggcacaaagagggtggggaacatgggggctatgctggggaaagcagccatgctccccccgacctccagccgagcatccttcatgagcctgcagaactgctttcctatgtttacccaggggacctcctttcagatgaactgggaagagatgaaatgttttttcatatttaaataaataagaacattaaaaagc

SEQ ID NO: 38141 - DNA, 20325 bp, Homo sapiens; identical to SEQ ID NO: 38117

SEQ ID NO: 38142 - DNA, 1023 bp, Homo sapiens
gctgcagcagctgtagaagaggtcagctcagccggccagtttgaggagctgctgcgcctcaaagccaagtccctccttgtggtccacaatgtgcacagatgaacgaagttatggcagagttagctaaagaacaccctcaagtttcatttgtgaagttggaagctgaaggtgttcctgaagtatctgaaaaatatgaaattggctctgttcccacttttctgtttttcaataattctcagaaaattgaccgattagatggtgcacacatcccagagttgaccaaaaaagctcagcgacatctagtggctccttcccacccagcactgatgaacatcttaaagaccaaaaaagctcagcgacatgcatctagtggctccttcccacccagcactgacgaacatcttaaagaagatctcaaccttcgcttacagaaactgactcatgctgccccctgcatgctgtttatgaaaggaactcctcaagaaccactctgtggtttcagcaagcagatggtggaaattgttcacaaacataatatttagtttagcagttttgatgtctttagatcaagaggttcgacaggggctcaaagcctattccaattggcctacctatcctcagctctacgtttctggagagctcataggaggacttgatataattaaggagatacacgcatctgaagaactagatataatttgtcccaaagctcccaaattagaggaaaggctcaaagtgctgacaaatgaagcttctatgatgctctttatgaaaggaaacaaacaggaagcaaaatgtggattcagcaaacaaattctggaaatactaaatagtactggtggtgaatatgaaacattcgatatattggaggatgaaggagatcggcaaggattaaaagcttactcaaattggccaacataccctcagctgtatgtgaaaggggagctggtgggaggattggatattgtgaaagagctgaaagaaaatggtgaattgctgcctatactgagaggagaaaattaa

SEQ ID NO: 38143 - DNA, 84017 bp, Homo sapiens
cggggcccggggggcgggggcctgacggccgggccgggcggcggagctgcaagggacagaggcgcggcaggcgcgcggagccagcggagccagctgagcccgagcccagcccgcgcccgcgccgccatgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctcttcattggtgagtgcgcgcagcgagccgcggaggaggggacgggagagcagggagggaggaggaggcgctgcgcgccgcaccgctcggcgtccccttccggcccgcgaccgccgtccgcctcgttcccggggtcccctgccctgtgtcctgcccgccggtccccgcactcgcacaccagctcatcccttcactcccccggtgcccccgatcccgcgccaaacacagcggacgtttgtgacccatgggatcaccaagttttgcttctgcagggccaagagctgggatggggaaaagggaaagaggaggtctcagcacgcagtgggaaactggagaggggtcgggcctcaccctccgtggcgcagcttagggagccgggtcacccctcccgcaaggcagcctccctgtcagccgcagctgggcctagggaagagggaagcctgtgctttggagtctgggatggaggcccagctaacccctatgctttcaccgggctgagccgcgcagtggtccgtgatctctgacagtcccaggcccgcgccctgggcgaggagaggcgagagctagggacttggattcccttcccccgccaccccacccgggcatgtgtctccagagcgcaacttctcaggctctgcgcaaagtagctccgactcgccgacgcagcgaccccggcgcccttgcttgcaaagttgggcgccacggccgggacaatcgtgcgtgcctctccactgaggtcccccccatctctctccaagaccttgactcttccagaccagtcaagtctatcaactcatagggtgtcccctgcatccccaaaacgtgttcattcactttaagaaaacaagcaaatcttaaaattcatatacagctttggggaagaaaggaaagattgtcacaaaattagatttacaagaggttgctgcagaagcagagttgctagttattaacaaagacagttagatagaaatagaaataaaacatacaaaatatgtgctcatatgtgcatcaaaaatcaaaaaagaacagcatttacacttctgttctcagccaaacggtttattaacctgatgacttgtcacacaagaagttagtatgtataatggggtaccttggcagggcacagtggcttacatctgtaatctcagcattttggtgggctgtgacaggaagactgcttgagtccaggagttcgagaccagcctgggcaacatagtgagaccccccccgccctttctacaaaaaattaaaaattagctgagcatggtgatgtgcgcctgtagtcccagctactcaggaggctgaggcgggaggatcacttgagcctaggagatcaaggctgtagtgagccgtgatcgtggcactgcactccagcagaggcaacagagcaagaccctgtctcagtaaaaaggtgtggtgggggaggtaccagcataggaccaggctgaatgagttggacgtttagtttgtgtgtaccagccttggggatcctcatgtgtaggtgtcaccctcaccatggacccaatgcccaagcacctttctggggttcatgcaccctcttcctcctccaagtgggcaggcatcctgcctctgactgtctctccctgcaggatggggaagtcagagctccaaggtgcacatccaccacagcacatggcttcatttccctgggcacaacctgcggtggatcctgaccttcatgctgctcttcgtcctggtgtgtgagattgcagagggcatcctgtctgatgggtgagtgactgtctgaggactcaggaaagtgaatctgctccagggtacttcctgaaaggcccaaggagatcctagctcacctatattccacaagcccatgtcttttgttactacatccagcagctcagtgtcttctatgtgccaacctctctgagctgggcactggacgcaagtgagtcccaggccctgccatcagtccaggagagcagagggaacacggacctgcatgccaagtcccagtgaaataatgctagagcctattagaatgccacaactccagtgaaaaatgtctggcctcttctacaacctgccggagttaccttcttggaaaaaaaaaaaaatctaaccatgccacccactcttgcataagacctttccttggttctcagctgttttgaagatgtggtctcagatcctcagcccaccattcaaggtcttcacagtcagccccacctatctctggcctcattccccatgcccaccttccgtttgggcctcacagcacactcctcacacctctgctacagcacagatcacactgtatgttaaagtttatgtctatttgcaaaactgtcttcagagtcagaaaggcctaagagttagaatctgagtcttgttcatctttgtgttcacagtgcaaggcatgtgataaacataaacattattcagtccataaacatttattgggtccttaggagaatgaatgaaaccatgttacaaataagtactctgggaggtgagaggaaggcagaattgggcaagctccatggttgagagggctttggagcggagtctggaagggtgactaggcttcagacacacagaggaggaaggagagagagaactggtggtgcctgagggaagggaaaaggcaccaaagagaaaagcaggtagggctagggagcagcgcaggggctggagcattaaacacaggctggggagcgatggaggctgaggctgggaacccaggttggggcatctcaggaggactgtgaatcccagcctgcatgtttgggtcggatttggtcagcagtttggaacagaagagagatgtcatcagcataacacttttaggtgggaacctgaggtgttcagcgcaggctggaggcagggagaatctagaggtataatagaagcaggacttagcattgactgcagtagtctaggtgagcaataactgcagacagaaatggtgtgtcagcagtcagggacagaagaggagcgggagcagccatctcactaaggaagaatccagtaaccagcaaggatgagagactgccaggagagggagtggtggaggagagggatatttggcttgagtatctgaggtccagcgccccctgagctggaatcagattatacccagactgcactcctgcagtgctgcctggctcctgtagttggatggcaggggataggctccctcatcctccctcccgttccccaccttcccttccccaatgtccctgcatcctggcttcagcagtgatctctaaaatacctgcttgacttggaggcagcagctctgcctgcttattaaagtccctagaccagcaagaagaccagaaggcatactgctacacaagcacgtgacaagtccgcctccacccccacccctacaccccttccaaagtagcacaaatgccacagtgagccctcagatgggaaatactcaccagatggtgacagagaaagacacctccgcccttggagaaggaagacctgggtcttcagtgagcactgctgctgtgtaccagctatgggactttgcacaagtcattcaggctttctgggcctcataagcatttataaacatacgataaaacattttagttgccaacttaaaaatgtgtgagaaagtataaggtgtttcaaaattatttcaaggagtaaagaggcaagagttttgaagatccctgggcagggtgttggctgttcccagtgtggccattcatgactgctctctggccttatgaaacaagcatcatagtccctggcttgcctgcttcatggggctgtggagggtgaaattcgagcatggacagggtgcagagcccggagtggcagagcactgggtagactgtgtattcccagaatgtgggaaactggaatgaatcggtccagggatgccctcctgctggctgtcagcagcccctcctgtgtgtggctgtactgcttcagctcagtgcaaagggccatctcctccccagggcacagatcagctcaagctgagtaattgtcatctggtctttgtgagctcctacccccaggcctgagtgaggggcaggaaaagagcagacaggagaagtcacagacccttgtgatacctccagtctaatccagcctgggttttcagagctgtctggaaatttagggggcaggtgggagggggctgattaaggcagccctgatttgatttagagtgagcctcatttagtgactaattaagccatcttaaacctgtagggcttcccctcttcctttgggtattatttctttctgtgatgttctgaattcagaacaatcaaaacagtataagttagtgaagaagatattttttaataactacaatattttcccagaccaccatacactggataaagcctgtatataaaactttacctaatttcttaactaattgaatgtgtattatttaacaaagcagctaaaaactattctatgaagccatgtcatgaaatatttagttcaattatggttaatcctcatcttatttcgtcttataaaattttaacatttctacctcctattgcaaaaaaaagcatttatatcagcatataataaaacatgtctagatgtcagcttaaaaatgtgtgagagagtagagggtgtttcaaaattatttcaaggagtaaagaggcaagagttttgaagatccccaggaagggtgttggctgtgcccagtgttgccattcatgactgctctctggccttgtctgtcttgtaccttctatattagtttgaagaccttttttggagaatattcactaaagaatatcaatatctaccatttcattaaaaaagaaatgtggagtttgccttttcaagttggtttgatgcttattgatgttttcagggacccagcctcttcccatctttccataccatcctgtgtgtgtgtgtcagcctatcttccccatggtcacaaggtggctgcctagctccgggtattgcttagcatgagcagagagggcatgctgccgacatgcctctcctttatgacagagatcattctttctttgacatctcactggccagaatacgtggaccaacactggcaaaggagtatggaattgcatggctgcttaaaccaatcaccatccattccctggggctgggtatattgctgctggagcaaacctgtggtcctcctggcacagaataaggggaagatactctttggtggacagcccacattgcctctacacttgcacctcagtcccaccagacccactgaggtcacaggatagctctcctcatgtccttcctccttctctgttgaactcttatgtatccttcaaagtccagcctggtgccacctcctctgggaagctgtccttggttgcccaccccctcctttgtgctctctcagtctctgtccatcggcagtatcacttccctagcctgctgactccaacagttagctctgagcatggcagccccctccataccatcagcttctcaagggcagggacccttggcacactggatagaagtagcctggtgggcaacagcagcactgaggcagcaagctgtagcaggccatctgggaatggagtgggtaccacagggctggagcagaaagggcaggctgggcagatctgataaagtggctggaggccacatagcctgggcctttcgttccaggctgagcagagtgggttttgctgtctgcaggagggagctgtggaagggcatgatcacgaccaactaaggtgaccctcctcaccaggcccagggaagactgaggcctggaaggaggctctggctgcctctgggtcttacccccaggccacagtccacccacttagaggcctctgtgagttaaggtggagagactatgagctggtattgactgctccattccccatcccgagagaggagacaaaatcagtgaccttggaaatgcctcttcgtgcctcagtttcctcaccccataaaatgggagactaagagtacccactcgatggggtttaatgaagattaaatgggttaacatatatcgcatgcttagaacagtgcctggcacagagtaaatgctccataaatactgactctcatcagtttgttatcacagcctctggggagggcgccagtgctgacttatgctgttcgtgttaaatggggctgtcactgggtgagttgtggcatacaggcccctgcactgttcaagagaccccagcaacccttgtgcttagggctcagcacatagtaaggcctccagatcatatacccagctctactccatgtactggcagctctgcccagcccataccccaaatacgcccattaactaaagggccctgcagcctataaagtgatgctataaaggttcagtgttcagcctttgaaattcaaggcctgggctgctctattgcagtacttagcatgtccccatcctgtctgtttctctctcccatctcagggtgaccgaatcccaccatctgcacctgtacatgccagccgggatggcgttcatggctgctgtcacctccgtggtctactatcacaacatcgagacttccaacttccccaagctgctaattggtaggtgaggtgtaggagggaggggcagtaccttcattcatttcttcagataatgtttactgaggactcattatgtgccagctattgctctaaacagtagagatttggaatagaaaaagaaaaaaatccctgccttcatggagcttacagtctggtgaaggaggatagacaggcaaagacagtgaataaacaagcaaacaaataggtggtggggatgctatgaagaaaatcaagctgagtaaggggtaggggcaatgacaatgttgctatctacacaggatggtcagggaagggctgtggtaactgtgggcatgcagatatttgggggaaggtattccctgcaaggggagtgacaagtgcaaagtcctctgatagggatagatttggcaaagatgtcactgtgggcaaagccaaatgagcaaggggaagagtgggaggtgagggcaggcgtcaggagaggagcgagcaagagtcccaggctctgggcctgagagcctgggtgaactgtggcatcaataactgatgtgacagaggagggggaggtgggctgtggtggggataaagttttctactgggggcatatcgagtttgagatgtcacagagacagccaactcaagtgtcaagttgggctttcatggggaggtcaggacaggagctacactttcaggaggtgggccttgtagatgacatctaaagcttgagcctggggctggctgccgtggctcacacctgtaaccccagcactttgggaggccgaggtgggcggatcacccgaggtcaggagtttgagaccagcctgaccaacatggagaaacccccacctctactaaaaatagaaaaattagctgggcatggtggcacgcatcggtggtcccaggtactcaggaggctgaggcagtcaaatctcttgaacccaggaggtggagattgtagtgagctgagatcgcgccactgcagtccagcctgggtgacagagcaagactccatctagaaggaaggaaggaaggaaggaaggagggagggagggaagggagggagggaggagggagggagaagaaagcttgagcctggatgaggtcacctggggagagaagagaaaggctctgggaccagagcttgaggtttgctaacatttagagagactcgggaaggactgcccacttagagcttctgagatgttaaatactgcaggactggggtcccaggcagaagcaacaggatgatggttggtgtttactgagcatgtgccatggggcaggctccatgccatgttccttacattcattgtcccacaggctaattcccccagcctccttattggtattgttaatatccccattttccagtgtggaccctgaaactgagaggttaaaaataataacagtaaatactcactttgtacttactgtatgccaggccccatcctacctatgtgatatattaattcatttaatccttgcaacaactctatgaggtaggtaccattattattttccctttacatatcagaaaactgaggctcagaggttaaataactggcactagtctagctcgtcaaggggcacagccgggagtctagcatctgtgcaatctcctaatcatttctgagactgcgtgtctaagggccctcagacttcgtccttggggtaaaggtatcaatccgcaggtctgcctctgtgttggggttcagcctgtgtgtctaaggctggggctgtacatctggcagttagactttgttcacactatgtccttaagtcagactgatttttaggtatcacagcatcgaattgacatttggagtctggcacactctgtgctaagccagtgacatcatggtgttgtcagggagtacagggtgtttcttgcactagtcacaggtctgcctttctgtagaaggtgggatctgagctccattaggattatccaggtgatccccctacccctagcccaggggcccccacatgagtatgaatgggagctgggggaagcaggttgagaggggagatgttaaatacaggcttcagagagccaccctgcttccatttctgaagtagctccttgtctgtagagaacccttcattaaccagggcctggctgaccagtgtcctctggaaacaccctgtctggacatctgaggagttcattttctcattctccagcaaacacataatgttctctctttaaagcacaagttatcacccgtggatggatttgtccttttctaaggaacaaagactaactccctccattccccttgttggagttatctccccttgaaaggacactccacagagccagaaattctagaacagggaaaagtggaggggacgtgcctgtgaactgcagggacagaaggaaatgggtattgggagaatggccagccctccaaggggctgatgtctggcctgggtatggagtcccacagaaaggggacctgtgatgcagcttacattgtcccgtgagggaaccatgatcctggaacccagatgaggccaaggaaatgttctctgaaaaagtcatatttgagctgagaactgaaggaactaactgggagaagggaggaaagagtgcttcaggcagaggaaacagcatgtgcaaaggccccaaggcagaaggaacaaaacacattagaaaattcagaagaagaagagtggcgtgggtgcaaagtggaggggagctggactttgggttttgtttgcttgtgcccaggctggagtgcagtggcaccaccttgggtcactacaacctccgcttcctgggttcaagcggattcttgtgcctcagcctgctgagtagctgggaatacaggcgtgtaccaccacactcagataattttttgtatttttagaagagttgggatttcaccctgttgaccatgctggtcttgaactcctggccttaagtgatcaggtctcaacttcccaaagtgttgggattacagccgtgagccaccgcacccacctggaaggtcataccacagatgtttgcctttatcccaacagcaatgggaagttgtgtgtgtgtgtgtgtgtgtgtgtgtgtgtgtgtgtgtgtgtggtttaacatgtttaacataaaatttatcatcttaactgtttttaagtatagtgttctgtggcattaagtatattcacagccgggcatggtggctcatgcctgtaatcccagcaccttggcaggccaaggcaggtgaattgcttgagctcagaagttcgagaccagcctggccaacatgccaaaaccccgtctctacaaaaaacataaaaattagctgggcgtggtaatgtacacctgtagttccagctacttgggaggctgaggtgggagtatcatgggaggctgaggagagaggatcagttgagcctggaaagtggaggctacagtgagccaagattgtgccactgcactccagccaagattgtgccactgcactccagcctggacaacagagtgagaccctgtctcaaaaaaagaaaaaaaaagtatattcacagtgctgtgtagccatcaccactatccatctccagaactttttcatcttcccaggttgaaactctgtactcattaaatgataactccccatttctccctccttacagcccctgacgaccaccattctactttctatctatgaatttgagcactctaggtacctcatctaagcggcatcatgcactgtctttttttttttttttttttttgagatggagtcttgctctgttgcccaggttggagtgcagtggtgcaatctcggctcaccgcaacctctgcttctctggttcaagcgattctcctgcctcagcctcctgagtaactgggactataggtacctgccaccacgcctggctaatttttgtatttttagtagagacggggtttcaccatattggctaggctggtctcaaactcctgatcttgtgatctgcccacctcggcctcccaaagtgctcggattacaggcgagagccaccttgcctggcctatttgtctttttatgacttgcttatttcactgagcataatgtcctcaaggttcatccatgttgtagcatgtattgaaatttccttcctttttaaggctaatattctactgtatggatatgccacattttgtttatctattcgtctgtcagtgggttgcttccacctcttgactcttgtaaatagcactgctatgaacatgggtgcattgaggggttttcgacataatcataataattgctttatggagaccagcttggaggagaacaagatggggaggaagtgtggaaaccaatgagaaggctctcagggtatagcgggaatacagaggacgcatgatgatgcctggacttaggtggtaccacagggatggagagaagtagatagagtcaagctatttaggacgtgaaatagacagcatttgttaatgggagaggtgtggggcgagggagaagaatagagggagaaggaggagtaatgggagctcaccagcagcccccatgttatgcctctttccttccttttccctcttctctcatcaggcattcagcttttgctgagtacttctgtgtctgacaacaggctgagcactcagcactgcaggacaggactatgcaaaaaacctctgggcctagtcctgggtgcactgctaattccctgtgtgaccttgcacaagacatccaagctctctgagcctcggattccccacctgggcaggaagagtaagtccctgcctaagtcatagggttgtaatgaagagcaaagcagaccatatctgttaagtgttagggacaagacaagcatgaggcatattttcaagtctcggctcctgtaggcagctctcactaagggctaaagggcttctgatgcctgggatagaatctgtccggcagagtggagtggaggcagggggacagccttcagctgtggaattcctccagtcctagagaccagcctgagctgggggacattattccagtcctgaggcatgagagcagaaggccgatgcttctgccctccatcctaatgtcctcctgcagggacccaaggtggatggcatcgatccccccgggtgagctcagccctgggcgcatggtggggcccaacatctcaacctgtttcctaaccctgagccaggcaggacagatcccagatttgtgcccaagagatgctctggcatccatgcccaggcccacatagggatagagggcagggtgaaagtctctctccctcactcgggtcctctggagaggggctctgtgtcatgaagctgaccttatccgcatctggtctaggagggaggagggaaggagctgccagtgctaaaatctcccccaccctcaaagggggacttcacaggttattgctggttttggttgttggaagctgacagtgatttattggcagattgaagtgagtgtgtgtgcgagaatttaggatagaatctactgatagcttctgaggtttaccttccccaggtcttaaatctggagataataaaaatataacagctaatgtccaaagagcacccgctgcgtgtgaggctcactgcactaaatgctttccatatgtttctcacaagaaccttctaggtagcactattatgattcccacttaatggatgaggaaactaagctctagaaggctaagtgactaatccaaggtcacacagctattatgtcacaggctctgagcccaggtgtatctggctgcggagccaccaccactaacccctgtataacgctgcctcacagaactgtggctggctctttccgtatcccccatgcccctgctccatcatcatgctgtggtgggctctgaactgtgaggacagggatccaggctttcaccctctctctgtccctagctgccagtgcacttgggcaaggtcacatcctatttctgggcctcagtttcctcatctgtaaaatgaaaggctggattgaatgacctttaagatttccctcacttggaaattccacaagtaagtcattatagcatggagcttgcatgcatgggctccagcgtcaggccagcccagctctgccagttaatgggtgtgtggccttggatctgttacctaacctttctgagcctcatttcctttgtctgagaaattgggggtgacggcagtgtactttctttgaaaagttatggtgaggaatagataagatcatgtgtttaaagtgcttacttggcacagtgcctgtaacttagttaaattcaataaataaatttcccattcttcccatgatcatttatttttaagggacatttgtctgaccagtttgatttatgagattattggtgtttttcatgaatgttaagacgtacgtgcgtcatcttagagtcatgtactctgatatattcacacgtgcacatccacttactcggaaatgtacacacccaggcacgcttattctgtctccttctctgccacatacttgcacacattatgtgagtgtacacacatgatgcacacacgtctctgcgatcttccatctctcctcggcagccctgctggtgtattggaccctggccttcatcaccaagaccatcaagtttgtcaagttcttggaccacgccatcggcttctcgcagctacgcttctgcctcacagggctgctggtgatcctctatgggatgctgctcctcgtggaggtcaatgtcatcagggtgagggtaagcaggccacctgggccagggtggggtgggaagcagaggctctggcctctgtcctgccctgggttcaggcccccaccctgcttctcagccaaactgagaagggatcagcttgttttacccgcccgtgtaaaggggagtggggccgtggcggaaatttcaggatagacactgcatctggcccacgtgtgctctaccccagggtcccagagggagaggggggtgatgggtgtgttcgctgaggttggcggatgactttccgtagaaagggaagataagcatcaggcactggcctctcctactttctttcttcgggggtgggggactttgctttaatgtattcatatcgtcacgctggtaaatgaatgagtaagtgttttgttttcctttctgtttgctcccgcctccctctctcttcctcaccccagactccaaccttccccttcccctgcccctacctccccaggcagcccagactaatgaactcgtttgtctttcccatgctttgtttttattagtataataccatatgtgtctgtctaaataaatacctattcaggttttttcctctcaacacaagtgaatatgtaggtttcccccacggtatttatcttgtaagaatgggatcatattatgcagttttctgcactgtgcttttctcacccaacaaatatctcttgggactccctccaagccatctgatatggctaattccgttttcttaatggctgcataatattccatcgtatggatgagccataatgtgttcagctatttctctatggatgggcatttactttgttgccaagttcttgccttcatgaataatggtgtgttgaacatacttatatatttatgtattgctgcttttatttctatgggagagagtccaaggaatggcgttgctgggtcaaagggtctgtgtattttaaattttgatcagtgttacatattgccttccagaaagactgtaatctgccagcaatgagtgagaaaaccctttccctgccttccaaccagcagtgagggctacagccctttcgaacttggactgcctgcatttctctgactcttctgcttttagttggtgatctgcagggcacaaagctccttatgtgtccccccatccagtgaccctcacaggaaccctgtgatgcaagcaccatcccctttatagatgaggaaacattttagatgaggcttgtccaaaaacaccttgctagtaagtggaggaggcaggattcaaaaccaggtctgcatgacttggagttctgtgaactgtatatgaaacatggtggtatccttagatctgtggagaagatagcatatgagagattcctgctcctccccaacccaacctaaacccaacccagcctagccatggggggttcaaagtcgacctcaatgagcagttacaaagtcaggatgccctgacattggtggccaagaagtgttggggaatccttttcctggtaataattacaggcgaaagatggccccatctgttagagatcaagtgtggaatatcacaaccccagatccttgctggggcaaggtagggagtggtgagaagttggacttacccatcccccatggcccatgtgccccacagagatacatcttcttcaagacaccgagggaggtgaagcctcccgaggacctgcaagacctgggggtacgcttcctgcagcccttcgtgaatctgctgtccaaaggcacctactggtggatgaacgccttcatcaagactgcccacaagaagcccatcgacttgcgagccatcgggaagctgcccatcgccatgagggccctcaccaactaccaacggctctgcgaggcctttgacgcccaggtggtcagtgggggcacagccacaccatctattcactgccttctggtttagggtcacagagagggacctcaaagggcattaggtcaaaatcctggtgggacaagaggggaaactgaggctggtgaggggaagaagcttgccttaagtcacacagtgaaccagggacaggtgcagggctgaggattcataggacaggcacagttggaatggcccttaccgtttaggtcgtctagtccaaagtccttatccagatggggaaactgaggctctgagaagggaagtgaccccactggactctcacatccctgtgctctttcctctgcagcttactgactataaaggttggagtgttcacttgatttggagcaggggtgttagtggcctgatccttatggtaactctatgagttgagccagacaggaatctccccatatcactgaggagcaaattgaggccctgagaaaggctgtgacctgcccagagctggccacagctggcaggcggcagaggcagtctcctggctcccagtccagtgctccttcacttcctctgccctcgcaccagggcagttgctgaggcagacacggtggcaggtggtaatgagtgagtgtggcacatggccacctcctcattccagtgctgtgctcatcacatagtccctgaccagctgtgtgaccttgagcaatcatctggccttagtttccccatctagaccatgttggtgttgatagggccctcccaactgtgcacttgctgattccatgatctcttcctggagttcacctatttgcagaggatgtgaccactgggtttccccagacaacaggagctaggggcatcctgggaggctaggcccagccgtgaattagccctcaggcactctgacctggccatggtctctctgggcagcggaaggacattcagggcactcaaggtgcccgggccatctggcaggcactcagccatgccttcgggaggcgcctggtcctcagcagcactttccgcatcttggccgacctgctgggcttcgccgggccactgtgcatctttgggatcgtggaccaccttgggaaggagaacgacgtcttccagcccaaggtaggcagccccaggggtagggtaaggcaccctctagatggttttcagttgtttctgagagtgcaacaggccaatgtgtgtgagccatggccacactggagtggctcctcacacatgcgcaaagcccatagcagtatccccaccacagaatactctacatctggtcaacagaaatgccagagggcgagcctatgccccaagggtatcctactctcctctcaccgtcactaccatagtacctctcccggtagttaggtcagtccgaaaactgcaggaagtgcttttgtttgtccagtgtctagagcttctgtgacttggatttgttggctttcagttcatgtcatcttagtaaactctttaaaagttttcaagatctgtcttcttcagtcctgtaaaggctggcacttgagctttctgcaggggcatcttgggagctactgtcagaggagagagaagtgggaaaccctcacgagtggagctttgtctctccccactccaaatttcattcaaagctgcccgtagttttattaatatgttggacttttccattaaaatttcttttttaagaaaagtttccatggcttaaaaaacactggagacttattagactagattatatccaatggccttggcagttgtaacgattctgcaaactgaaatttgttggagctagaaaacctttccccggggttatttgccctgcgtggggccgtagcatccacttcgggggctgggcagactgtgctctgttgtctgtttccttgcagccgtttaggtttaaatggccacaaaatgaaaactttttcacccctaataagtttcagagttttagtttccaagtgaggatgtcattataacattttaaccacagacagtctgaaaataatgcagagaatggggaattagggtttttaataatttatgacaccctttgcgtaacatttgttcatctcatgagctccaaaatcgcagccagcagttaatcctcaggaggtttatgttcatttttctggagacataattagtcagctgaacagttttggccacagatatgagatacgttgagtctgatttatgcagcaaactttcattgaacactgctgtgtgccaggcctgggttgggctgtgggaatatgaaagcaatagttatgatgaggatgattaacaatattaacagccacttactgaccacataatacatacctggctgtgtgcaggagttatccatgtgttatttaatccctaaaactatcctttggcgtgagtatattttgcaacatctttactgtggtatacctcaaatactgtacagtttatgagatgataggtattcttatccccattttacagatgagaaagttgaggctcagaaagtttaagtaattttccccagggtctctcagctagttaataacagaggcagaatttgaacacaagactcactccacagtctgggcatttacagccaggaagctaaattgactattattatcaagccatcacctctggctccaaggattatgaaatccaacagtgaggagagaaatcaaaataaaatacttttatgctatgtgttacatgtgactcttaggaggaatattcagggaattgtgggaaaagatagtgattaacttagccagtggtcatgaacagcttcatagaggaggggatgtttgaaaggggtcttgacggatgagtaggaatttgccaggctgccatgggaagatttcttgctcaaccaagaatgcaaggaccacttttgcttatttaaactttgatggcttttgaagccatatctggctttttgagcctctctactttacctggcccataaaagagaggggaagcggctgcttctcttgtctacaggagtgtcacctttggctctagcctgaccataggctaccccagaatacccccattggcgatcctgaagcagcatggagccagttgttaatatcagggggaaatggcacaggccagagcccttatcagagtgtccacaccacgctcttcttcctgtgtttcccaaaacccttgtgggattctgctaaggagagagctctgaggcaggacgtgccaaagagatggcgaaagcacttagaattttagttcatctgaacgttatcattgccgtttttttctctttgtttatacacaaaccctggggtttattaccgtctcattggaatgctcttgtcccagttacttagcacacaaatccctgagacagatggccctgcctcagtggcagtgggccttatcagatttaatattttttccctgcagcccaaacacaatcagaaaatttccgacacagaaacaagagttgaaagtaaatatagtctccagtgtccgcaacaaagaactctccatcatgtggttgcctgggatgtggcttaattctcatgtgggcttctgagctcagaaaatgggggaaagggatcatttactgagatcatttggttcatctcccagcccccaagccattctaatccagagagaaccgagtgctattctggtctttatgaatgacaaagaaggaagctccctagctacatgttgcagtgtttcacagtctgggagaggaagccgttttttctgcccagcctgaatccatcctgcagcagttggcacagcgaggcacctgtggtttattcatcatcactcttccttcctaagatactcagagttggcaagaaacatgtcatccttggtatccgcaaggacgaacatttctgatgtcctctttagttactgaaagtgtctgtgacttgccagatctttgatgctcctgtcaccccgctgccactccccagggaaagctgggacccaggttgggctctgcctatgatctatagctctttccagcctcctctccaacccaacccctactcccaatctgtcacctcccatggatgccactgatctggctgaaggacaagagaattagattcataatgagctgctggtgtctgaaacctgccagcactgccctgggctatcagttgagccaaaggaagaaggaacagtctgggtttgatcgaagggctaaagcttcaaacagcctctaagtctcagtaggaaaatgtgtaggtttgggagggtgtatgtgtttccgaatgagttcccctaagaactgcttatggttctatatgtgtgttctgtttgtccctgtgtcttttggtgtgtctttttctgcgtgtgtgtgtgcatgtgtgtgtgtctatgcccccgtttggattgccatatttgtggctatcattatgagtgacttaatgagtgtatatgcattggtgtttctgtgactttgtggttttgatgcatgggctggcctcttcataaccatgtccatgcagctggtctggcctagagtacctgccttcaattcactagctccttcttggccatcaagactctgctcaaatgtcacctgctccagggagccttcacctggttgaattagatgccccttatctgtgctcacataacatcctatcaaagcgccctgtttctttccctgacttgatcctctgtcccctattgcctgacctctgtgtgcccagcactcagcccactgcctgacacccaggagatgcacgggaaatggttctgcaaagaaggaataatgcagcaattactatatattgagtgcttacacttactgttttttcacatgcactgttacattgacttctcataacaactctctgaagtcccttcatagcctcaccttacagatgaggaaactgaagctaagagaggttgaggaacttacctaaggacacagtggctaatatatgatgagtcaggacctctaagtccaggctcttaaccaccgtgtcaaacagtcttgtatgaatgggtaggtgtgttggtctctgggtggccaaagataattttattctttacccagggcctcccggggctgggacctacggacaactcaccttttgacacctgccaaaataggaaacaagagtccaagtgatcccctctcctttaagcaccagagaacatgtgaaggggacctttccaatcatacctctggcctggcagagacaatggggctccaaactgtagagtcgggagtgctgggttttagtcctacctctgcagctaactcatttattctcctcagcagtcacattctgcaagcctcaaatgcaaaatgtgtaataacttctgtagaaagtacatgggggcatgaagatcattggcttgattgcttttaaaaaatcggtattgagcactactggggaaatccctggaaacaaacacaattcttccctgagagcttgtgaaaatgcaagactagggcctatgattttccaaagcattttcttccaccaagtgtcaggttgtaggtccttggtcttttctctcttgccttggtacctgcagggtgctgaccagtgctatcatatcccctccccgtttcctaggaccctcttctcggtagactccaacagggcctgccttccttgggcagcatggcaggcctcttggctagtctagtacccacttcttttttttttttttttttttttggatggagcctcactctgtctcccaggctggagtgcactggcgcaatcttagctcactgcaacctctgcctcctgggttcaagcaattctcctggcccagcctcccaagtagctgggattacaggcatgcatcaccatgtccagctatttttttgtatttttagtagaaacagggtttcagcatgttggccaggctggtctcaaactcccgacctcaggtgatctgcctacttcagcctcccaaaatgctggaattacaggcatgacccaccacgcctagtcaggtacccacttcttaactgaaacttagctattccaggttctatcccttttaaaccaactctttgaagagaggtctaataatgacccaatgacttatagctgcagtgagatttttattttaacaggtcacaaaattctcaatccacaaaagtagatttctgaccctaggttattttgttgggggcggagagaggaagtcaaaggttttgcagcctttagagctgcaaaaccagaatttgttgttttgttaaaaatgcacaaataccgacgagtatatttaagtaacacccatagtctaacgaacaaacatgatcagttggcttttccagccctcattctccagcctgtgtgttttctgctcattgtaacacagcgtgtgtgtggcattccatgtttctccagagctttcatgagaatcagtggtcttggatgcatagtgttcccatgagtaccttaattacctaaccattccctgtggttggaaatttatatgggtttttgcattctccttctgctctgaccccaaaataaatgtctgtgttcatacagctattaccttatgtgaaattattttctttgggataaattctcatgatgtgttgttgctttaaaatagtggactccagtctccagagctgcgtctctgcagaggacagtgggacagaagaatcccagggcatgttaaaaaggaccgggtcttcctaaacccacatgcctatatttctgacccagtaccagccaggggggcaagtttccatcccccacaagtcacaaacctgtaactgacactaggatgcttaaggtcaaaggcctggacgaggcctagacagtgggtctggggtagtgtttttgacatcactcaggttcatgttcacatgttgtccccttaccagcatgtgaccttgggccagccactaaccctactgaaactcctttttttcatgtatgaaatggggctaataatggtaccctcctcattagggtattgtgaggatagagttttgcacctgataaatattgtctcctgccccttcctcccctggaaattcaggtctctccctgcagcctaattttaaggcccatttttctgcttccagcccacccctgcccttctaccttcgacctcctccctctgcctctccctctggtgcactggcaaatgggacagagagcctcggtagggccttcctcttagagtcttgcacgcatccctcagtggtctccctgtggctgcttcctgctgccaccaacagatacagacccctgtcgcacagatcatggtagagacagtggtgagcaggaccagacagctccagggagcagtgagggctggcttagagaacctctgttaaactgagaggccaccatcaggaagctctgatccaagatccaggaatccctgactctagggaaaggcctccaatgagagcctgggccctctctgcctgattctgattgtggatgtgccctcaaactccttctcatcactttgttccatccctctttaccctgcagcagctcccacaccctgccaaacaggatgcacagtccagggcagtgtctgagaaagagcagagatctgtcttcatggaaatattgatgtggctctgctggggagcaatggatttatcaagatcaaagttttcctgggagttattgatgcttaatttggaaatagacacactgttgatccctggtatctttagcaacaaagttaaaatgtttgtttttcttcactggttgccatctgagatcttgccggaagtacacaagagaaccttaaatttaacaggaggccctgggagcccatgaggctggcgggcttgggtctgaaatcttttcagtctcttgtaagtgatgagctctcattctctcctgagagctctacggtgccatgttttccactggccttttctgctcagtaattgctacattacaggctgttggtaagttcggaacaagggagctgctgattccatttctgtagcagagaacatgcaccgtgagacttgttgtaccagttcaggttttaggtgctctatttattcttgccccattcagaatgctctcccctgggtctgtggccacaatgctaagagtcatatttatgggcctgcagttgtaattgggccccattctgttcccccaagtggaaagatgaacagggtgtaagcaaccttccctgtagttagaaaaacgtttagttggatttatcagtctgatttttcactcataaacaattgcacaagcctttgcaagcccagagggtcttgtaataatgatggccgtggtccattatggcacagtgatgtgttctacggtggtcattttgctggcaatgacagtcacctctgaacttctctttccaacagacacaatttctcggggtttactttgtctcatcccaagagttccttgccaatgcctacgtcttagctgtgcttctgttccttgccctcctactgcaaaggacatttctgcaagcatcctactatgtggccattgaaactggaattaacttgagaggagcaatacaggtacttggatgattattttttcactttgccataagaaccattattaggaataatgtccatgagtgttattcatcctcatggacactcaagaataattctgctgtaaatttattttttgttgcccattaacgatgttttaaaacagtaaccattgacaaggcagtgtgggatagtggaaaatatcttgggctgaacttgggagacagtgtagctctggctctggttctgccttggactgggtctgaaaatccagctgctcagcccttggcttgaaagtggtagacgtcactaattgatcacagcactctttctgaccaagggtaaatgcaaccttggaatcctctctaagtggctgttccagagttctgctaccagacagtcttctttgggtgtgaaaaaaggaatgtgcttgacatacaaggtctagatagcctctaagacagggtcccctctaagatggggtattggtccatggcctgttaggaactgagccacacatcaggaggtaagcagtgggagcaagcattactacctgagctctgcctcctgtcagatcagcggctacattagactctcataggagtgcgaaccctattgtgaactgtgcaggcaagggtctaggttgtgtgttccttatgagaatctaatgcctgatgatctgaagtggaacagtttcatcctgaaaccatccctctcccccaggtccatggaaaaattgtcttccacgaaaccagtccctggtgccaaaaaggttgaggaccactgctctaagttctatttgaacccttaagtcttgctcactaatgagagtgacctatttggtctgttgggtcacttaagtctaggctcttggtcctgccttctgtgatttccttcttagagtttctggaaagatgatcaaagccagggagtgttcagggcccctctgaagaaggtgatgatgagagttgtccaagtcccagggtcttcactaggattttggttcagctatcagactagagagacatcctgattgagagtagtttaaatgggatagaagtttgtttattcttcagatagagtcagggctgacacaggagctactcaatgatcagagacctggcttcttctgtcatgttgctctgccagccttcttttgtgacttttgtctccatagccatggtgggtattgaaactgccactatatttacatttaaactagccagaagaagggacaagaggagggaacgcattttccttttaaaatggtaatacctgatttgcacataccctctcgcatcccattggtgagaaagtggccaaatggccgtatctagagagtctagaaagagcttggtctttattcttgacagctatatatgcactgctagaaattctctgtgcaaagaggagaatgggcattgggaataactagatgcagctatgcctagtgatgtccatgaagttgtggtaaaatcctgaagctaccttgttctttggaaatgttcctcagaatcattaacattagtcatgtgggagacaggagaagaagctctgcagaaaagggaccgagaggacaaggatatagcttgggctggggacaatgtcagagtccaaactctggctatcttggaatagtctgtgtgaacggtgccctcccaagttgtgcagtgcacaacctgtgcagctatatatggcaaccctgcccatccccagtggtttctcactgggaaagcagagtatttcctcagggatgtcattatgtgacaatagtggaaaaagcccaggaaaatctaagaccttctaagactcatgggggcccagagctgggaggaaccaagctgttgctcagttcagaaaacttctctagaaatcccagcctctcctcacacccctccagtgacaggcagacttgcaccaccacaagcaacagccacttttgtggttgggcagttttgtaattaaatatactaatgtgtgtatgtcataaattacattttccaattatgccaaaagagccaaaaatggttttttaatggttagcatataatcgtttttatcaaattgcttgaatctttcatgttaataagagagattcattactatgccacaaaaagcaaatactggcattaattatagaaacaaattaggggggtggagcgcaatggctcatgactgtaatcccagcgctttgggaggctgaggcgggtggatcacaaggtcagaagtttgagaccagcctgaccaacatagtgaaaccccatctctactaaaaatacaaaaattagccaggcatgttggcgtgcacctgtagtcccagctactcaggaggctgaggcaggagaatcgcttgaacccagcaggtggaggttgcagtgagctgagatcgtgccactatactccagcttgggcgacagagtgagacttcatctcaaaaaaaaaaaaaaaaaaaaagtggctcatgcctgtaatcccagcactttgggaggccaaggcgggtggatcacaaggtcaggagatcgagaccatcctggctaacatggtgaaaccccgtctctactaaaaatacaaaaaaaaattagccaggcatggtggcgggtgcctgtagtcccagctactcgggaggctgaggcaggagaatggcgtgaacccaggaggaggagcttgcagtgagccgagatggcaccaccgcactccagcctgggcgacacagcaagactctgaaaaaaaaaaaaaggaaagaaagaaggaaaggaaaggaaagaaaggaaaggaaaggaaggaaagaaagaaagaaaggaaagagagagagagaaagaaagaaagaaagaaagaaagaaagaaagaaagaaagaaagaaagaaagaaagaaagaaagagaaagaaagaaagaaaaagaaaagaaaggagttagggagaaaaaaaccctttctttctttcttttggagatttccggaaaatgtacccttacggatgagagcctgtgtcttcatgggttagagaataaccacgctttgtgcataaaaagttattaagcacaattcctgaattatacataattactagctgtcagtcagttgtgcatttctgtgtatgctggtcttcacttaataagactttatttcacagatcacttggtgtccctacttcactgaaactaggtgattatcttttgaagtctcatttcacataacctaggaggtatatagatttctttaaaaatgtcattgccattattttaaaccttacccatggtatatataaacttacagaaagacagaataggttcattattttaaaccttgcccatggtgtatattagctcacagaaagacatagaataggttcctgccttaagaaaacctgacccacaaaaaagcctgggtttacacaaaagaggaattaagggcggggagcccaccttacaacagaatgaataatagaattttatccaagagcaggcatcctgaggacatttaagacccggatgcatttttccttgttcaagagcacacatccaaaaattgcagtctttctgcgagtcatgatcactctgcacataaagcgtttaggttcagagctcggggaggccattaccatggctgctctctgtctgccctgtgagggtccttggggtggctgcactctggggatggtgctggggctgactgactcacgcggtcgtgtaacacatcagaccttccaaagtcgaacccttgttttgtttcaaggctcaattatgacaggacttggtctcagagcagatcccctccctaggctggagaaggccactttaaaacagatggcctgccccacttcatcatttttatggctctgatctgtgttctccactggcctctggtaaatcaagaatacaagtggacatgaagatctgctttaaaaaataaagaacagaccgggtgcggtggctcatgcctgtaatctcagcatttggaggccgaggtggatggatctcctgaggtcaggagtttgagaccagcctggccaacatggcaaaaccccatctctgctaaaaatataaaaattagctgggcatggtaggcacgtgcctataattccagctactccggaggctgaggcatgagaattgcttgaacccggaaggtggaggctgcagtgagctgagatcatgccacttcactccagcctgggaagcagagcgagactctgtctctaaataaataagtaaatgaattaaattaaataaaaataaagaaccaattaagtcctgtctacaggaaaaggccttacttgctggagaagtagcttgctgtgctggagtagactagtaagttggaacggtgatacagtaccaccttacagagctgctctagggcaccatggggactgtctgagaagcccctggcacactgtaacaggtggcatctggtgtggtgatgatgatgagaatgatgatgaatgtgaaacactctgctctcatttctagaccaagatttacaataaaattatgcacctgtccacctccaacctgtccatgggagaaatgactgctggacagatctgtaatctggttgccatcgacaccaatcagctcatgtggtttttcttcttgtgcccaaacctctgggctatgccagtacaggtactagatgggctgaggggaagggaggggggcagcaggacacacaaccagaatctgctggtccatggccagtaactaggagcacaccgtcttccactccatgcttgcctgtacctttcacacacttggctataccacaggctgtacctctgggtccctcctgtcccatactctgcaagcactgaccatctctcttaatgaccagagaaggcagtatcattaagactttaaaaatggagccaactttataaactatagaaaaatcaagccaggttcaggggctcacacctgtaatcccagcactttgggaggctgaggcaggaagattacatgagcacaggagttcaagactggcctgggcaacacagtgagaccccttctatgcagaaaaaaaaaagaagaaagaaaagaaaaatcgtacatggaatgcccacagatcttaaaagctatgttgtagcaaaatatttaattacatcaaaaagtgttagtgatgtatttttaagcaaaaagagtaagttacaaatagtatatgttgtatgcttactactaaactggaatatatgttatgtatacatttgtacagattcacacatgaaaaagaattggaaaatcacatagtgggattataagtgatttttattttctttatgtgtttctaaattctctaataagcgtgtataagatttggaaatcaacaacatgatacttttagcctaggcaacaaagtgagaccctgtctgtacaaaaaattagctggaagtggtggctcacaactatagccccagctactcagaggctgaggtgggaagattacctaaagtccaggaggcagaggttgcagtgagctacaatcacaccactgcactccagcctgggcgatagagtgacaccttgtctcaaaaacaaacaaaacctggtgttttttagccagatgtggtggtgcgcccctttagtcccagctacctgggagtctgagatggaaggattgcttgaccccaggagttcaaggctgcagtgagcaatgatcacgcccctgcacttcagcctggacaacagagagactcctgtctcttaaaaaataaaaataaaaacgttaaaacatggtatttttttaaagcaagacaacctttggtgctggctcaggaagaggtacattaccccccaataatcagaggagaatcgtcagcatgattgatctgacctcgggcttcatgtgtcccatctcccacccggagctcttccaccacagagtctgatcctgtcctatgcctgggactaaatcttcaccctggtgttcaggccagaaaccgaaatcccagacccattcccagagggcgggaaggttccaccgggagagcttgatgtagcagaaagtgacttgggtgagacaggctgattcaaatacttaacctctctgagccttggtttctttatctatgaaatggggaggctgcccaccctctggagttgctatggcaattcagttagataatgtaagtaacacagcaggcagagtggcccccagagtcttcacttcgtaaatatcagatccctctaccttgcacatgtttggtatgagtgaggtgttaccaatccagaatccattgcttcttgggataaagattccataaaccttcatctccagtgatttgtattggtcctccttacttgtaaagcttagagtttaaaaatattaaaagaaaaaaaggggagaggctcccacagggacacagctagacaagatgagatgcagggaatctgatgttcttttttatgggaacagtcatatatgccatcccccattaccacctacccatgcccagactgcccccgctccattctgccaagacagatcaatgactataaaagctacaaaagggcctggagatctcatctagtttagttaccaaccaaccttttatgcacaagactttctaagctgggtgtggtggctcatgcctgtagtctcagccactcaaaaggctgaggtaggaggatggcttgagcccaagagttcgagtccagcctgggcaacatagagagacctcatctctaacacaattttttttttgaaacatgaaaaatgaagatttctgaccatgcttctctcattagttaacactttgggctgtgagggtctgatgcagagagacacagcctgggaggatcctaacatgtacacagcattcaaaaggctacaagacactttctgttgtgtccccttgaacaagcagtttgtaagattttgttggccaggcatggtggctcgctcctgtaatcccagcactttgggaggctgaggctgatggttcacctgaggtcaggagttcgagaccagcctgaccaatatggtgaaaccccgtctctactaaaaatacaaaaattagccgggcatgatggcgtgtgcctgtagtctcagctactccggaggctgagacaggagaattgcttgagcccaggaggcggagactgtggtgagctgagatcgtgtcactgcgttccagcctgggtaacagagcgagactcggtctaaaaaaaaaaaaaaaaaagaaatcaggttttgtctactaaacctgctgcacggttaccgttactagtactcacagggtttgttgcacatgcatcgttgctaatagtgctaactaatattaacagcccttgccctatgcctggccctgtcccagcccccctcccttgtataatttaacccttgcactgggggtagagattttcatatctactgatttcttacctttgctcatttatcatggagtgtcctttggttttctgtgtttgtatatacctttaccacttatagatttgaccagcactcaagaaccagtgttactcctgggagttaatacaatcccagccccatggcaaagaaactcatgtggttaggattctgtgtgcagcctggttagccacagggcacgtaaggctttttataatattgacatgagtgcagaagccccattcccgtgtaagccctgagggctcttgtttcataatctttttttggtcacatgcacacagctttattgagatataacccactcatttaaagcatacaaatcagtgggttttagtgtcctatattcacagagctgtgcagccatcatcacaaatgtggaagttttcatttccccaaaaagaaacccgtacccattggcagtcactcctcatcttcgcccccagcccttggccaccgtttatctacacatacttttgaaaggctagtgaaactttctcagaaaaataaatgcttgctcaaacatttgggctataatttcaggggcttcatgggtgcccccctgacatttatcaagaacaccaggttaaggaatttagctataatggaggcctctgtgtttcccagtctcctgggtatcagaggcccagagagggcaggtgccttaccctgggccacgcagtgaaccagtggcagcaccatactcacacatctcctttctgcggttccccagtgacagagttctcaggaagctttttcatttattttctgagaggagggtaggccatcttgtattgatctccaactatatgccagccacaattctaggtgcttatcataaaggttcatttaatcttcacaatagtcctgcagagtggacagagtccttcagagtgggcattataatcaccattttaaagatggagaagctgaaaaccagagaggttaagtaactcacccaagactgcacagcaaaaggctggggctttgaaactcagggccacagactccaaagactatgtcctccccactatgctagatttttttcctaacctgtgaataggagacaaaatagtccttttatttctcacagttgctttgcacactcagaatccatgatttcttctgcatgagggccattcagacctgtgcagaagagagtaatggaccaaggagtcttgggagcacctaggaggaggggatgggggagcatgaggaggagccagggaacagcagcagctgcagcaccagctcccaccccagcctctgccagtctcttggaggtggtgtgggtgcagacaccggctcacaaggtgccctgttagtgagcttggggtgccatgggagccttcttgttgtcaggcccaacccaagctggctgaagaacaccctgatggcctccatttgagcacaactaatgaaggactggatgccagagataagtccaggagggtgatgctgcagggcaggccagggaagagggtacttcatctctatcatggtcctctgcccatccatgccagcatctaacacctgttaaacactgggaggcaggtggtgaaggggccacttcccagcctctaagatacctcctaagccaggaggcattctgtgattaaattacagggcctcccacttactcctttatccttgaggcggtgctggaagcttaatgccaatctggtgtagggctctgggactacaggaccaaggcaagcagtcctttctctctctctctctctttttagctaaggaagccagcacatctgttctttgagaaaaagccctgtatttagaggtgtctgcctttgaaggcaacctgagaaactgtcatcttggcgctttggggactggccatttacacttctcataaatattcagaagtaggcagtcatttacataaagctaaatgcagaaggaattctcttttcagggaatacctggcagattcattaaaaaaattaaagaaaccaagagcataagaatgaaaagcgaattctcggaccccaggctggttttttctggcatgggtgcagtaactttgcctctttgctcagttatcacttttttccaatgacagtaaccataagccctgagagccagcaaatagaacaaaaggtgctgtcacaaacattgtgcaatctcatctctgagatttccatctggaaaatagactggagagagttaaggcttcaaccagccttgcagataaatgcagttagttaccagcccagcaaccctctgcttgcatgagagcccattatgctaacctccttttgaaattgctttgtttctcctccttccctgcactccactccccaagataatttggaaacctgggcaccaaggcttgtcccactctaggggactggggaaacagggattttgccagcacctcctggcagggcaaccatcaggtcaaagggacctgacccatgaccccttcctcagatcattgtgggtgtgattctcctctactacatactcggagtcagtgccttaattggagcagctgtcatcattctactggctcctgtccagtacttcgtggccaccaagctgtctcaggcccagcggagcacactggtgagtgcccaaaggtgtgtgtgttttgtccctcttcccctccttccctcgacagcagcaggtctcctcccacacacccacactgtcattgactttgactttgactttgagtaggccacttcacctgtccaggcctcagcttctttgtctgggaaatggagtcaatgggggaggaggctgcctcccggtgaggacaggaggcgggcatggcagtgacagtattgacactcaggccttcctctcgggtgggagacggagcagaagcctctcccctctgactcggggacccctgcaggagtattccaatgagcggctgaagcagaccaacgagatgctccgcggcatcaagctgctgaagctgtacgcctgggagaacatcttccgcacgcgggtggagacgacccgcaggaaggagatgaccagcctcagggcctttgccatctatacctccatctccagtgagttcaccccacacagccagccctgggtgctgctgcgtacatgcaaggagagggtgtcagagctcgggtaagagggggtgcagggacagaagcaggaggccttgagattatccgactcagtaggggagcctcaaactggctctgatagctaagctcccagaaatcaaagtactcttcattcatttatccaacaaacatgcatggaaagcctgctatgtgctggacactgtgctggccctcaggatacagtgatgaggaagagagatgaagtttcattcctcatggaactgatatgttattgacagacagcagcaagtaagtaaatgaccacagttttgaactctcctaagaatgaagactttttagtaagtcagactgagctgtcattgccctggggaagctacaagaaagcttccatccacttggggctatgcaaaagaaaaagactagttatccttaaatatcagaagcccaggctgaaggtactcacaggtgtagggactgaatttatattaaccaagtagtttgggaaccccaagccaaggaagaagaaaaagaccaaaactggtaaaagtcctagagtcccatatacttgaaaccattttactgagaatgtaaaacttttttttctttttttgagatggagtctcgctctgtcacccaggctggagtgcagtggcaaaatctcggctcactgcaacctccacatcccaggttcaagtgattctcctgcctcagcctcccatgtagctgggactacaggcacacaccaccacacccgactaatttttgtatttttagtagagacagagtttcaccatattggccaggctagtcttgaactcctgacctcgtgatccacccgcctcagcctcccaaagtgctggaattacatgcatgagccactgtgcccagcccaaaagattttttagaaattgaaattttagttatggaaattaattcagtgaacaatggtcccctggtcagagtgagggcttacggaggtcaggtgatccatggagtcctggcccaagtttatctcacagttggtctcgtggctccgtggacccatcccatggtggttacttcccaagtgcataattgggatgtagatatttagcaaccagctgacttcacactagttccctgacctgtccagtctaagagtcattatggccaagtggaagcccctggaaagaagaaaacaaaaaagaaaccaaaacttactcagtgcacaggttacatgaatgagtatagctgaagagagaatttttgaattagaagacagatgagtggggattacacagaacgtggcaaggagagtaagttggtagaaccattttacagatgggaaattaaggccagaggggagtgtgttcctgagatccctcctgaggttagtagcatggctcggactagatcctccaaagtctcttaactcctggtctcaggctattttccacaaagagctgggggcctctgtggggtgaagaagacttaggacaccatggggcaccattatgaggccatttcctcctaggagaaaaaaaatctctgggctctgaaaggagtagaattagggtaggaaattaagagaggctaccgaccacctcctccaactaaaattggttcttttggtgccaggaagagacacacctggtgggggagggaaggtggtaatggagggggtgctggtagtgtctcccagatagacccatccaacaagtctcatggagaatgagacggtcactcaggtcatctgcgtattcttggcattcttgctgcctagagagagagtctgatggagctaggtggccaccaagctgtcccactccccaagacagtttggaaacatgggcaccaaggcatgtccctgtctaggggactggggaaatatcccatagcagtgttctcacagtatggggctggccatgaataccccaggagtccaacctccctttgtccagctagaccatggtgtcctatgcctcaggcagggaatgtggtccagtcatcagtggctgggccgtctgccatacatggtgcaagccatggcgttttatgcagaaagtcctgctagcatttgattttctcagaatggagctgtgagcatggcaggcaaccactgtttcctggattcttcaccaagacaccccaagttcctggtctctccccgttatcctcatccctgaccctgtggttctcagagcctccaaacacactcaggctaagcactccatagacaggggaaatttggaaggaacatctagggagctcagaaaagccaatgtccctagccccaggcccacttcaaccttctctctgtcagtcctgcctgcccctggaggctggttacatgaagagtaaccccctgcttgtgtatagccccccagttttgtacaggtttagagacagttcccagcagtaggaacagctgccgaggtgggagagggcttctcccgatagccgggggacttcctctcccaggaacaacagggtggggtagagcaggcttgtcgttgctgagatagagagagggaagggaaacaacaaggaaagtgggggcactgggtccccaaggttcctggcacagcaagcagtgaagttggggcagcctcaggtcatgtagtgggggcaggtgacatctgctttgactgctcctaagagatatgtactcatctcctggattccaaactgcagcctgggacatgttttcttatataaacagcatcaaaagatgtgtgagttcccaggctagcccactgaaccctacctagtgggtgctcattgtcccccagagcccccagaagacaagccgtggctttgtgatgggcctggggccaggaggacctagggatatgttgtgaagagctgagaagactctggaaaaaaggggctctggagccaagcaggagcccgcccaggactcctcacgtgtccaagtcacctagggagagaaacagagcagcccaggttggtccctggaagagagcagcggaggaggggaaaggggagagcccctggggagagctttgaaagtcaagtgctgtttgctcagtgtgtttgcctttccgaggatgtgtttttttttccctccgttagtcagcagtgggagggggagagagacgggtggtagggtgcagggtacctcctggctgcaggcatatgctttgagtgcgtgttcatttacctcctctggacttcctgccttctgttaccagggatcaagacacaggtcattaggcgtgaggtaatggggcatctcttgttctgacccctggcgccagtcttggagtcctgacgctgcagaggagccccagagtcacatttcctgttggggcccatcctgctcatatgcggcaccatcagacttctgggcaggcaagattacctgtgactctgtctgatggtctcgccatcaatatcactgagagtagctgtgtatggagtcccgaactggtacaggataaaacagggggctgaaaagggaatgaatgggcacagtttctctggcatcaaaagtcacatccagaattgatatttcctgttgagtaaaaatagaaatataagttgctcagtggatgttgagtgagccctattcatgtgccccactctgtgccaagcaccaggaaggagggaagggaaaaatgataagatgttctccccgttctccaggagtttatgctccactaagaagtcagagctaacatgcacagaacagtgtggcagcgagagcagaaccgtgtggccagctccatgcttgccgcctagcaagcgtgattgcacttcatcctcataacaacttggtgaggtgtgttgctctgttgtcccattttacagcagagaggactgactctcagtgaattgaaatgtctcagtgaggtcttccacagcaaaaggcgaagcacagagaaggaagtccatgtgggctgggagttcacccagagattcatgtaggggcaatgtgggctgtaccttgcaagatggtgggatttcaatgaggagaagacaaagtgggaggaagctggagacaaggactgtggtctcttcctttagaagtcagttcaatctttttttccttgtggaagcagcataactctaggtggttcctctgtatctgaggacaagctttgtagaggtgacaaaggggtcctaggtcctatcaggcaagcactcgatatgctgccagttcattctgtccattgtgagatacccattccagagcgcttcctctgtgccaggctctacggaggttctggatgttaaagaggaagcaggcatggccctggccctcccagtcttgtgggagattgatcatgcccatgaatagtgaccatgtggtcagagccacagggtcaattccaaatgcccctgtttctcttttgtgttactcacctgactctgggtctttcgtttcttccattcattttttttaaacaaatatttcctgcccaccttctgtgtgccaggcctggggatgcagtgggagaagcctctgtcctcctcagtggaggcgctaactcagaacaggcagtggagaaaaacaacatgacctggagacctggtgccccttccttccccagcatctttgaaattcttttggttgttgttgttttgagatggagtctcactctgttgtcaggctggagtgcagtggcgcgatctcaactcactgcaacctctgcctcccaggttcaagtaattctccctgcctcagcctcccaagtagctgggattacaggtgctctctaccatgcccagtaatattttttgtatttttagtagagacagggtttcgccatgttggccagcctggtctcaaactcctgacctcaggtgatccacctgccttggcctcccaaaatgctgggattacaagcatgagccactgtgcctggcctgaaattcttcaatatctacctgcccttctgccagttggtgcagccacagtgggctgcttatgcatatcctggcctggcttggtggggagcatggctgagggagagccggggcacccatcaattaaggaggtaaagatcagtctgactgagatgcctcctgccacacttcctcagctgccagcaactgacaccattaacctgatttccttccccctctgttgactgcactgactattggactgaatgggaaacagccccgtgcacctcaaaatgcacttcccctcctgcagatgcatcttgcaattaggcccaaactgtgagcctgcatgctcctcccctggccctgcacaggcaacaaagctgaagttaatcagaggtacaaatggctggctatgcctctctgacacgtaacttctggaacatgtatcaatgctttggaaatgaaaagctcctggtattgcaatgccaggctggtgcccataagggccagaaaacattccttgggcaaagccagggggagtgggtgatctgatcccagctcaggtttgttgatttgttgttttgtttgtttcgttttgtatggggcaagggttgagggtatgaaaaacttacactatcatttactaccgtagtccccagaacccagcacaccagcacaaggcctggaacagggataccttttttgaatgaataagtctttttttttttttttttttttttttttgagacagagtttcactcttgttgcccaggctggagtgcagtggcgcgatctcggctcactgcaacctccgcctcctgggttcaagcgattctcctgcctcagcctctcgagtagctaggattacaggtatgcgccaccacgcctggctaatattttggtatttttagtagagatggggtttcaccatgttggccaggctggtctcaaactcctgacctcaggtgatccacccaccttggcctcccagagtgctgggattacaggcgtgagccactgtgcccagccttgaatggataagtcttaagggatatttttggaaaggatattctaaaaaatacccatgtctctacactattgcagaagggctttcagttttgatggcagcctttcaggccagcctacacgcaactaaacttttccataacagcatcacacttacacaagaagaaggttttataatccacttgccattatttaacatagttcttcctccttaactttcaagatctgagcactataatgttcttctttttgtttttgtttttttctaaatcaaattaaggtgagtcacctcaccttgggcctgagttggacagaaatctattcttggctatattccccacccctccaccaccttggaaccttatagaactttatgtggttcaggaaaatgagggcgaggcctcagatcttcaacccatgacagctgtatgcccagctccctgccttcctgtcttacccccagctagggcacaggactgactattgtgcccagagaggtgccagagcctgtaacaaccccagacttcccaggtccagccacatccaccccagagccccaaaagatgatcttcagagagacctttaaaacacaagtagctggtcacttccatccagaccagaacccaagatggctgtgctcttgctgagacatgttggttgtcattgcctccgagcccactttagccctcagctctgtaccagaaatgctgttcctttgggaatcacagccaaagaagagatggagcagttctggaataagaacacaagttcaaactgtcccatatctccccacatcactatctacagttggtctcttcccatggcgatgtccatctgccaccgtggcactggtattgctttgagtgcaggggtctctctttttggcatgttggccctgttactccctgggaactttgagtcttatttggaatgcgtgaagtccctgtgtccggggccagcactgatccacacagctaagtttgcactcatcttccctctcatgtatcatatctggaatggggtctgacacttgatgtgggacctaggaaaaggcctgaagattccccagctataccaatctggagtggttgtcccggttcttactgtactgtcctctgtagggctggcagccatgtgaagaacagaggttcccagcatcatcttcctacacattattacattcacccatctttctgtttctcacttttatctccagcctgggaaaagttctccttatttgtttaaatccttttgtgcttttagatccccttggagcagtagagtaccttgtagaccataagagtggaaaagggtctagttttctccttgtttctaaagatggggtggctgaaaaaactccccttttttgcctacagcttgcctctctgggcctagaagtggttattctgtctccatattggcctttgatttgtgctgagggtcagcttttggctccttcttcctgagacagtggaaacaatgccagctgtgtggcttctgccctgggggctgggggtgaggctttgggtgccactgcctgtgggttgctggcttaaaggacaattctgttcattggtgagagcccaggccattaacacctacgcagtgttattgaaagaagagaggcgggggtggaggggaattagtctatcccagctagagggagataaagagggctagttagttcttggagcagctgctttgaggagaaaatgtatagcttttgacacaacaggaagatccagaaaattatcattgaacatattaaaggttatttctttttcttgcaaaacacacacacacacacacacacacacacacacacgcgaacacacgcagctgatgattctactctcccagccccagccctgaaggggacccagaactccctgcacaaaggctgtccttcaaggggagggtgaaagaagtggaaaatcacattttcattctttagcgtctccatacaacagccagaactgggcagaagctaattatatcagaagcatactccatgttgctgcatcagctttgggatgttcatttttaaatttatttatagcttgtctcattcctcaaaggagttcagggagctacaaaaataaagacaataaaattgaaaaaaattaaattaaaaaaaccatgaccagggaaaatgtgcagtagaatgaagtgtcaattatcacgttttctgactgcaaaatctcccccacggctgatgcaccatcatttactacaacagcccctcttgttggacatttccagtttatttcgtttgggatggtttgttgctgttgctgtggttgtggttttgttttattgaattttgtgttagctgcagctaataccatcttgctgatggctttgcgctgctcttgaatgattactcaggataaatttcctggagacggattataggatcagaaggtctgaacttctgtgtggctctagctacaaagcaccagattgctttccaagagcgttgtagcaatttataatccaacactcagcctattttttggctgggagtcaagccccagaatgtgaaggaggggtcttggcctggagcaggggctgagggatgggtgcacaggacccctccttattggttatttatggggatgggccaggaggagcagaatagaggcccctgccctcccagttgctccttggagtgactgaccccataggggaggggcgaggctacctcacatttagaactatgtagttggtgatggtcaaggtcctaggtctgatgggcatcctcctccctctcctcctcagccagtaatggctgcactatgtcgtatgtcctagatctgggtcccttttgctgtgggaacaccaataatacttacgctgtttcctgccggaaacggtgcaggagggctgtggcatggtagtgggccctggaaaccatctagccttcatgaggaagggcagttaaagcacaggcatgtatgatgttggtattgattaaaagcctcacgggcagagaaattcgccatctgccagggccccagccatacgagggctccagccatacatcctccaggagactgggacctctccaattgcaggagccttgccttccccatcagattaggaattccccgaggatggggacaatgtccttcccacctgcttgagaactcctaaggggcatgtactctgtctccccattgtatctggaacttcctgggagcatagctcctgtctccgtcctcagactgggaatcccctaagggcagaggccatgtccttccacccacttgggattccctgaagttggggaccacatctctgatgtacaatgctttgtatgtactgactgctgcaggattcttggagtaaatgggcagtcaacttcttggactggtattgaccatctggacttcatcagagtgtccaagactttgccattcattagacaggggccatgtgcacaggcagagccctggcctctggcttctggctcctgactcctggtccctctgctttaatttggctaatggcagaaccagactcctttctgggctgccctggaaggggatccttgaatgaaagaggatagatgggaaggtggcagctgacatggttacctcttatgccatgggggggctgctctctctggaaatttaggcctggggtcagggcactgttgagcattttacaccctaggccagaggaggggtgacctgtggagcagggctaagctagtagcccatgaggtatgatgtgtaggcagcacctggggctcacagagcctgttacccatgttatctcctctgaccttggaaagagctggggtgtatgaacaagtatttataagtttacaaaaatcatatgaggaaactgaggcacggggaaggtaaatgacatgccctaggttacacagcttataagtagcagggattctgcccttctgtcacaccaagtcccactgtcttttcttcctggagtccctgtgactgatctaaaggccacatgtttaacagaataaggaggaggcctctgttgcagcaaaccagctaccccacccgcacacagactctaagggacatcctgctttaagctgtccttagttactaatacctcagtgagaatgagtttgaaattttctcaagagccatgggagactaggaagtctctaagcttcatagagagcctggcttggggggacacaggagccaaaggcagaggaagaagtggcagctttgtgcccccagaaacacgtgctcctgacctcacagttggccacagccagccaactctcccatccttctcccaccactttcccgtggggctaacttcaccctgtccacacggagtgacttaacagtttaagccccagagtcgggggccggggtacctgggacaagagtcctgagggaaatggggtgaggaactggaagtgccacagggctagagttctgcccctagcctactggagctgtgccccacaggctggccccactggactgcgctgcctccaagccatcctgggcatctccatgtgtagctgtcacgctcctcccactaaacgcctccctgtgcttcctctgcagttttcatgaacacggccatccccattgcagctgtcctcatagtaagtggatcctttctccatctcttgggggtagggtggagggggagggcgtctgcagtgacaggctgcccagatttggcctttctgcacaggggcctcagaagacaggctccacagccagactgaaaataggatcgaaagtttatagagggtgtggcccctccccaactccagccgaacaggggcctctgcctccaggcctggaagaccggaggcttagtatttagagaaattaaactttcttttaaaaaatagctatccaaatttttaatttttaaagtgaaacatgtgtattgtagaagtgatgggaaatccagaacagaaagctcaaagagaattaaaatcacccataatcccactggtaacatttttaatgtgtttctttccagtctttttttaaggcctatgatatgtcattttctacaaaaataggaatgtgctatgcatgcagttttgcaacctgctcttttaaatttaggaatatgccacacacaattctccatgccactgaatattatgatggtggctttctaaagcaattttgataaaagctgtgtgtgagctgagccatgggggtcaagcagcatgctcctacagaaaggcctgggcccctacgagcctgcagccccctcacccagcctcccatccccatcttctgtgatggctgcagttccttaaaaagatctgcttatttcccccggggccagtgtccctgagctgtgtagagttcacagcctgtcggatacacttgggaattcacttccaatgtgatgtattgagctggttcctggcctggctcctgggggaactgtgggtaacagaggccactgagccagccaggtggctggggcaaagcactgtgcagtttcgtaatcactctgtttacgttatcccgatgaggactggggagatgagcaccccgcctgctgtctgcagagggggccgtgctgacctaacccgagatctcctccctgcttattcccagccaagactgggcaggacagggagtcttggccaggacagggagggagcagcccctgctctccagcttgaagtcctgaacttgttggggacgtttccatgagatgactgtggggatgatgaaggtgtctccaactaaaagatcctcttaggagcctgctccctgacagccctctcatttcccttccagtgctgagcgtttccagtgtgggagggacccacaccctgggccaccctggcctcacttgtgcctctgtccacagactttcgtgggccacgtcagcttcttcaaagaggccgacttctcgccctccgtggcctttgcctccctctccctcttccatatcttggtcacaccgctgttcctgctgtccagtgtggtccgatctaccgtcaaagctctagtgaggtgaggggagggtccgggcgagggcactgggcaggcaggtcctgtgtcagcctcaaggcttgctcgagtgatggccaaaccacagctgtttggtcccggaacacacccccattgctgggccttgctgtagctggtcctggttggtcagagggacattggcctgtatggtttcccagctcgccatccctgagcaaggacttgcttacatacctcccaggagaggggactcactgtcactttcacgacaacttaaaaaaaaaaaaaaaccagtgttgagccaaatgtggaatcctcctaaattctacccactggtcctaacttcaccctccagagccaccaagaatgaggccatcccgtccccacgtggctgccccatggatatcagaaggcatccactgtgtctatctttcccaggccaagtatcccctaccctttccacagcccctgagccctcacagcctcagccagtgaaacagcttcccccaagcgctgggtcctgctctgattggcccacagctcttggaggctcccacttccaggctctagagcctcatggggactctgccactgtcccagaggcattgccctcttgggaatgaaagcctgaaggtagaaggctgaggctttggctgggaaatgccctgtctggagtgagaagatgtccttgggcctctgaagtagctctgcctccttgaaagcaagagcctgtcatgcctctatggagggctggcttgtccttacccatggccagagaaccagtcagtaacaaatgtcctctgtgtcttcagccttgaggaaggtgacacccctgtctcatgggaccctggcaggtactgggaagctggaaggaaggagtagctgttggaatgaagtagctgatagagagggtagcttgcagggggagactctagcatgggttcaaagatggaatggggcataactcagcaaaattatgctctaaggagtatctgaccaggcagtagctggttaaacagggattagctcccatttccacagtcggctgtgctgactcagtttcttgaccagggtgttgtggggtctgaagatcacccctcctcccaccacccactctccagccctatgattctgtgtagaaaccacagatttaagaacgctgcacctgcctgaaaactgttgcactgatcccaaagcgttcatattttcaaacactctggatcccactgtttccaggaatggaacaccagagtagcagaggccttttcagtgaggcagctcaggctctggctgaaggtgggcgcaggacactacctgaagcttcaccccaagagatgagggccagctccactcttcccagtcaccgcctgtgggggagggaggctggacagggcatgaaggcagagcctggtggtctgcccctcccatctaggggtggcgcacagaaagggagactccaggccacagctcacttacaccccagaataaccttgccttgagggtgggatggcttgtctgccccaggcctgttggacatttagcaaaagagaagaaaggggaatacaaacaatcctgagcttcccagaaagctttcacacctccaggatgggagagaatgaactagaagagtgaagcttccagtgcttcctcaggtccacagggaaatctggacaggggagagggtaggaatagccgcctcccccgtgagtaatgacacctcctccagcaggctgttatggggatccgattacataatgctacaaaacagttaacacagtgtctggcatttagtgtatgctcacaaaatactagctattgattctttaccaatcctagtcctaactaaccttaaccctgaccaatccaacaccaaccatccttcagtctaataacccagactaactaacttcaacattaaccctaaaactaaccaatctcacctccaatccagaccccagcctattccagctgactggtcaaccctagcaaaccctggtaacaccaattacctgcccccatgcccactggtctgcccccttcagtgtgggctttgtgggactatacttcaggcctgagatcctgctcagagctctctatcaggctgcgccctctcccctcccctctgcccctggcaggggtgaggggtgtctctgtgcttcccgagcagcgtgcaaaagctaagcgagttcctgtccagtgcagagatccgtgaggagcagtgtgccccccatgagcccacacctcagggcccagccagcaagtaccaggcggtggtgagtgcccggcctccccttgctactcccagcatggtcctctaaggcccaaaacttgggcctgctgtgtcggacttctgccttttttcccaggaagaggggctcccttccctacacagctcccagcccagtgggtcctcacctccaaaccacccccagcccctcagggttgtgaaccgcaagcgtccagcccgggaggattgtcggggcctcaccggcccactgcagagcctggtccccagtgcagatggcgatgctgacaactgctgtgtccaggtgagtcctgctgccccatgcctggccacccagcaccaactcccagagggagctcagcacctggaaagccagaaagctgcatgcttagtcctctgcagaggtcaccctgcctgcctgtacggtccataggagtccagaaaccagggaccaccaagtggggggacccccagccttaggcaagggtcagcatgagaaggccagtctcccactcccctgctctggaagtgatccaggggctggaatcagtgtcttttggctttcatggaggaggggaagccagagactattcactgggaactggctgcctttctgttctctcctgggcggtgggacacgcctaatgaagatcatgggaggctacttcacgtggaccccagatggaatccccacactgtccaacatcaccattcgtatcccccgaggtatggcccagtccacccctccagcatgcccctccccatgtcccactgaataacatagagataaaaagacaaagctgcatttattgagcacctactctctgctcattcttggtgtatgccctgggtatattatagaaggggaaggctacattctagaggcttccgtgtgctgggtgggagtgaagcactaaggacagggtaaaattgccagccttaatgtcaaaccatccattgcagacagtataggtaatgcacaaaaagatcagaagtgggtagccaaggaacgcaagtggaagtgatggggtttctgagaatggacaaaggccctgaggccatgaggcaggaggattttctggcagaggcagccatgagcaaagtatggaggtgggttggaggtgggacccaggatggtgtttcttgggaccacaaggagcctgggctcatactaggagcatgggaaaggagaagcgagtgcttaggaagggtggcggggcaggaaatcagagagggggaaggacctggggagccagaggaggatgttgatttccagaaggaaaggattaaagagggagaggacttgctggggattctaggtaggaagaaagaaaacaggggccccagggttgggtgcatctgtctgtctgtctttctgggtaatggttgttcagactcccccggccccactcacatctgccaccctccctccctgcaggccagctgactatgatcgtggggcaggtgggctgcggcaagtcctcgctccttctagccgcactgggggagatgcagaaggtctcaggggctgtcttctggagcaggtaatacatgtatcctcagggcccagtggaggggaaatctccttttaaccatcctcctcagttgaggatgcacacacatttattggagggcccactctgtgttcagtgaggactcaataaatgctgctaatggatattctcatcatcatcactagtacgtattcacctcttactatgcgcaggttctttgctaagtcctttgcatgcattatttcatttaatttttatgataactaacaaggtccatactgttctcaattctcatttatagaggaaggttaaactatttgtcctaattcacacagctaataagtggcagagctggaattgaaactcagttctgtcagactctgaatcccatggttactcagatgcacggcagtaatttcccagtgtgggaaattgcaacaccaacattggtttccagcttggtcctgagctgcactgacctacacaccataagtgggtgttctgaagatccagatgtaaccaataaatgttggtttctgggcaaagatcactgtcttaattaaagagccagaaccccaggctcagtcaatcacgaatctgttatttatacccacctacttccaagaagcacttgaaactagttgatgaaagattcatgtaaaaatcaaaaccacaatgagataccatctcacacccgttagaatggtgatcgttaaaaagtcaggaaacaacaaatgctggagaggatgtggagaaataggaacgcttttacactgttggtgggagtgtaaattagttcaaccattgtggaagacagtgcggtgattcctcaaggatctagaaccagaaataccatttgacccagcaattccattactgggtatatacccaaaggattataaatcattctactataaagacacatgcagacgtatgtttattgcagcactattcacaatagcaaagacttggaaacaacccaaatgcccatcaatgatagactggataaagaaaatgtggcacatatacaccatggaatactatgcagacataaaaaaggttgagttcgtgtcctttgcagggacatggatgaagctggaaactatcattctcagcaaactcacacaggaacagaaaagcaaataccacatgttctcactcataagtgggagttgaacaatgagaacacatggacacagggaggggaacatcacacactggggcctgtctgggggtggggggcaaggggagggatagcattaggagaaatacttaatgtagatgaagggttgatgggtgcagcaaaccaccatggcatgtgtatacctatgtaacaaacctgcacgttctgcacgtatatcccagaacttgaagtataataaaaaaagatgcatgtaaaataaaaccctttaaaaaggtaagaaaataggaactgagaaatgaagagggtaaaaagatgttcagcaacctgggcagaggacaactacagccatcaacataaaacctggctctgtgccctctggtagccaagggaaaaagggatctctgggctttggagtattcatttaggaataaaagttgcagccaatcagcagaagggcaagctttccctaccaatcatttctaggggaaaattattgaaggtgtcaggtttttcataagcatgagtacagaactgagcagggagaaagactttgggcccaatgtctgaatatcaacatgcacccccgtttcctgcatttccaagatgtccctgaatggtgtatccaaaagatggcaaatttccctcctcagtggggtcgtgggctagcagatgagccccttgggtttcccatcacctcccatcagggactgtgatgtctttgggggcagaggggtctttgcctccattcgccattttatttgggagatttttcaacatagcctgactgggaaggcccaggtattcggtttgagatcatattgccttattccgactgcctctccagcctttggagggaggagcccttttctgctgtccaactgcatgcctgcagcaagaagacaagagtccccagtgcactgtgagctgaagaaagtaaccaatatttattgggtacctcctatgggccatgccctttgctaagtgcattgtcaacatgatctcatcaagcctcctactaagtttaggaggggagtgttgttaccccatttcacagaagcagaaactcaggctcagagaagttgggtgacttactagtcagtgtgtggagcagagactctgcccatgttctttccctcaaacctggtcactgctggggcccccagggcctagtcctaagggttattgtccaagccccatgtagtggtcaggctggatctgggctctcctccaaggcagggcttttccagaaggattgcagggctcagacactggagctgcccctgccttgacctgctcagcatggatgtcaaaacccactctgaacctggtccctttgccctgctttcttctcctcccccaccctcatgccctcatgtggcatcgtgcctgcctcaggagctctccttgtcctatgtagatgaagcaggcatgattggcaggggtctgctctgccctgcctcagtccccacctcttctccaagctgtgccaaccctccgggtctgactgctgcccctctctcttaggaaacctctgccccagcccagggaacacaaggagcctctccaaggcagaggaccctaagcacttcttttttttattattttttattttattttaggttctgagatacatgtgcagagtgtgcaggtttgttacatagctatacatgtgccatggtgctttgctgcacctatcaacctgtcatctttttaagccccacatgtattaggtatttgtcctaatgctctccctcctcttgcctcccaccccccgacaggctcggtatgtgatgttcccctccctgtgtccacgtgttctcattgttcaactcccacttatagtgagcacatgtggtggttggttttctgttcctgcctaagcacttattataggccaggcactgtgcaggcacctcatcatctcagtcagtctgcaccgaactctgtgcagtagatattattatatcctcatttatcagattaggaaactgaggtgaagcaagttgtccaaggccacccagctgttaaatggcagaagtgggatttgcacctaggtgctcaagtgcattggtttgccaccatgtgctcaaagagaaggggcacaagagcctcatgaagaaggcatagctagcctgacagtccaaaggccagcagccgctgtggccatgactcacacacacctgcctcctcccagaactgccacgtgggtcctcacagctctgtccttatcaacacttactctcctttacaggtagcctaggccccagctcccagctctgttcgaggctcgcagaggggcggtagtgaaggggtctcatttctccaggatcctctttgctctctcgcccggtcctggtccagcttccctttcaagcatagtgaagtgcatttgttagcttgcagccaaccctgggaaatcatgagaatttgttcccaagtcaactcattctccagcgtccacagtgacgtattcactcacccagttgagcgcctagtgtatactagaccctgtgacagcaacaggagtgcaaaggtgactaagacgtggcccctgctttttttttttttttttttttttgagacggagtctcgccctgttgcccaggctggagtgcagtggtgcgatctcagctcctcacaagctctgcctcctaggttcaagcgattctcctgcttcagcctcccaagtagctgggactacaggtgtacaccaccatgccggctaattttttgtatttttagtagagacggggtttcactatgttggccagggtaatctcgaactcctgacctcatgatccgcccgcctcagcctcccaaagtgctgggattacaggcatgagccaccacccctggccggccccgcttttaagagaggggagagaagacctgggccttagaagagctcagaggaaccacaattgactctgcagtcaaggagaggaggctcactgcggatgtggtatttgagccttgaaggatgagtgtggtttcatcaagtagaaaaggcagggatgggaaagggaggtggtccaggcaggggtgatggtgtgggcaaagccttgctgatattaaagaacatagttctgtgcacctggaacactggatgcatggggtgcattatgaaagatgggactgaagaagtgaacttggcttagatcccatgtagtaggtctgagaagtaagatttaacccaaaggttgcaaaagaaccatgcttgtgataaaggatgatggattggggaaacagagaaaaagacagacagactgtaggaagggaggtattagcaaataatcataacacagtgtgaggtgtgcattaatattcactcattccaagtattgatcaagaagagaggtaggtactgggttaggaaacagcttgggcaaatgcatggggaaatgagagatgtcaagatgcattctaatggcagcctcttgaagatcttaagttgtttttggttcactcatttcgcaaatgaattcatttagcaaaagcactatggatacagtgcttacctctaggaagtaagttttagcccaaatgctgcagaaggatcatgcttatgacaaaggatgatggactggggagagagaaaaagaaaagacagacagactccaggaaggaaggtcagtctgcagctccttatagtggctaggagaaggagtctaggcagatacgactcaattagcttcatctgctgtttgtctctcaaaatctagacatgtgcactgctctggctggcccacctatcctgggcattgagttaagtgtgggggctgtgtgttgagagtccccctccattactggcaggaactccacacctcagacattgagccccaggtctgcagggagaagacgtgcttgcaaagtgagctaaaagcaaaacagcctctgacctggcaagcattcccaagtctgcacgcctgcagccagaggagagggtgatgccaggctgctgctcagatgcttttcagccatacccaggccaagacctggtgaccaggcagccagaaggagttccaggaggcacaaggcaggaagttgggggattaggaggtgtagaatggagaatgctctggggagatgggtgctttgttggtgcaactattcgtttattcctccagtgaccacgtgagcagtatggctgcacacacaggctctgcagccaagctgcctgggttcacatttggtctctgtgctttggaaaatttcataagctttctctaccagtttcccttattacccatgagattgatgtgaggattaacctagcatgtagtaaatatcctataaatattattattcaatagtgtacttctttgccaggaacaaaattcacctgttcctctttaaatgtcctccagtctgtctcctgggaaagattcttgtgagctccctggggacagggaccatattttgtttgtctcactgtatccgtagtgctttttgctaaacgaattcacttgctaaatgaatgaaccaggaacaacttaagaccttcaagaggctgccattataatgcatcttgacatctctctcctttccacatgcctttgtccgagctgtttcctaacccagtatttcactacccctcttctccatcaatatttggaatgagcaaataccgttagtgcatacctcacatggtattataattatttgctaatgcgtctgtctcctccatgactctgagctccttgagggattattccatgttgtaccccaggtgccccatgcagatgtgtattttgtgcactgttctgtgtaggctacaaaggaaaaggcctagcacctgcccttggggagctcacccacccaggatggacagaggtgtgcagacagagctgcagggtgggcacaaagggtccatctgctgaagtcctgcagatgcagccccgagcttgtccctcacgtcagcagcctggctcctggtctcagagagaactgtgtggttcccaagcattcactttaggaagaatcacttgcccctccctggctctctgcttcaaggaactgtgacaaccttgggatttgcaaactctctctttaatccttaagaggaaaatgttttggtaaaaagtcaagattagcagatacactcgggtgaaattctttccctggaaataaagaatagagccattaatatccacagtagagtgactttaaatgcccccggggggtcagcaggaaccagggccctgaggaaaggatcagcgtggggaagaggctcccacttccctgtgaggagctgcacatgcagtctcactggagctccctgctgcaatgctgttgcctgtggtggttggtgtggatgctgcctgccaagagccctgattccccaggaagagagaaaaaggcttctctcaggacggccctggtcgcatctgcctgtacaattcctggagcctttggggagctgaagtcaggggctcaagtgcccctgggtttcctggaggaggcaggtgtggtgagacagctgacagacaggagaagggatgctctgaggaagtgactgtccagccatgggaaccagatggcccctggctgtagtcctgatgctgccacttgctagctctgtgaccttgagcaggttacttcacctctctgagacagactcactgtctggacaatgagtaaaaccctacctttcctgtctcagagatttggcaatgggacccaatgacatcaattggaaaggatgctgtgggtgaaaggtaacctttcaggacagcgacaagcctgtctgggcaggatgaatgggctgtggagccctgtatatcctagctcactctttgaacctcagtttccacttcttccctttttatttattgccggggtcttaaatgagtgttgggggtatctgattctccctctgcctgtacttttggggccaagcactgagctgaaaagacaattcctcctagttctccaagcctacaacctgccccctaaccagctgtgagctgtaatacattctccagtgtcactgtgaggtttgtgccttcacccccattttatagatcaggaaacagaggctcctccaagtaaaggagcttgcctcagatttcacagccaatgagtggaaaagcctctgggattcaaatgtcagagcccatatttttcctacttctcgcacctgttatcatatgctgcctcttcctttaacctgcagttccctcccttcacctccaccgtctcaatccttcccactctttaaggttcagttcagctatgacttcttctatgaggctctactcattttctcagatttcttcctcctccaaatttcttgtaaaaattatgttttttctctgattctaaaagaatgcacattacattagaaaagatacacaagcatacagaagataaaaaccacctaatatcccatcacccagaagcttccagtttttctttatgcatttgcatatgcatttgtgtttacttttccccaaaagttctccgatactttgtcctacttttcttttgacccttataacttcctgacttcggtacctttctgatttgccctaccagagtgtgagcccctggaaggcagcctctgcaccctgattcaggttgccacacatatgccagctcctagtgggctggagggaaggacatgcggttggggaactggaagactcatgctttcagctgtgtgcttcctccctagagtgcaggcagaggaggaatcgaatcccctcagcactcttgtaaagaccacagcaatgagtgagagatggtgcctgccagacataccattctttacttttcagcttaaaacagatacaaagtttggggaggctcactggaggaggcttggggctacactggaaagagaagaacttggattcacaccccagcttcccctcttcccagctctgtcacatttgcaaactctgagtctcagtatcctcatgtgtaaaatggggatagggtttatagggttgtaaggatgagatgatgagttgtttgcaaacaacttctcacagtgcacagtgaaggtcagcaatgagagccagccccgccctttcttctttccaaatgattaatatatctgttaccagcctccattcattatatagctctgtcatgtgctaagcaccatgggggctgaaaaagatgttcttcctgccttaaaattccactggggatgaacaaattacacgggagctgatcagagaggaaggcagtccattatgagggctaattgagcagtgcagaccatgttgcaaactgagttagggcctggagagcttactgtgtgctggggtcctcaggaatgccacagatgcatcaataaccacctctgctactctggaagtagtcacatcaggaagactccagagataagcttatctgggctgtggccacagagctggaatttgtaagctttaggtttctatgtctcatgttaccagcttgtctataaattgtaaattacagccatctgatggttagggaatatgaagtttggttaagagaatgaaatgagaccacgaagattagagaacaggaaaagaggggactggggactacatacccatcagaatcttcattcagtcctgaccctcagcaggagggggatttcatcaggctcatttccatccttgatttcgtccatcctggttctcctgacaaggggcatttatcagagttatggcatgggaaatcacaggggagtaatgtaccatggcatttaagagtatgaacgttggagtcggagctattttctccgctacttactagctgtgtgactttgggcaagttacttagcctttctctgagcctcactttctttatctgtaaagtgagggcgatcagaataaacctccttcatatggttattttgagctttataaagagacaatactggctgagcacggtggctcactgccagtaatcccagcactttaggaggccaaagctggaggatcgcttgagcccaggagttggagaccagcctgggcaacatagggaatgagactcctgtctctacaaaaaatatacaaaaattagtcaggcatggtggtacgtgcctgtaatcccatctactcaggaggctaaggcaggaggatcgcttgagcccaggaggtggaggttgcagtgagccaagatcacgccattgtactccagcctgggcaacaggagtgaaaccctgtctgagagagagagagagagagaaaatactactatggtgcttataaaagttcaataaattttagctgttgttagtattattaaagtaagatctgtatgaaaataaagcagattttttcccccaaatgttcatgtcagaagtatatatttcattggcaaggggctgcttctggaaggttgagaggtatcctgggggaggggatagagcactggcaaaattggcatcacaattcaagtcacctcactcagtgttttttaagttatcaaaatccacagtatgaaaagcatttgacattacagtccactatatttatgcatttataaacaagagaaaaaatcacgaaaaatacagtaccacgtgcagtacacactgattccatctattctttttttttctttttcctcaaatgcacttgccgcctacttattccagacccaatgattgggtccctatccacagtttggaaaacactataagaaatgattgtgtcctctcactttccctctctgggatttagttttccaactataaaatgctcctgatgcccagccagcctcaccgctgctccgagtcaatgccaggaacgctgatttagcacatgctatttggagggtacccatccaggtgctgtgggagggacagagattgagaagagtgctttctgaccccacagaggccatttggaaaccctgggaatgggtgggagggttggaggtggggattgcttctcccctaagactcagcgtgatggaaaggcaatggggtgggaactaactggtgttggtctgtcccatttgtgtcccagcagccttcctgacagcgagataggagaggaccccaggtacagccttgggactgggtcagaagtgggtctcaacaaagggaaggggtagggtgggggtggaggacttgtgggtgggtaatgctgagtatggattcagggatgtgcagcctacatattttcagagacatggggctaaggcctgcattctcaatgagggcaaaatttggttcttggggacagaaaacacttagacattgcaatgctttgtggctgtccaaagtaccaaacagatgccagtatatctgtggtgctgaaatttcatggtgaatggagtcagaaaatagactagcgattgccagggtctggtgggagagagagggaagggactgccaatgtgtatgggatttgttttggggaagataaaaatgttttggaattagatagtggagatagttgcacaacctggtgaacgtacttttagtttcagaggttttctaaacctctgatttttttttaagtgacaggaaagacagaaaaaagtatatctaaaaaggctctaggggtgatcatggaaaagaaagttaagaaatatgactgtaaggaaaggagatgggtgtccctcaggccaggcagaaaattcagtcttgttgctttatgttcatgtgcaaatctaaaaaatccaagtgatatagattaatgaggctctgagtccctcaaaaccttccctccccttacctctccaaaaaacacttgagataccctagaggtggtatgaagtcaggatgggaaggttggctcagctttgcaaataagtttaagcctctggcctttgctctccaacaccaaagaggcttcactttggtatattttctctgccctttctccctccttgtccccaactgtcagtatgtgatgacaggctcagcctctgtaatggtagtgatcatatttcttgagccaaaaatcagacctcatggcatgtgacaagtttgcatatgtggatgagaacagagtggcagaatatttgacacgggagcagcttgggcagtccagggcacatggcactgcacctgacatccctggcagatcccccacattccgtggttgtcttctgatggggccatatggggctgcagatcatgcctggagccctcgcagctccagggctgcgggttcccagccccagagtgcaggtgctggtgtcagcctgcctggcctggcctggctctgtccagagcactccttgccccagctgtttgtgcagctgtatcagcctcagacctcagcctattcattccaacctgaatgcagaggctgggtctggaggagccacattgcgggcttcatactcctgatctgacaagttttccccccagagcctgcaccaatggcacctctccccattctccctcttaactgggtcctccagggccctcctcacacacccacgtggtcaggcagcagaggcttccccaagatgggcacaccccactctccacacctctctatgcagcatttgtggctacagactgggtccaggggattgtaaaggcatgctcatgttgggttggagggagctcaggatcttcctggaggatatggttcactcccatgagagctcagtatgcctttcctcccctgctgcagcccagagcgggagacagcgaccgacttggatatcaggtactgcgtcctgggaacattgccccccagggtcaactccctccagggtgctctcaggcccaagggagccacatcaccctgctgggcagcccccagaccccagccccagtgttgggggaggccagggagggcccctgtgctccaccaggtggctcgggagctgctgctgtttctgtgcatccatttactcccttcacataagatcatttttatctgggatctctttttcttttttcttcaaaaaccacatcactcaaaatgtggcttccttggctctgcttttaaaaaaaaaaaaaaaagttcttccatttggagaattacctgctgacttcaaagtccagtggcttgagggctacccaaagagggaggaagccagaagttgagtgttcccttggtttggtcacacttttgggctcctccctgactaaggaacaacagactgcagggctggggcaggctgggtgtagggcagggaggggatgaggtcctgctgccccagtcagttgagacccagacctctcaaacctgcctgggggaaggcaaggccaccagaggccacactaagcagatttctaccaactgcacctccccatccccttgcctccatctgagccatcagcttgacaactgcctctgagaacaagcccctgagaatgccttccgcaccccctactcccgccctgctttttccaggaagagaggccccgtggcctatgcttcgcagaaaccatggctgctaaatgccactgtggaggagaacatcatctttgagagtcccttcaacaaacaacggtaaaagcctgtcggagggaggcaggatgtggaggggaggaactgtctctggccagcctgccccagttccgggcccctccatcgatcacccacacccagccatctcactccccaggtgcttacctgcactccagcctctccatatggtgcacctggagaggggccaggtgtgcctgagcattggggcaatccagctcccataggggagagggcaggaatggagggaagggagagagccccgctgccttttctctagctggtgggagggctagctagctctctctgtgagtctccattcgcctggctcctgcactattttccctccaatgataatagttagggctagcatcgactgcgctcttactacataccaggcacagtgccgagctctttgtacacggaatttcctctcatgcttacaacaacctcagtaggtagatattattgttattcccactctacagatgaagaaccaagtttcagaaaggtcccaaggccacccagccagtaagtgaccaagatgggtctcaaatccaaagctgcctaacacctaagtacatgtttgtcaccaacatactctgatgcctccatgaactctggctggcacctgcccaggctaagggctggctggggaagtatgagaggaacaggctgggcaaatatttgaccagccatcatcattactgcctaaaccaaccagcagtggttttccctgcagtgccccaagcacgggttccggctgcagcttttcccactgcacagagatcatgagcgccctttcatcacttactctgcatatttgttcccaaccaattccatccttctagtatttaacctgcccaaacgctgtgtgaagtgctgacctcagctcttttcaagctcacacggtgtttgcttgcacccaagcgggaggcctattaaagccattgctcaccctgggcatagctacccagagactaatgaccctctgcaagtgctcgggccaactctgaccaggctgaccagctgcatcccctgcctctacccacgccaggtacaagatggtcattgaagcctgctctctgcagccagacatcgacatcctgccccatggagaccagacccagattggggaacgggttagtagcagcctctgaggggttttttcaaagccaggacccccaacctaccatgccctgagacactactcaggacaatgggtaactaggaaataggagacattgaaggctgaagagttgcctgcagtaaggtcaaacatgttgttcttgatgatgtcctttgacaggttttcagtcctgcttggagggcaaggtcagcttagtgccctcccaggctggggatcttcttcatttgcaccccaggtatacactgagagcccacacagcactgtgctcagcctggggttgtattgttcctgttcatcctccagatggggtcccctccacaagcttagacgaacaggattctcctgtgactgtcctccttttgtgtgattttaatccctgctgcctctgtctttgtttgtactggtcagatggtccctagcgcctacacaatgaatctttaaagacttggggctcatgctgccctcttctgaatgaattcagtaaacacgtgcaagttccttctctatgcaaggtgagaagcaggcaaagaagtggatagagccaggcctccatcccaaagagctcatagtccagtagggtacaggacagtgtctcctgaatggctgagggcatgatgtgttcctcctctttggtgacagggcatcaacctgtctggtggtcaacgccagcgaatcagtgtggcccgagccctctaccagcacgccaacgttgtcttcttggtgagtgcaagttcccttggggtcctggtctctggctgcctcccaggcctaactgcccacctccacctccccgcaaccccaccatcatccaacaatctccctctccaggagtaaatccctcctgccagagatattgccttatcatcctagtgatagggaaactgaggcaggcaaggatagcacaaatgacccattgcagacttcagatggagctctgcagtagccaatgaggagaggcaagctgtagttataggctgcctgtctgtgggacagcccaacccctcaacacttatgcagcccgactataagaatggctgataacagaatgtgtgctgccacttcccatcttatgcccagtgcagacattgctaattgttcacagcattatttcccatggaacttaactcatcctcagaatccttctcaacacagcactccaggtaaccactagccatcaaacatgagataaaactaggccaggcgcggtggctcacgcctgttattccagcactttgggaggccgaggcaggcggatcacgaggtcgggagatcgagaccatcctggccaacacggtgaaaccccgtctctactaaaaatacaaaaaattagctgggtgcggtggcgggcgcctgtagtcccagctactccggaggctgaggcaggagaatggcgtgaacccgggaggcggagcttgcagcgagccgagatcgcaccactgcactccagcctggggacaaaccgagactttgtctcaaaaaaaaaaaaaaaaaaaagaacgtattcgcaatccttacactacttcatgtcaagttctgttgtgtcaggtgccttgactgacactgaagaattctaagaaccagtccttggcctcaaagatttagaatctgattagggagacagagctcacccagttcaagaggcccagcccggttcaaatccaaactgtgcggcataaactatgagggggccttgtccagggagacaactgtgagggctggagtaatcagggagggcttcctggaggagagcctcaaagggagagtcaattaaacagaaggaaagagggaggccatttgcacagtgagttggaagaaggaagctcaagtctctgattccagctttattccctcccctctccctacaccacacgcacaagcactcctttactaaagacacttcacagtgggaagattcagtctccgttaccgtctgacacacacacagcgttttacaaagcatgggtgcattcgcgatctctcatgagatttaaacaaccctgctagagaaaagtgaagtggacattttatttcagtaaacgtttatgaagcgtctactctgtgccaggcactaaacgtttatgaagcgtctactctgtgccaggcacaggcacaagaagtctcagttcttgggagtgccataatcaggaatggacaaacaatgatcagatctggctttgcgccagtgtcacgggaatagggaggaaggaagggtaggcgtgggggtcaggacaggatgcaggaggaactggtgcttaggtgagcgaaggatgggtgggagttcacaaggcagacaaaaggcagagcagcactccaggcagaggaacagctcaggagaaggcccagacggcaggcttcctgggaacctggaatgcagagtgctgggaaagcacagatgaagcatgagtctagaagggaaagcgagaggttataaagcacctggaacaccagcccacagggtttgactttagagatgatggggagccgttgaaggtccaggagtcaggcagtgaagtgattagatctgtttgagagtgatatctgacaactgccccattttaaatgaggtaaccaaggcccagagaggttgggtgagttgtccaaagccacacagctaactagcttcagtccctagagcagagttgatagaactctaatgggttttatactcattgtcacccctccccaccatgcctttccctaccctctactctcttcctctcccttctgcccaggatgaccccttctcagctctggatatccatctgagtgaccacttaatgcaggccggcatccttgagctgctccgggacgacaagaggacagtggtcttagtgacccacaagctacagtacctgccccatgcagactgggtgagggggaacaagggggtcaggctatagggggcagggctggggaggctgtcaggcatcttggcaggaaccaatccgttgtcttggtagcaactgctgagggccacaaagcataagagaccagcactggatggctttatgcatgctgggcatttcagggagaccctgtacaggccaggggtttggtatcacctagacccacagacactccccatcctggcccgggccccccatggtacactcaaggctggcaccaagaagtctcaggaataatcaagtgctcacttctcaccttctgattcctgcccttttgatgacccatccccgcagtcatggggagtgcccatttggatggaaaagccctcttcccaccctatgaccttcccggggtggatggatgcaccaccccgggaatcatatgggaaatatggaaccaaacaatagcagtagtaatagaaacttcaggctgggcgcaggggctcacacctgtaatcccagcactttgggaggccaggacaagaggatcacttgagcccagaagtttaaggctgctgtgaaccatgatcatgccactgcactccactacagcctgggcgacagagccttgtctctgaaaatttgaaaaaggaaagaaagaaagaaagaaacttcaatattatcagtagagtccaatgttgtgaaacccctcattaactaaatttccatactcttcagtaggtagaaaataattactttttgattcattagaaagcacttaatttttaagatggagatcatgtaattttgaactctaggtcttgcctactcctatataaattctcctctaaacaacagccaaaattgaggccctctttgagcttcaggctggtgccaaatggctctgcttattttccccaaaataaatcttccttccatgtatgatgagaccccctccagtataaagaagacccaaagaaaatcacccaaagaaaaaaggcccaaagataagacccaaagacctaaagatttaaatatatatacagatacagaaggtttgtttctgagtttctgtagtgaccttggcaataccttgtagttcaggacaatcctgaggaacacagaagtgctggcttccttgaggaatcagtgatcaggactctcgagccccttgaaccccagcatagggcgggagggggtgagggcagcaggggtgggtgtctgaattaatgtcaggtctacgtgatggtgtcatcaagtgttccagataaaaagttttattgagccgggcgcggtggctaatgcctgtaatcccagcaccttgggaggccaaggcgggtggattgcttgagcccaggagttcgagaccagcttggggcaacatggtgaaaccctatctctataaaaaaaaaaaaaaaaattagccaggtatggtggcgtgcacctgtggtcccagctactcaggaggctgaggcaggaggatggcttgagccaggaagcagagattgcagtgagctgagatggtgccattgcaccccagcctaggcaacagagtgagaccctgtctcaaaaaaaaaaaaaaaaaaagatttattgattccaaagaggcatggccacacacacttagaccagcaggtgctttgctaagccctgatggaggctgccagacccgccgtcaagaggagctaagggtagtgtacaatgagcccacttagtgtatgacggccgctgccgtgggtggagtccttgtgagtaaccagccagcttgagcaggatgcactaatttgctctgcaaacccagccattgagaaatacgcctcagatgtaccgaactctaggtcctaggagtatgttggttggggtaggttatcaataccagcccacttgcagtggatgagctggtggccatttgtagtgaggaaagggatgtgtcaacctccatcttagactccacaattgagggatgtgaccaccattcctccccagccagcccccaaaccacgtttgttgctgcctttccagatcattgccatgaaggatggcaccatccagagggagggtaccctcaaggacttccagaggtctgaatgccagctctttgagcactggaagaccctcatgaaccgacaggaccaagagctggagaaggtgggtatatccagggatggccaagcagccacccctggatgcaaaggttctgctagaacctgaactcataaaggtcttcctgtccttagtgccccaggaagccccctaaagggcagatgtgggagctgggcatgaactggctcctaccagaggagagacagtacctgtgccaggtgcccagggcagaatcaggtgggcaccttcgccttatcctgaggtagtcagatactatttagttgcaaagtttcagaaaatcaactcaaactggcaaagaaaactaagcaaagaaaacaagagggaattaaggatttattgacccatgaaaccaaaaagtccaggtgtgtcatagctttaagtgtgctggatccaggtagtcagtgtaatcagaaatctgtttctcccatctcttgactctgctcccctcaaattggctcagctcccctcaaattggctccattctcatggtatcagtgagggccaccagcagtcttaggtttacattctcccagctcaacaactctgccagaaaaaaagtgcctctttccccatagttcagcaaaagtcccagggctgagtctcactggtccagtttggtcatgtgcccacccctgaacaaatcactgtggccagcggtgtggaatgtgaggattggcctgtcctgggtcacgtgccactttgggagccagatccacctgaatcacagagactaaaaacaggggaagagtggttccccacagggatatgggggtgctattatctgatgaaggggaaggactaaatcctggcaagatgaatgtgtgtctgtctgcccctccctcaggcagggacaaagtagaaatctgacattggtcatcaccagagtagttaccccttaacttccccttcccccaccaaccatatatcctgaagacattgcccaggccacatctgtcttttaggagactgtcacagagagaaaagccacagagccaccccagggcctatctcgtgccatgtcctcgagggatggccttctgcaggatgaggaagaggaggaaggtacaggcaatgggactgggagtgaaattatggcctgaggtctgatcagccacagagaggctaaggtttggggttctgggtgtggtgcagtagtgtgcctttgattaaatggcttccctctgtgtgcccccgttgtcccctcagtaagtggggataaaatgccctgattcaccctcagagggatggaaatgtgtagccacagagtgggttcttgcggcctgcagaggaggcagctgagagcgaggaggatgacaacctgtcgtccatgctgcaccagcgtgctgagatcccatggcgagcctgcgccaagtacctgtcctccgccggcatcctgctcctgtcgttgctggtcttctcacagctgctcaagcacatggtcctggtggccatcgactactggctggccaagtggaccgacagcgccctgaccctgacccctgcagccaggaactgctccctcagccaggtgtgactggcggcccatggcagaggttgggagtggggatgggggaagggctgagcccatgggcaccctggaactccaaatcactctctgcctgtgaaggagtgcaccctcgaccagactgtctatgccatggtgttcacggtgctctgcagcctgggcattgtgctgtgcctcgtcacgtctgtcactgtggagtggacagggctgaaggtggccaagagactgcaccgcagcctgctaaaccggatcatcctagcccccatgaggtacccgtctcccctggccaggctgggactgtgagcaagtcactgttctctgagccttagtcttcccatctataaaatggggatatacaacctgtcacaagcttgtgggggtgactcaaggagacagtgtgtgtaaaagtgccctccttgtgcaagaagcagggagaaactggcatttactcagccagatactgtgataggcattgtgtgtggttagctcatttaattgttaccatggccctttaaagtgagcgtctgcacatccaagtaaagattgttttctcctccctaagtgggtgtaatttgcccatccccacccatgagttcagctccctgccctcccctcactctctctccctcagccagcctcaggttttgacactgggggaacaggtagctgttctattaataatttcctgtaatgggatggataaaaatctcaaaggccacttgatgtcaaagaggtttaaagttgtccctgcccaattggttggccaacttggcttaaaaacacaacaggcaaacagattttctggccccttgtcgaggctagacctcacaatctaactgcactttttactttccagcctcatgagttttctgtggcccacagatatggcctccaagtttatttacttttactctctatttgccccagctctgtagttctgaaactccctggttggggttgggctgactctgggtcagccagccggcaggctgtccccagggccctgttcctcttggcaggttgtccctctggagaggactctgtgtcccaggaggacagctgctgagtcaggccgagccggcagctgagaaaggcggcagtcgtcagatgggcttgagaaactgaaaggctaacgaaaggccagcgcccctttgggcagctgcaggaattcacggggatacaggccagatgtctacaaattggcagaggatgccagacccatgaatgactccagagacacttacatgaaataattaactatctcattcagtaaacaggaagtaaatcaatggacaaatgagtaactcttcctctggctgcctcttaggttttttgagaccacgccccttgggagcatcctgaacagattttcatctgactgtaacaccatcgaccaggtacagaggaccgtgccacactatccccccttccagagacacctcggacccctgggggcttctcctgtctgaggctgggttccccagatcaggtgatcacagccctctgggaagaagccagtgtccccgatccgattataatgctgcttcagggctggggcctccctcgtgggagcctcacagtaaggctgagggaaaccagatccctttagcttccacctgagatcccactggctttctctagtaaagttccagcatattctgaaccaaggtggctgattgtatggagaatattcattttgattcagcctgtgttctttatttaccattgtaccagatggtgtgaaaacaaaatcttgattcctacctcagggagtttaccttgtagctggagagatgagatacgtgcctataataaagggagagcaaggccgggctcagtggctcactcctgtaaccccagcactttgggaggcggaggcaggcggatcacttgaggccaggtgttcaagaccagcctgatggccaacatgatgaaaccccttctctattaaaaatacaaaaattagccaggtgtggtggcaggtgcctgtaatcccaactacttgggaagctgaggcaggagaatcatttgaacccaaggggcagaggctgccgtgaaccgagattacgctgctgcactcaagtctgggcaacagtgagactcagtctcaaaaaaataaaggatcaaaaaataaagtgagagcaaaacatggcggccagtagcactctaaacacagtcaataccaaaattcacctcactctctccccctcgtctccctcagcacatcccatccacgctggagtgcctgagccgctccaccctgctctgtgtctcagccctggccgtcatctcctatgtcacacctgtgttcctcgtggccctcttgcccctggccatcgtgtgctacttcatccagaagtacttccgggtggcgtccaggtgatggcctcaggggtgaggggtgggaggtgctttgcaatgtgcagtttggtgtacttgctagactcatcgttatgagagtaatagggtcgtgttccctccaaaaaataaaaacaaaaaacagaaatgaaggaaatagaaatatccacatcttattccaccgccctaatataatagtctgccaacacacgcacacactgaggttgacatctgaattatttccttgggcgatatggtcaggactggaattgctaggtcatgataaatgcacattttatgcccttcattcattttgccaacatgcttcccaggagggttgcatcattctagtggtcaggctgattgctgatgcatgaaatcggcgggcacctgattcaagcagtgttatgataacacctcccagcccacgtgagtccagagtgtagctgtaagccttgacttgagggagcctctcacagccattctcatggatcacatttgccctcatgagctttggatccatgcacgcctctttcctcctcaaaattttctaagaatgttctctagggagttctttctgggagtgattctcccagattcatagaaactcatagattcaaaaaattgtaggaaaaaatttaaagaacgtctaggccagtgtttctcaaactgccaattacagcccatcagtgggtcatgaaatcaatatcatggatcacaaccagcatttttttaaaaatgaaaaaaacatcagactgtattcatagagtaaagcaagctttgcttcatgaaacctttgtgttggtcatggaggtgtgtgagtactgatttgtgagataaaatatatttctgactgcaggttgtggtcagaaaggttaagtacctttcccaagtgcacatagttggctagaaactagagttgagatacttattagcaataataaaatttagatgcattttggacacaattacctgccccaaaggatcaacatttgtataaatggctttttgcttggatgatccagaatggcccgacacccacacgaacaacatagctttttgacactcaaaaaattcaaagtgctgcacaagctgttctacaaagttcatttcttctgccagagaaacagcccagtctctgtggcacccagtctgaccctggagatggtttatcagggaaatcaacttcctgcatcccaaactggcctccctggcactgatgtgcttgtcgaggtgcagctttggggagcaggaggcaattctgttgccatggaaacctctggccttaccccgagacgaaacctatcatttcagcacatcactggccagggtctaaagagctccttgatggggtaagcggaagacggggttgaacgctttgagtttggtcttctgttcctttggccagctgtctcaaggttcagattgttcacctgtaaaatggaactagcactgcctgcccagccttagctcagctccaggctgtgcagcagaagtacagggacagatggcgacctggggttgacaatgcccaggacagcagtaattgtgccccacatcaggctgtgtctaagcattgtacataaacgatctcattcagtgctcacaaaagctcaatgggctggtggcattgtcttcccccttcacggggtaagaagctgaggcctagagaggtaaggccattcacccacacagcggtagcaggtggagctaggcttcaggcccaggccgagccctgagcctgccctcttaactgttccactctgttccccgccacagggacctgcagcagctggatgacaccacccagcttccacttctctcacactttgccgaaaccgtagaaggactcaccaccatccgggccttcaggtacgagtccacattcccccaaggtaggagtggaacaggggtggggccagggggcacaggccatgagatttgattctcaggactccacttgggaaggccaaggacacgttctctctcaagctgcctcaggtcccaaggcccaagggatatccaccagcagggacaggccaggtgggctcccactgaatgttctagagaggaaaattccagctctgtagacaagcccaggacctctgtgaggcagagcatgaaaagagacaaagctgggacaagtcttcatgtatcaacgctagaaagggccttaggtgcgggccaccctaagcccttcttttattaaggagcccctgtgtgccaaacactatgctgagtactgtacaggccaatcccactcattctgcactgcaaccctcggtgctgagaatggtcatttccattgcacagacaaggaaactgaggcacagagacgttctataacctctctgtgtaaggtgccacaaagcccagacttgaacctatttgttcatgcaacaaacatttactaagccccgactatgtgctaagccccatgccaggcactaaaaagatgagtcaaataagccgctgccctgcaggcgtttacagcccagactttgagcaggccaggataaatccacgtgacaagtattctgaaaaaagcggattcaagggctgtgggagcatagaagagagacagtccgggaaggtttttgtaccagaggtgtcatcagaactaggactcaaaggaggggcaggagttcaccaggctgaggaattcctgaaaacttcagtgcccctgccatcgtctcactaccctgagtggtgatgttggggtggacaggagcatctgaggttgcctggggaatgagggaagctgttgtttcccactccccaagagtctgtctgatctccagaggcatctctcttccagtcaggcaggccagagacccctgacacacaaagttgggctcttttctcatcttcatccagagagtgataataggttatttttagggtggcacagctgcacgaagtatgacagtaaccatgagacaccaagcactgtgtccaggagtaaccatagggcacaaggaccagccaagggccagagaggcttacatctcctccccccaacccctgaagtccagcttcagccctggagaggtatccaggcccctctgcccaccctggagcacctagggccagtggaaatccacctcttagggatcttgtctaagtaaagaagagcagagcaaagctctgccctggccttggcgctgctccctggacatcccttgcccctggacaagcctatgctgtgtcttccacaaagaagcttgctggggactggattatgactctagagtctcctcccagcctcctcttctcaagcctgaacttctcccgttccttcaacttccaggtccctcgacattactgagcctagcctttgctctaagttttggtgatttccctctctcaattggtgtctcagagggccctggggtagagagatggtgactcttctagagtgggccacagccccttgtgtgcagatcccagcttcctgtaaacagcctcagatcaggccaaacctgtggtcagccagagccactgctacccagtgaggtcttccacaccctactgacacggtgaatgatttttaaatttgaatgaaaggctttttaatcaaccccatacacatttaatgcattggctttaatccagcagcctgttgagagctattagcacttattgattgcccacttactgtatgccaggcaccgtgctaagtgttgtatgtgcattattacatttaatcctcacaaggaccacataacataggtacgaatcgccacattctccagatgcagaagcgagacccagagaggctgggtaatcaatccaaggtcacacagactgcgggggctggcgctgagcttggaacccaggtttgcctgaccttctgggctttcctaagagatcttattttttcccaaaagagtttcaagagtgcccagcactgggctcagtggcgggctcggaggttgttttcgttcatgtaggaactatcacttccccatttttttcataagaaaactgagtctcagtcctgatacacagccaggaagttgtgatgttcaggctccaacctgggtttacatggctccgaggctggggctcttttctagtcctcagacacactgtcgcacgcctgtggcagaagctcccatctcacacttgccgaccctcaactcacacagtcctgagacccacatacgctgagcgcctcacactcctataacacgcacatgccctgatgcacacacattttcaacacgcacttactctacccttcaggcatggtttcacactcactgcagacacgtcaccctcccacacgtctccaccctgggggtgtgcagtagcatgctctctcccacctcagaacctcccttcagtcccctcagacacatgccctctctccacgcagagacaatcaaagctgaactaacaccttccagggtgaaaagcaaatgcccagtaaggtacgtcttgggtgcctccgtgtcccctgagtttggtcctatcaaaccagcgatgatgaggcagcttttctttcgttccttcctccatcatcaaacaagtgctcctgcatctcctctgggccgggcctacgtcagcaaggtctgagggaagcggccaaggagagtgatgacggcagcccaggttgatcagagaaaggaggcaggtccatgcgcagtaactcagggaaaacatgatgaggacctaaggatgagaaagaagcctccagagttccctgtgcagagagattccatcaatttcagagggtcaggggagtgccatgcattcatccaacaaatatttattgatagtgccaggtgctggggtatattggtgaataaaacatcttcatggaatttgcagtctattgagggagatgattataaatagctagagaaatgcatgtacagcagatactgtggagcaaacaggttgcagacaataataggggaaacctactttatagtaaggtagtagccaggaagagcctctctgaggaggcagcatttaaggcaagccctgaaggttgagttgagccagccttatgaagagcaagggcaaaagccttccaggaaaagggaatagtgtgtgcaaaggccctggggtagggaagactttagtattgtcacagagcttttaaaaagctgagtggctgcagcatagtgtgtggggtgtttgtggcaggaattaggttggcaggagggggttcttcatcctataagcagtggaaggtcattaatattcttttttatttgtttttttttttttttttttttttttttttgaggcagagtctcactttgtcacccaggctggagtgcagtgaggtgatcttggctcactgcaacctccacctcccgggttcaagcaattatcctggcttcctcagcctcccaagtagctgggattacaggtgtgcaccaccatgcccagctactaatttttgtattattagtagagacagaattccaccatgttggccaggctggtcttgaactcttgacctcaggtgatccgcccgcctcagcctcccaaagtgctgggattacaggggtgagtcaccgcatccggccggagatcattaatattctaaacagtgggggagaggacacagtttgcgatttagatagattaagccagccactgtgtggagcatggactgtagggagacagcaggtagacgtattcaggaagctgatgcagtagtccaggtgagagtttgtggtgggcaggaagcaggatagagggggagggaggcaaggactcttttagagagagacataagaggacttgccaaggggctgaatgtgaatccaggtgattcctgggtgagaaactgggtaaagggaggtgccccttattataatgggaaagacctagagaaaatggatcttggggtgaaaacaagagtttggaggaggtggggattctggacaggtttgaataagcagaaaggagtggggtggacattccagagagggatagcttacatgaagtggccacggtggcatgtctggggactggaggggccctggagcctccctctgcaggtagggagactcctaggagctatgtggaccaacactgttcccttaggagcttctcatcctccctccaggtatgaggcccggttccagcagaagcttctcgaatacacagactccaacaacattgcttccctcttcctcacagctgccaacagatggctggaagtccgaatggcaagtgctattcccctctaccctggcctctgataggagggtggggccagagcaagagcacacaggtacctggggatgaaagagaggataggataccagatcgtgtggacaccaagccttcctgcttcccccagccctggtggtcctcctagtgtctagcctgtgctccttttccccatatcactgcctggaggcttgtgtatctgaggtgtgtgccagtggcaagaacagttgtggtgaatgtgtatctgcagtgggtcatatgacacccacattgtgtgtgtttgtgggccagctgaggcgtgcatgttaaagggtgtgcaggggctagggggtaggggagcatgagcttgtgggacatgttggctcctggggctccagccttcgcagcccttgtgtgtgtctggtgacgtgtgcatgagttgcagggctggagtggaggcctggctgagctgctctctgccccgaaaaggagtgaggtagaacaggggcctgtggctctaacccctgagcgcccaggtcagctcctctccctccccaggagtacatcggtgcatgtgtggtgctcatcgcagcggtgacctccatctccaactccctgcacagggagctctctgctggcctggtgggcctgggccttacctacgccctaatggtgagcggcagtgggctagggcagaggaggggtcagacaccagcactcccggagcaccttcgtcactggagacatgagacactcccaggccttaccccaatttcatttgcatctgatgccagagggacagtgcgggcaggaaggctgaccagcaggccccagggcccaggccccagacaggtggaggttggggagccacatgactgaccctccctgtgcctccagggagggctgctctgagcaggcagtggatggcagcaaaaggaatctggggccctggcccctctccagccttaagaagagccattctggtggctgaggacagaactaagcgaccatggagtgtgcgccactggcttgctccccacaggtctccaactacctcaactggatggtgaggaacctggcagacatggagctccagctgggggctgtgaagcgcatccatgggctcctgaaaaccgaggcagagagctacgaggggctcctgggtgagaggctcagggagaggggtggggaagagtccaaggaggagtgtgtctgggttgggggccacaagggagcctggggatggggtggcactttcggatactagctgtggcccatgcctggtggctgagcccagcccggcccccagcaccatcgctgatcccaaagaactggccagaccaagggaagatccagatccagaacctgagcgtgcgctacgacagctccctgaagccggtgctgaagcacgtcaatgccctcatcgcccctggacagaaggtcagagcacgggcccaacccaatgctgcaggacaggcgtgagcaggggatggggcatgcacggagctggatggcttcgcagtcacctcgtggccctccagggccgaggcctctcactattcagacatcgcagtctcctgccctgggcctgtgggggcccatctttcctctccttctattgccttcccccagtgctgccctcaggccttgtcttctcactcatccaccaaggagaccgacactctggactcccccagctcacacgggctttgtcagggcctccctctctgcgaatggtcaggggctttccctagggcactgccccgagcttcagggcagggacctgggggcagacagcgaggccacccttgtattgagggtgagcccctgcctatggccctggcccagctctcctctcgtttcccactctgtctctttgtctctgtctcactttgctgtggctgtccatgtcattctctgaccttgggatgtacctctgtccctgcctctctcatccttctatgtcactatctgtctccgtattgtaatttctgttggtacccaagtgccaggaagcaacgggatcagaggtggctccattgtagggcggggcacacagacacatccatgcataccactctcagctgcccctgtgtcctcctgccacacccatgcccatagagacacaccactgccccccagctctccttcagccaagtacccggcacacccagacccacaccaaggcccaggcaaatggacatccatgcctgcacttgcgtgccggtccctgtgtaagccctctctggacccactgcaggaaacaagcccaaacctgtggtgtccaaagagaaactagtcagaaaaccaggccaaaaagataccctgtgacctcccacacctgcacacacacccagagctagcatagaggctattcccagcagccccagagtcccagtggcggtgcctgcttctctctttccagatcgggatctgcggccgcaccggcagtgggaagtcctccttctctcttgccttcttccgcatggtggacacgttcgaaggtgagttgtaaggcgggcaccccacgtgtacccacagccaccagatgaggcctcagccctggcacgtggtcagacatgacaggaggcccagcagtcaccgccttcccctgcaccctcactgggacccatgcagggcacatcatcattgatggcattgacatcgccaaactgccgctgcacaccctgcgctcacgcctctccatcatcctgcaggaccccgtcctcttcagcggcaccatccggtgagccccaccacccctcaggcccacccagccccaggccggctcagttccatcagatctggagcacaaagaggagggggttgggggagaccaggatcccagaggtgtttcctgctcatgcccttctccatcccatcaggcccaggcagcctctggaaggggatcccccacccatgggtctaagatgctgtcccccacccactgccaccacctcggtgcttctcccagccagacctccaactcagtctgctctcgctcactgccctctttgccgcctggggatgcaggcaggaccctgctccctccctactggggctttctgtgccacttccagatttaacctggaccctgagaggaagtgctcagatagcacactgtgggaggccctggaaatcgcccagctgaagctggtggtgaaggcactgccaggaggcctcggtaactactcctggctatgcagctgggttggttgggcactcaaggaccctgtaaggatggcagacagaagcccgtgtctcaggtttgccccaagtttggagtctgaagcctggcaggaccatttagtcctacttctcactatacgggggcccagagaggtcaggtgtcttgccccaggtcacacaactggtcagttcagggtctggctcctcctgcagggtacagcgggtacagtcagggatccttgtgagacagagattgcgagtcccccatgccaagggggcatcttcagccctgccctgccccatccacctgcatgcccagttctgccttaggggaggagaagatggactgggcaatcatagacacgggtcactcatcaaggccaccggtgattggcaaagccttggtatatttgctgcagctcctggagcattgggggtggccaagccttggtttcaatgaatcaccctaccaaggccctacatacacactcagtgcacccctcagtgcacacgccccctcccagaactgcccagggccacagcagcacacacctccaggggtgcccttctcgttgcagtccttgcagacggcctccacattgttgtgtcaggtgcaccagccctgcacacgcctgtgctcttggacacacacccacctatttgcccccatgcacacattttccaacagccccccaagccatcccatctgctccactcacagcacaagattaactcagtcctacttcatctccccgggctgttttcagatgccatcatcacagaaggcggggagaatttcagccagggacagaggcagctgttctgcctggcccgggccttcgtgaggaagaccagcatcttcatcatggacgaggccacggcttccattgacatggccacggttggtcctgggcccctccatgggaccatggtcttggaaagggtttagtgggatgctagggagaaatttgcacgaagtagtcctgaggctcaagttgcctctaacatcaaatgctatgtgttgcagaaaatgaaaagagctggggggaccctgactctgtctagtcttagggaatgttacacacacacacgcacacacaaaaacactatgcaaacacacacataagctgcacacacagacccacacagacttcacactgtcacctatcacaacagcacacacacagccacaaccacaacctacatacacacacagagctgagctcccaacaggctgagtccagtccctgagtgccgggaacctgttcagtcctgtggggtgggggtgggactaggatcggggtcagatgggagctgagccacagacctgggctccacatcccccaagccaggccagaccccatccactgggcaggtgagccaacagctgttgcccccacttggcaggaaaacatcctccaaaaggtggtgatgacagccttcgcagaccgcactgtggtcaccatcgcggtaaggggcccattgatggggtgcagagggacacccagggacaggactggcctgttgtggccgtcatcagtgcacagcccctgggcttgcctggtcccagtaatcaagaaagaaccctgaagcaggcagttcagggcaaggggcctggagggcatgcagggagcctgggttgcaggatttggggtggggggttttgcccctgtgcttccctcagacctcccctctccttctccaggttccaaggcctgcccctgtcccaaggccttatatgttaggctggcgttacttctccataggaagtgggggaggggttgtggagggtctctgagccttgaagcctggaggtggggtagagttgggacttggagaggagagaagggtggtattagcagatggagagcttgtagtcacatccaccccaggaaagtgcagtccccacagtgacaggacattctggccacatgcctcatcctcctcctccaagccgcaggagggccaccctcagctgtggcccccaccgcgggtggtattcccaccatcctgacccgccccctcctgccctgcccagcatcgagtgcacaccatcctgagtgcagacctggtgatcgtcctgaagcggggtgccatccttgagttcgataagccagagaagctgctcagccggaaggacagcgtcttcgcctccttcgtccgtgcagacaagtgacctgccagagcccaagtgccatcccacattcggaccctgcccatacccctgcctgggttttctaactgtaaatcacttgtaaataaatagatttgattatttcct

SEQ ID NO: 38144 - DNA, 14705 bp, Homo sapiens; identical to SEQ ID NO: 36551

SEQ ID NO: 38145 - DNA, 11237 bp, Homo sapiens; identical to SEQ ID NO: 36100

SEQ ID NO: 38146 - DNA, 18703 bp, Homo sapiens; identical to SEQ ID NO: 36379

SEQ ID NO: 38147 - DNA, 24957 bp, Homo sapiens
ttccagcgcagctcagcccctgcccggcccggcccgcccggctccgcgccgcagtctccctccctcccgctccgtccccgctcgggctcccaccatccccgcccgcgaggagagcactcggcccggcggcgcgagcagagccactccagggagggggggagaccgcgagcggccggctcagcccccgccacccggggcgggaccccgaggccccggagggaccccaactccagccacgtcttgctgcgcgcccgcccggcgcggccactgccagcacgctccgggcccgccgcccgcgcgcgcggcacagacgcggggccacacttggcgccgccgcccggtgccccgcacgctcgcatgggcccgcgctgagggccccgacgaggagtcccgcgcggagtatcggcgtccacccgcccagggagagtcagacctgggggggcgagggccccccaaactcagttcggatcctacccgagtgaggcggcgccatggagctccgggtgctgctctgctgggcttcgttggccgcagctttggaaggtgagtttccttgcgggggggggcgcaccccgtcactcctgggacctcccccccaacatctgggcctcggagtggaggggccggcctctgactacccctacccgggcactgcagtcccaaacacttcggaccgatagtgctggaacgggaggggggcggggaagaggcgcccgacgggtagtggagttttcttttgtttgggaaagagatggagtctggctacgacccgggacattcccctgcccgggctccccgaactctcactgctgattacatacgcccctggctgcctttcctttcctccctaccccactattcaaaactatctgcaaagtttctgtcccagtcccacctcccgccgtacatgagggaaggtttctggagaagcaacagcagacaaggcacaacttttcgtgctaggccctaaaacgacccccagcgccaattccttagcgatcacaccttgatcctccagttccacactcctgcaacaggatggcctcctttgcattcacacagcaaacccccaaaccgctctcccgcccactgctcctgcccctggtatagggtggctccttggtttctacaggctgcaccccatccctttaaatgcggtctagaccccggccccaggtgagtcccgggcttcccttgagacctaggagcgggtagaaactgacctacacagcccccaggtagaaactgacctacacagcccccacatcgccctaactaacccagtctatctcccacctcctggtctctccaagcatttctttggccatggatcgctgtccctcctggtcccctaaagggggagccaagagccctagaaactctcctgtgtccctaatgtcctttcagtgagctgccaacacccccctttctctgtctggtatgaaagtggttatggggcggtaggctatgagggactcccaaagggaaggattcagcggcgttagaaaaaccctctccccctggctgggcaggactgccctgggctggggatcaaaggctaggtgtggggttgggagtgaggggaggcttgcccagctcagagaacggagaagggggaacaaaaaccatgaacgaggggaagaggaaggccaaaggggtggaaaaaccacgaggacgaggtgtggtgagaaggaaagacgcaaagaggaaatggtgattgtgacacctattacctgagtgtttccaagcaccaggcctgtgctgagcgccttacaaatattaatttcacccatccagcaacgctaagggtggtgctattattgcccccatttttcagatgaggaggctggggcttagttaaggttaagtagtttatccaaggccctgtgccgcgaggaacagcgagaagtggaggccgaaagcgaaggagagatagtgactgtcagaaagagaaacggaggtggacagagagtggaggagagataggtgagagacatgcgaactgacagatcaaagcgtggctgcagctgagctgggacgcagaaagggagcctgcgcttgctctgggctgcggacagcccgaggcagagacagtgtgtaaattggagacaggaaaacactatcccggctggaacaatggagggtggagacggcagcctctatccacccccttcccagaacccgggcatcctgtccccagtgagcagggctgtctcttgccacccatggggaccttgcgcctctcacctcaggctggctggcttcccatctgacccctagctggaggacatcatttggtccccaggaagaggctgcctcacccaccctctttctcttctctcctgcagctcccatggggtgggagccaggtgttctggctcccctctccacccttcccagcgcccaatgccccccacattgccggcccccgaggggattcctgtaccctccctcctccactctccactgccaggggctgtgcagtttttcctaatccccccccttcctccagtgcctgtcccctcccccgatgatccgagccaagccaggtgtgttcacccctcccattcataccgccccccagaatctcctcccctctgccttcccataaccaaatccagatgtgaggcctcggcgggagcctgggaaccctagcatcccgacctccagtgcttcctgatcagggcactcgtggggagggaggtactgggatgggggccagggctatgccccaggcacggagcgctcccttcaaggagggaaggacggggtgtttggtctgaaagcagagaggggtcttggacagggaatgaaattgtggggtagagaggctgattctgggacttaggggaggaaacgtggaggctgagacaagaggttcccctcccacaccagcagcctctgctcgtgggggtcaggaccagggcgcagctctcattttaaccctttctgagctgccgccccttctccccgtacattttgatctccctccctcctccagggaggcctagatctggggtatcccaagggagccccatgcctaccagatgttgggggtggggttggcacttagcagaagaggccagaaatcaggcgggtgcagagggcagggcttgctcccctcttggccccccaactcctctagctcagagctaagaggatccacctgcctcggttcccagggatctggtcttcctgacctccctcccccaccccaggcactgactctgtctctctgtctgtctcagagaccctgctgaacacaaaattggaaactgctgatctgaagtgggtgacattccctcaggtggacgggcaggtgagagctgcacccaggagctggagctctggagggaaactgagggaggagagggcgcctgtgccgcctgctttctgtgtgccactcctctcccctgtccccccagatgacagcagccccagcagtgtcgtctgagcccttctcagaggcgccctcctcgcagtaccagcagcccccctttctcagtccctctcactttataggattcaccccatgcagccctctccctggcggctccccagcccccttgctgacctccttctctgcacagtgggaggaactgagcggcctggatgaggaacagcacagcgtgcgcacctacgaagtgtgtgacgtgcagcgtgccccgggccaggcccactggcttcgcacaggttgggtcccacggcggggcgccgtccacgtgtacgccacgctgcgcttcaccatgctcgagtgcctgtccctgcctcgggctgggcgctcctgcaaggagaccttcaccgtcttctactatgagagcgatgcggacacggccacggccctcacgccagcctggatggagaacccctacatcaaggtacctgggtgcccccagggctcagccacagccaaggtgggattccagccagcaggcccgtggcctggagggcagccgatgtagttgcgaggcctctggcccgcgcgctgggggctggaagcaggaggcttaggtctggggagggaagggggtgatcttctgggcggaggagcagaatatacgggggctgcctggcccggcccccagggaggcccaagggtcaggcttctcctccagtcacctcaaccaccctaccccactgtgctccagccacactgagtttctcccattccctgactgcacctggctggtttccagctcaagactttgcagcggtgatgtctccacctgggggcctctctgcctctcacacccctacttgtcttcggagttccagctcccgagatcttgcctgtgccaccttggctgactctctcctccctacaatcctgcatacctctgtccacctgcctgtctcggcactcattttactttatttatttttcttttatatctatatttttaaagcggggtcttctacgttacccaggctggtctctaactcctgggctcaagagatttctcccacctcggcctcctaaagtgctgggattataggcatgaggcactacgcccggcctcatggtactttataacttccccaggattcattcatcgctgtctccttgactctgaggtcaaggcctggcatggcgtcagtgtcagtaaatgtttgtagaacgagtgaataaaaagggggagaggtgcaggccagaggccgggcatatcgcaggagctttgcaaggctgaatggacagtgtgggggcctgcagaaagtgtgccctggggaaggtggagggaagattctggaacgggaaccaaggaggtccgggagggtgagctgggaagaacacaacagtccgctgggtcctcagggagtggggacagcagcggtgtgcctcccccccgccggcaggtggacacggtggccgcggagcatctcacccggaagcgccctggggccgaggccaccgggaaggtgaatgtcaagacgctgcgtctgggaccgctcagcaaggctggcttctacctggccttccaggaccagggtgcctgcatggccctgctatccctgcacctcttctacaaaaagtgcgcccagctgactgtgaacctgactcgattcccggagactgtgcctcgggagctggttgtgcccgtggccggtagctgcgtggtggatgccgtccccgcccctggccccagccccagcctctactgccgtgaggatggccagtgggccgaacagccggtcacgggctgcagctgtgctccggggttcgaggcagctgaggggaacaccaagtgccgaggtgagagctggagcttcccctgcgactgctgctcatccgggggagagtcctgaactccactcaggacccacttcttaagtttccattttgtatagttagatgttgaaatggaggcttgctctgtcacccaggctggagtgcagtggcacaatctctgctcaactgcaacctttgcctcccgggtccctgttcaagcagttctcctgcctcagcctcgtgagtagctgggactacaggcacacgccaccacgcccggctaatttttgtattttagtagagacggggtttcgccatgttggccaggctggtctcgaactcctgacctgaagtgatttgcccgcctcggcctcccaaagtgctgggattacaggcgtgcgtcaccacacccagctggaaaaaaaaaagactttattttcacctgaaattcattaatttccacttgaaattccacctgcagttgtagcaggacctgacacttgggccccatggaaatcacaggtattgcctgacacagtggttcatgcccatagtgccagcactttgagatgccaaggtgggaggatcacttgagcccaggagttcgagatcagcctgggtgacagagcaagaccccgtctctaaaaaaaatttttttttttttttcaagacagagtcttgctctgtcgcccaggctggagtgcagtggtgcgatctcggctcactgcaagctccgcctcccaagttaacaccattctcctgcctcagcctcccgagtagctgggactacaggccccgccaccacgcccggctaatttcttgtatttttagtagagatggagtttcaccgtgttagccaggatggtctcgatctcctgacctcatgatctgcccgccttggcctcccaaagtgctgggattacaggtgtgagccaccacacccggattacaaaaactttttagataattatctgggcgacctgcctgaccaacatggagaaaccctgtctctactaaaaatacaaaattagccggacatggtggcgcatgcctgtaatcccagctacttgggaggctgaggcaggagaatcatttgaacccaggaagcagaggttgcggtaagccgagatcatgccactgcactccggtctgggagtgcactccaacaagaaggagtttcgctctttttgcccaggctggagtgcagtggtgggatctcagctcaccgcaacctccacctcccgggttcaggcgattctcctgcctcagcctcccaaggagtagctgggattataggtatgcatcgtcacacccggctacttttgtatttttagtagaggcaggtttccaccatgttggccaggctggtcttgaactcaagtgatctgccctctttggcctccttctcaggaaaaaaaaaaaatcacaggtatttacaggccattccaagtgccaaaagattgtttttgctcatggtgacttcagtatcacagatgttaggagacttgctgctatatgttaagaaagaagcacaaatgttgctgtagcccaaacttttttcctcatgtttcattgcatttcagcttaattggtttccctggtattcctatgtattttgtggagtgcttttaaaatcataagttggagtagaggtctttctgtgggcttcaccagactgccgagatcagggtcgaaacaggtgaggaccccttctctggagagagtctcctttctcctctaagaggaaaggttttgagatcttttgtccattttcccaccttagcacttcatcagccttaaaagaagctggaatttttttttttttttttggagatgggatctcgatatgttgcccaggctggtcttgaaccccttggctcaagcgatcctccagcctcagcctcccaaagtgctgggattcgaggcatgagccaccgagcccaccgtgcagatggatgtttttgtgcatgcttttgatgaatgctttctctctctcagcctgtgcccagggcaccttcaagcccctgtcaggagaagggtcctgccagccatgcccagccaatagccactctaacaccattggatcagccgtctgccagtgccgcgtcgggtacttccgggcacgcacagacccccggggtgcaccctgcaccagtaagtgaccagcacccaggtgcagttcactggggaggggtcacagacctctgaggtggaccctcacatggcccccatcctccctgggcttcttccctttgtccctggcatgcttgtccctagcccggaggaacatgtggagcccactgtctccaaggcaagagtccagcatggctgctggtgcctccattgccctctccccaccaccgcagagcaggtcggcctctgcctgactccctggtctcctgcagcccctccttcggctccgcggagcgtggtttcccgcctgaacggctcctccctgcacctggaatggagtgcccccctggagtctggtggccgagaggacctcacctacgccctccgctgccgggagtgccgacccggaggctcctgtgcgccctgcgggggagacctgacttttgaccccggcccccgggacctggtggagccctgggtggtggttcgagggctacgtcctgacttcacctatacctttgaggtcactgcattgaacggggtatcctccttagccacggggcccgtcccatttgagcctgtcaatgtcaccactgaccgagagggtgagacttgggggctggggcggctggtggtctggcgggagagatgtcactgagggcctgaaggggagaggcaggggctgtgaagttgggtaccccggaagtgtgaggggctaaggctttgggggcaagaggcagaaagagggcaatggctgggcgcagtggctcacgcctgtaatcccagcactttcagaggctgagacaggcggatcacttgagccctggagttcaagaccagcctgggtaacataggaagatctctctacaaaaaataaaaatattagccaggcgaggtggtgcatgcctgtggtcccagctactcaagaggctgaggcaggaggattgcttgagcccaggagtcggaggctgcagtgagctatgatcgcaccgctgcatgccagcctgggtgacagagcagtgtgagatcctctctcaaaataaatgaataagaaagagagggtgaggagctcgtaaagctgggctggagagttaagtacaggaaggcccccagtgggactggggccagagagaatcagaaggaattctcgaaacagccagggggaaattgagacaagtgtagccagcagaggaagtgttggaaaagataagggacatggccaggctgatcacaaggtcaggagttcaagactagcctggccaacgtggtgaaaccccatgtctactaaaaataaaaaaattagccaggcatggtggtgggcacctgtaatccacttgggaagcaaccagaagaattgcttgaacccaggaggcggaggttgcagtaagctgagactgcgccactgcactccagcctgggtgatagagcacgactccgtctcgaaaaaaaaaattttttttaagttaagggacagagctaccatgcacaagggttccctgtgtctctgcctctcacagtacctcctgcagtgtctgacatccgggtgacgcggtcctcacccagcagcttgagcctggcctgggctgttccccgggcacccagtggggctgtgctggactacgaggtcaaataccatgagaaggtaaggccatcccccagccctggggtgggtgggcaatgggttgtgctctcctggctgggacacctgggttgcaggcacctggcaggcatttgaattccagctctgccatggattccctgggcagccttgggtaagccccttggcctgtctgagcctcagactcttcatctataaaatagttactgtaatagttaccagcagctggacacagtggctgaggttgggtgcggtggctcacgcctgtaataccaagcactttgggaggctgaggcgggcagaatgcttgagcctaggagtttgagaccagcctgggcaacatggtgaaacttcatctctataaaaaacttaaaatgggccgggcgcggtagcttacgcctgtaatcccagcactttgggaggccgaggtgggcggatcacaaggtcaggagtatcgagaccatcctggctaacacggtgaaaccccatctctactaaaaatacaaaaaattagccaggcgcggtggcaggcgcctgtagtcccagctactcgggaggctgaggcaggagaatggcgtgaacccaggaggcggagcttgcagtgagccgagatagcgccactgcagtccggcctgggcgaaagaacaagactctgtctccaaaaaaaaaaaaaaaaaaaaaaaacgcaaaaaatacttaaaatgaaaaaaattagactgggcacagtggctcatgcctgtaatcccggcactttgggaggccgaggtgggtagaacacctggggtgaagagttcgagaccagcctggccaacaaggtgaaatccccgtctctactacaaatagcaaaatcagctgagtgtgttggcgggcccctgtaatcccagctactcaggaggctgagacaggagaatcactggaacccaagtgattctcgacttgaggtcgaggctgcagtgagtcgtgtttgcaccattgcattccagcctgagaaagtgagaccttgtcttaaaaaaaaggaatgatattatgaatacagcacatggcttgcatgcgtaagttctcccaaaggcctcaccagttgcaaggcaggctagtgatgggagtggagggcgagggaaggaggcaggaagagcaacaggaacttgggttcccgggtgacggccaccccactacctctcccggacagggcgccgagggtcccagcagcgtgcggttcctgaagacgtcagaaaaccgggcagagctgcgggggctgaagcggggagccagctacctggtgcaggtacgggcgcgctctgaggccggctacgggcccttcggccaggaacatcacagccagacccaactggatggtgagcctggggaagggggtgagggtgggggttggaaagacccccaaagttcctgggaagaccccaggtctccaaagtcccatcatcttttttttttttttttttttttgagatggagtcttgctctgtccctcaggctggagtgcagtggcaccatctccgctcactgcaacctccgcctcccggattcaagccattctcctgcctcagcctcccgagtagctgggattacaggcgcctgccaccgcgcctggccgattttttgtatttttagtagagacggggcttcaccgcgttggccaggctggtctcgaactcctgaccttgtgattcgcccgcctcggcctcccgaagtgctgggattacaggcatgagccactgcacccggtcaaagtcctatcttcatgtccttcttcctgtggatcacatggcatgccctagagaggagagaacgtaagatgtcgaaaccaaaaccaacagctgagttttgtgaagtctggcctgcttcactctgtacccccaggctggagcgcagttgctcgatcaaagctcactgcacagccaggcacagtggctcaccctgtaaccccagcactttgggaggctgaagcaggaggatcacttgaggtcaggagttcgagaccagtctgaccagcatggtgaaaccgcgtctctactaaaaatatagaagttagctgagcgtggtggtgcacacctgtaatcccagctactcgggaggctgaggcaggagaatcgcttgaacctgggaggtggaggttgcagtgagctgagattgtgccagtgcactccagcctgggcaacagagcaagactctgtctcaaaaaaaaaaaagctcaccgcaggcttgacttttagcaacaacctgacccctgagctccccattccccatccaacaaaatgggaatatcatgaagcttcctgcagggctttgaggattggaggtaacaggttatttttaatatgctaggccagtggctttcttttttctttcacatttttttttttgagacggagtctcactctgttgcccaggctggagtgcggtggcgcgatctcagctcaccgcaagctccacctcctggtctcgatctgctgacctcctgatccacccgcctcggcttcccgaaatgctgggactgctggcgtgagccaccacgcccggcctaactttttcttttttttaagagacacggtcttttttatcacccaggctggagtgcggtggcaccatcatagctcattgcagcctacaactcccgagctcaaccaatccttccaccttagcctcccaagtagctggggctataggcatgtgctaccgtgctcaactaaatttttttttatgttttgttgagacagtttccctatgttgcccaggctggtctcaaattcctgacctcgagcaatcctcccgcatcggcctcccaaagtgctgggattacaggcatgagccgccacacccagcattggaccagtggctttctaaaccttgtaattttctgtaatagctttactgaaatacagttcccctgccatacaatttgcctgttcaaagtgtacaatcgatgacttttgatacattcacagaattgtgcagtcaccaccacaagtaattttgggacattttcagcaccctcaaaagagaccctatagcccttagccatcaccccccacccagatctttctgttgccttagtccctggcaagcactaacccactttctgtcttgaaatcttccagtgtggtcttttgtgactgttcaccgagcagaatgttttcaaggtttatgtatgttgtagtatatatccgtgggtttttttggttgtggtttgttttttgtttgttttggaaacagggtctcgctctgtcacccaggctggagtgcagtggttcaattacagctcactgcagcctcaacctcccaggctcaagtgatcctcccacctcagcctcccaagcagctgggactgtaggcatgagccaccatgcccagctaattttttttggtattttttgtaaagacagggtttcaccatgtttcccaggctggtctcgaactcctgagctcaggcaatccacccacctcagcctcccaaagtgctgtgattacaggcatgagccactggacctggcctgttttttgtttttgttttgaacacacgattttgctttgtcacccaggctggaatgtaatggtctgatcatagtgcattgcagcctcaaactcctgggctcaagcgatcctcctacctcagcctcctgagtatctgggaccacacgtgctcaccaccatgcttggctaattattattattttttgatagagacggggtcttgctatgtttcccaggctggtcttgaacacctggcctcacacaatcctcccacctcagtatctcagagtgctgggattacaggcatgagccactgctcctggccaatatttcatttctttttatggagacgtaataatcagttgtatggaaatagctgattttgttttttattgtatcttttggtgaacatttcaattgtatcgactttttggataaaaacctgaaaatgtttcacctttagaacgtttcattgaatggagatttttttgtggactctggtatttatactagaaccaaatcaaaaccactctggcggctgggcatgcctaggctggtttgagactagcctgtccaacctggtgaaagcccatctctactaaaaatacacaaattagccgagcatggtggtacacacctgtaatcccagctactcaggaggctgaggcaggagaatcgcagaacccgggaggcggagattgcagtgagctgagattgcgccactgcactccagcctgggcgacagagtgagactgcgtctcaaaaaaacaaacaaaaaattactctggcagtaagaaaagatttcgaaacttcctcccttgccctgaggtacttcagaggagcctgctggcccctgggggagagtttgaaacccactgtttgttccctgaccttgcctgcttgtgtcctctccctccacctgtcccctgtactggggacctgttctcaggagatcacagttcattgctcaaagccggggctggggcctcctacaggaccatcagtttctcctgatcagcagcctttccttccgcagagagcgagggctggcgggagcagctggccctgattgcgggcacggcagtcgtgggtgtggtcctggtcctggtggtcattgtggtcgcagttctctgcctcaggtaagggctctgacacccagaggcccctggaagccctcagttgatggccacctgcctgggtgctacaggacaagcctttctggctgtccccagcctctttttacttgaaatcttctccaatccctgctccttcctttggtgtgtgtgcctcataaagatgtgtgactcagtttaccttttgttcctttcccatcggctacaggaagcagagcaatgggagagaagcagaatattcggacaaacacggacagtatctcatcggacatggtgggttgccctaatttgatgggaataggggcttggggccgggtgtggtggctcctatctataatcccagcactttgggaggcagaggtgggcagatcacttgaggtcaggagttcgagaccagcctggccaacatgttgaaactccatctctataaaaaatacatcagtcagccaggcatggtggtgggcacctgtaatcccagctactcaggaggctgaggcagaagaatcattttaacccgggaggcggagattgcagtgagccaagatcgcgccactgcgctccaggcctgggtgacagagcgagactccatctcaggaaaaaaaaaaaaaaaaaaaaaaaccacggagacaggggtttggggctaaaagctatgagccgagcctccgagtccagtgggagttaattcccagctgacggggccctgcctgatttctcaggtactaaggtctacatcgaccccttcacttatgaagaccctaatgaggctgtgagggaatttgcaaaagagatcgatgtctcctacgtcaagattgaagaggtgattggtgcaggtgagagccgaaggctgcccgggcacctgggaacgaagcgggggtgggcagggccacactggagcgggagagctgatgacctctgcgtccttgtttgaaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcgggtgagcaccctccctggcttctgcggccacccggagttcccacttacacccagaggccacttgggttaagaagccaggacagacagtgggtcccaggtcacctcctccagccttttcctcttgggctaagccctggtcctctgccttttcttttttttaagacagagcctcgctctgtcgcccaggctggagtgcagtggcgcgatctcggctcattgctgtctccacctccagggttcaagcgattctcctgcctcagtctcccaagtagctggtactataggcatgcaccaccatgctgactaatttttgtatttttagtagacacagggtttcaccatgtaggccaggctggtatcaaactcctgacctcaagtgatctccccacctcagcctcccaaagtgctggtattacaggtgtgaggcaccacgcctggccagccctctgcctttaattttccctctgggaaaggctgggctcctgggaccttcctttcccactgccccatacagctgaaggttgtcattccttctttttttttttaattttgttttaattgaattttttttttttgagatggagtttcactcttgttgcccaggccggagtgcaatggcaagatcttggctcaccgcaacctccgcctcccaggttcaagcgattctcctgccttagcctccccagtagctgggattataggcatgtgccaccacgcttgactaattttgtatttttagtagagacgggggtttctctgtgttggtcaggctggtctcgaactcccgacctcaggtgatccgcctgcctcggcctcccaaagtgctgggattacagacgtgagccaccgcgcccggccaattttttttttttttttttaagacagagtctcactctgtcctctaggctggagtgcagtggtgcattcatagctcactgtagccttgacctcctgggctcaagtgatcctcccgcctcagcctcctgagtagctggaactacactcatgtaccaccatgctcagcaaatttttaaaattttttgtagagacaggatctcgataggttgcccaggctggtctgaactcctggcctcaagcgagcctccctcctcagcctcccacagcactgggattgcaggcatgagccactgtgcctggcctgtcattccttcttttgacaaatatttactgagtgctttctacgcaccggtcatcctcccagtccccaggaataaagctatacacacggcaaactggatttctcctcttggggagcagagggtctaatggggcagggggactgaaaattagcaagtaaatagacaggctttttaaaaaagtaaacaaatcatttcaaatgtgaaaaaaagcaaacggggtccttcatgcagatgtggctagagaggaaagagaactgcttaatttatttggtcactttaccagattttactgactttttttttttttttaactttattaagcttttcttttttcttgagatggagtttccatctgtcacccaggctggagtgcagtggtgcgttcttggctcaccgcaacgtccacctcctgggttcaagtgattctcctgcctcagcctcctgagtagcttggaattgcatggcatgcaccaccatacccagctgatgtttgtatttttagtagagacagggtttcatcatgttgcccaggctggtcttgaactcctgggctcaagtgatccacccatctcggcccctcaaagtgctgggattacaggcatgagccaccatgcctggcctaggcatctttttaaaaaaatcaaaacatttttctatgtagcaaaataacattgcattgaacagagttatagcgattccctagcgtcattgaatacccagttgattttcacgtttctctagttgttctaaagatgtccttcactgctgctttattccaaccaggatccagttcaagaccgggctttgtacctggttattatatatattttatttatttattttagaaacaaggtcttgccctttcgcccagtttagagtgcagtggtgcaatcatagctcactgcagcctccaaactccttggctcaggtgatcctcctgcctcagcctcctgggtagctggaactacaggtgcacaccaccacacctggctaatttttaaattttttacggagatgggggtctcgctatgttgcccaggctggtctcaaactcctggactcaagcgatcctccctccttaacctctcaaagtgctgggattacaggcgtgagccaccacgcctgctgattattatattttcgagcctctctaaatcttgagcagttcctcatgatgacactgacacactgaagggttaggtcccttgtccgcctgaatgtcttgatttctggatttatgaaattcttcttatgggatcatttagcttgtctctctgtatttcctgtaagagaagctctatctgatgtggggtttttttggttttgtttgtttgttttttgagatggagtcctgctgtcgcccaggctggagtgcagtggcacaatctcggctcactgcaacctccgcctcctgggttcaagagattcttctgcctcagcctcctgagtagctgggactacaggcgagtgccaccatgcccagctaatttttgtatttttagtagagacagggtttcaccatattggccaggatggtctcgaacttctgacctcgtgatctgcccaccacctcagcctcccacagtgctgggattacaggcatgagccactatgcccggctaatttttgtatttttagtagagacagggcttcgccatgttggccaggctgatctgaaacccctggcctcaagccatccaccctccttggcctcccaaagtgctgggattaaacgcgtgagccaccgtgcctggtcgaagagacagaaagggtcttaaaggttcagtgacacacacctgtaatcccagcactttgggaagctgaggctggtggatcactcgaggccaggagttagagatcaccctgggcaacatggtgaaaccccgtctctacacaaaatacaaaaatgggcagagcatgatggtgcatatctgtagtcccagctactcgggaggctgaggcgggaggatcacttaagcctgggagatcgaggctgtagtgagccatcattgcactactgcattccagcctgggcgatcccatctcttaaaaagagagagagatgggaagaccagcacaggtgaaactggtgaacagaggagagatggtagatgctgcattgggcagtgtgacgggaacccgctggagggctttggcaggagagtagtttaagaggatcccagctgggcacagtggctcacacttgtgatcccagcacttggggaggccggggcaggtggatcacttgaggtcaggagttcgagaccagcctggccaacatggtgaaaccctgtctgtactaaaaatacaaaaaccagccaggcatggtggtgcacccctgtaatcccagctactcaggagactaagacaggagaatcgcttgaactcaggaggcagaggttgcagtgagccaagatcacgccactttactccagcctgggcagtagagcgagactccatctcaaaaaaataaataaataaaaagacctctttgctgggtgctagggagcaagagcaggagctgggagaggcctgcagcagaagcctgttgccagcatccaggccgtggggtgaagggaagggtttggatttgggacatgtcttggaagcatcaccagcagaacttgctgatggattggaagtggctggtgagggagaaaagggggtcaaaggaaactctgaggtctataccctgaccatctggcaagtggtggtgttgccacaaactgagcggggagtagggcaggtgcaggtctggaggatggattcaaaattcagtttttggagtctatgtccctggttctgtagggctgcagatggtctgccaaatcttagcggaacccagaatacgggatttgtttactgtctgtgacttgttggtttccctggtgagagcaaactctttaaaggtcaaggttgggcttcagaccttggtttttgcaccgatcattggtcatactgcagttcctcactcttctcttgcaaatccatacacagctagtccaagagagctgaacagctttgtggttggatcagcaccaatgtatctccacctgtagacgggttgctcaggtgactcatgcctgtaatcccagcaccttgggaggccaaggtgggaagattgcttgaggccaggagttggagacaagcctgggaaacacagtgagaccccatatctaccaaaaaaacccctttgttttaattagccaggtgcagtggtgtgcacctatagtcccagctactaaggaggctgaggcagaaggatcatttgagcccaggagtttaaggctgcggtgaaccatgatcgtgccactgcactccaacctgggggaaagaaagagaccttgtctctaaaaaaactaaaaaacagaaaagcatttgttgagtatttcctgggtataaagcagtgtaccaggttaaatggaaggaaaagttgaaataatttttcaactcataatccgattgggagagactgaatgcttaccattgaagcaggaaccattgtaagcaatgtgttgtgatactgtagcaagagctgagaaaacttgggaaaagagaaaggaggaaggctcacctgagggagttggggggcttgccctacaggtgagttgtgaggtgggtctggaagtgacagatgcagtttaggaagtggacgggaggctgggtacggtgactcaacatctgtaatcccagtgctttgggagacccaggcggaaggatcgcttcaggccaggagttaaagaccagcctgggcaacatagtgggaacctatctctactaaaaattaaaaaattatccaggcataatggcacatgcctattgttccagctactcaggaggcttgcctgagcccaggaggttgaggctgcagtgagctatgatggcaccactgcactccagcctgggcgacagaacaagaccctgtctctaaaaaaaaaagatgtggatgggagggggaacggtgggtgggctgtcctcaccaagcccccaccctatctgctctccagctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctggtaatgctgggggtaatactgggtgtgagcttcttagggccaggtgggcagggcaggttggaaaggtgggaggctgagggtttggcagccctgctccagggagaggatacaggagcaggctgtgggtggggggacagtcagctccaggaagccgacttccagatgtctaggaaaataacagttggataacctgggcaacatagcaagaccccatctctacaaaaaaattaaaagattagccaggcgcagtggcatgcacctgtagtcccagctacttgggaggttgaggcaggaggattgcttaagcccaggagttggaggctgcagtgagctatgaatgtgccactgtactgcagactgggcgacagagcaagaccctgtctcaaaagaacagtggccaggtgtggtggctcacgcctgtaaatccagcactttgggaggctgaggcaggaggatcgcctgaggtcaggagttcgagaccagcctggccaacatgggaaaaccctgtcgctactaaaaatacaaaattagctgagggtggtggtacacgcctgtaatccgagctactcaggaggctgaggtaggagaaccagttgaacccgggaggcggagtttcagtgagccaagatcgcaccactgcactccaacctgggcaaacagagttggagagtaggaggcttggggcctgagctagggggaaaaagcagaggcaggtgggggactggggggcagtgtgctgggtctggtgagtccctcagtgagtcccccagctcaccttttctcctttttctgcagggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtaagtgtcccgtggtcctaccaagctttcctcgagtgttctctcacctgggatttggggtgaagggtgggttcccagagagtcatcactgctgggttcttgagaccatggagatgacaaaaaggagaattgatctttgtatcaaagagttgagatacagggccaggcctagtggctcaagcctgtaatcccagcactttgggaggccaaggtgggcagatcacctaaggttaggagttcaagaccagcctggccaacatggtgaaaccccgtctctaaaaaaatacaaaaaattagcccagcatgatgggcgggtgcctgtaatcccagctactcaggaggctgagacaggataatcgcttgaacccaggaacagaggttgcagtgagctgagatcacgccattgctttccagcctgggcaactgagcgagactctgtcttaataaataaataaaagagttgggtacagcatatttgggtcgcagaaggatgcagagatggagggcagggttgagaggtaacatgtctgtatcatagcccaagagctgctggggccttcagccacagagagcttcaactccggctaggaggattcctggatctgttattttttggggggctgtggctcctatcctaccatcttccaagtcaccatttcctgggcctgttagcatctttgcttttcctggacagcctcacccagagcttcttcccctctttccaggtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcgggtgaggactgcagagaatgggccctccttcccgctctctgcccccactccttgcccagaagtgtccgttcattggtgttgggtgggagggcctctgtccgcctctgcaaggctgggttccacctcctcccccggacctgggcctggtactcagcattcctccccatccttgccccctagggcctcacaccctctcctggaccagcggcagcctcactactcagcttttggctctgtgggcgagtggcttcgggccatcaaaatgggaagatacgaagaaagtttcgcagccgctggctttggctccttcgagctggtcagccagatctctgctgagtaagcagtggcaggagctggagtggggctgggagagcggggcagctggagtcaggcccacggggtctccaggggcttttggggtcagcttcgggtgccaatgctgtcttcttgcactgcgctcatgccatgcctagaagggccccagaggagcagtcacagccccatggagctgaggacccaaggactctttggggccagcctgcccgcctcacctcctcctgccatcacagccctgggccatcgcgcttccgcctctcacttctagctatctttgtgcatctatctgcattccaggcccggctctcacggtaacaatgtgtcaactcgggttctctttttccaaccataaaaggagaagattgggctaggttttggagatcctcttcagcttttatgtgaaatggttttatgattccttgcctcccaaaggctgcgtatccccacttggcctttgtctgctactccccctttctgccttcccgttcctctcccaagatctcctctcaccccaggttgaataacagaaatagaaggaatagaaatctgaaggccgggcatggtggctcatgcctgtaatgccagcactttgggaggccgaggtgggcagatcacttgaggttaggagttcgagaccattgtggacaacttggtgaaaccttatgtctactaaaaatacaaaaattagctgggcatggtggtgcgtgcctgtaataccagctactgaggaggctgaggcaggagaatcgcttgaacccgggaggtggaggttgcagtgagccgagatcgcaccactgcactccagcctggatgacagagtgaaattccatctcaaaaaaaaaaaaaaaaaaaaaaaagaaatgtgaaggccaggtggtggctcacgcctgtaatctcagcactttgggaggctcaggtggaccgattgcttgagcccaggagtttgagagcagcctggccaaaatagcaaaaccccatctctacaaaacaaaaacaaaaaaattagctgggcatggtggtgcgtgcctgtggtcccagctactcaggaggctagagccagagggtctcaggccagtctgcccctgccccacggggcctgggcacatccctccctaattcttcccagcctctctctgacccagggggcctcctctcccttttttccccttatctcagcctccagccatcagcaacctcctcttcctctccacccagctcttcctctcccacttcggccttttctttctcacactccatttccctctacggcaatctgtgcagcctcttcccccagtctcattttgcgggcttttctctcttttctttccttccctggcacccaagccaaaggccctgcctctggcctccagccctacccccttctgcggttgcacagaaggatggctgcccagctcttaaaaaaactgcccgggaactgttgacatctgttctccctcccccgctggcttttctgattggcttacaatcctgaggctaggaccgtctcaggagccaagagaggagagcggccacagggaacctagggtctcaccaagctctcctttccttctgcagggacctgctccgaatcggagtcactctggcgggacaccagaagaaaatcttggccagtgtccagcacatgaagtcccaggccaagccgggaaccccgggtgggacaggaggaccggccccgcagtactgacctgcaggaactccccaccccagggacaccgcctccccattttccggggcagagtggggactcacagaggcccccagccctgtgccccgctggattgcactttgagcccgtggggtgaggagttggcaatttggagagacaggatttgggggttctgccataataggaggggaaaatcaccccccagccacctcggggaactccagaccaagggtgagggcgcctttccctcaggactgggtgtgaccagaggaaaaggaagtgcccaacatctcccagcctccccaggtgcccccctcaccttgatgggtgcgttcccgcagaccaaagagagtgtgactcccttgccagctccagagtgggggggctgtcccagggggcaagaaggggtgtcagggcccagtgacaaaatcattggggtttgtagtcccaacttgctgctgtcaccaccaaactcaatcatttttttcccttgtaaatgcccctcccccagctgctgccttcatattgaaggtttttgagttttgtttttggtcttaatttttctccccgttccctttttgtttcttcgttttgtttttctaccgtccttgtcataactttgtgttggagggaacctgtttcactatggcctcctttgcccaagttgaaacaggggcccatcatcatgtctgtttccagaacagtgccttggtcatcccacatccccggaccccgcctgggacccccaagctgtgtcctatgaaggggtgtggggtgaggtagtgaaaagggcggtagttggtggtggaacccagaaacggacgccggtgcttggaggggttcttaaattatatttaaaaaagtaactttttgtataaataaaagaaaatgggacgtgtcccagctccaggggt

SEQ ID NO: 38148 - DNA, 23487 bp, Homo sapiens; identical to SEQ ID NO: 36081

SEQ ID NO: 38149 - DNA, 69955 bp, Homo sapiens; identical to SEQ ID NO: 37265

SEQ ID NO: 38150 - DNA, 17421 bp, Homo sapiens
accccgctccgggcgcgctctcgggaaggcttggaccgacgcggcccagaggccaggaacattccgcgcgtggaccagccgggccagggcgatgctgcgggtgcggtgtctgcgcggcgggagccgcggcgccgaggcggtgcactacatcggatctcgggtgcgtgcgccaccggcctcgtctggcggccgcgtgactcactcgatcctgcgggcggcgtggagcactcgctcgctccctgcccggagccgccaccttccctcgctttccctagccggaattgcacgagagtgtcccttctggtatccctgggaagctcagcttcaagagccttcgcaggctccaggagctgggcggcgtcccccagtcagggggaacttgcgttgcggctccagcccttggggtccacttgctgtctgcgcgtccgcggcctgctggcccacggcgcagggggcgccgcccccctctaccggaccttggtgcgctgcaccaagcttcccgctcggagcaaggggttgggacgacggaggctcctcttagtaaaagggtggcgttattggggttcagtagcctgagtgggcgtcgagttggggagatttctggaaaatgcgtgtggggtagatggatggggagaagaggcaagcaaagtgggaatcggggacggggagcgagcgaccagattcactccaagtataacatgggatcccacgtctggagaggagtcggggcgagtgcagcctgtaagcagagtttctgcgctccccgccctcggctgccctggcagcagaccctcccatgcttctagtactggaatcgctccgacattctggcttcctcccagcaactggttcctgaacagctgtcattctccgtctttcttctgcctccacccgagttctcctcctgcccacttcctaaggcttttaacagagcaggatagagatttggggggttgaggtttgctcaggggttgagggaccctccctgctctagattttataggccatgcatttttaaaaggcttttgaagtttttagatctccttcttatttgtttgaatttacgcctgagctaatcctgaccttggctagggtactgtggaccatctgtaaaatggagcagatggcagttgctcactctcagaattgaagtgccaaagaatgcgaagtgtatgtcaaagatgaaaaaaatttgatttgaagctggttattctgaaagataaggtcctttacaaatgttcccaacttttcatttgtaaaaaaaaataaataaaaagcctaatattggtaacctttgatacttaagggaaaaggaggttccgtccccagctgagactggcgggaagttttagagcagctgtctatggttttctgagaggaggactgacccatctgcaaaacagttgcttaaagcttgagtgcaggaattgcattctgagataaagatgggggtgtatggtagctggggacacggtcttctgaggagttttaaagagttacagcaattaatagataagaagacaatttgtagataaacaagagggttaaaaaaattatctgtaatcccactacccacctacacactgttaacgtcttggtttatgctgttctaaaggggtttaagtggcaatgttatgctggatttttactccatctccacttcctcctctctgtaagtactgatagagcaatgcaatacaataatcttttctttgttcttggaagcttggacgaaccttgacaggatgggtgcagcgaactttccagagcacccaggcagctacggcttcctcccggaactcctgtgcagctgacgacaaagccactgagcctctgcccaaggactgccctgtctcttcttacaacgaatgggaccccttagaggaagtgatagtgggcagagcagaaaacgcctgtgttccaccgttcaccatcgaggtgaaggtaaaggaaggctattcacatgtctgaaagtgcgctccctcctcacctgctgctgctaccctctgactgctttcccttcagcttactcccagacctctcaatccagtgattaagttatcttacttgacacctctgtggtatttgacactatttacaccaatgataattgcttccttcctgaagagcttcctgaagctcttcccttggattctgagagagcttttctgggaataatagttctttcactgtcctcagatcttcttccgtcacagcctgtaatggcaaggttgaacagaatattactttcagcccccttctcttagccattctcacagctaccgctcccacctcctctctggtccggatctctgtattgaactccttccagatcaacgagttaaactccttacgggatattgccacaggacttcaaacttggcacatctggagttcagttgccagccacctgctcaagtggatccctcctcattcctgccttttaattattggcattcctatttaatcaagctaaaacacaaaagaatcatctttgatttctccttatgtcacgtgatgtaacaaggcttttgtcaaaaatgaatcttgcctcattcctctgctttgcctctccctaaaggttgggagctcatctgctgcctggactattgcagttaactcctaactggtcactcctactcactcttctcaccaaatcacctggcagctgcaatccaagtgattttttaaaactcagatgtgatcatgttactcatcctgcttcttttcctcctgtactttgctaggcgacccccactaccccaccaccccccgcattgtttaggataaagtcttcatggtattcaagatccttcacaatctgactcttgtctgcatttccaggattccccattccagttattgactcatctgttagtacagcagattagcaggtgttcatttctggtcaagtccctctatcctctaatattccaccctggttttcagcagactttataagacaaccatataaggcagctaagctagactactcactgtttcttcacaagccctgcatctttgcccctacctaagtctcttccatccatcttcctgtgccctttagtctgtagtttaaacctaccaccacctagcttcaatgacacctttcacaaagtcttccaggatttccctggcaacaagtaatatctctctttttaaaaactcctagtggtggccaggcgcggtggctcacacctgtaatcccaacactttgggaggctgaggcgggtggatcacgaggtcaggagatcgagaccatcctggctaacacggtgaaaccccgtctccactaaaaatacaaaaattagccaggcgtggtggcgggtgcctgtagtcccagctacttgggaggctgaggcaggagaatggcatgaacccaggaggcagaggttgccgtgagctgagatggcgccattacactccagcctgagcaacagagtgagactccatctcaaaaacaaacaaacaaacaaaaactcctagtggtttttatctgtaacgttcttatatccagggcctctatgggctggtgttcaggttctatactgcataaggattccatatctaagggaccactttccacattgtagacacagcctagactcctattaataatgggttacaaatgtatctttagtgtccttaaatttttcctgaatatttacacttttatttgtaaagtggattgaggaaagaagttctgtaacagcattgtcgtggtcttcagaaatattgcctaccatgtaccagggctctagaggtattaatataaaagatcttcctttctatttgaagagatttgatgttcacatagaaacgaagaccaagtatcttattccagtcgactgacaaggcagttgaagtgccaggaaagaggaatgaccaagggctggccagttaagaagtcctcttgaagaaaatgactcctgagttagacttggaagacagggaaatagaaaaagtaataacttctaattgttctgaaactatctttggttctgatatttggaatttgatgagaagattaatttatacaccatccacatgtttttaaaaggcatagtagtctttttaagtcttttcttgaaaagtcccatcccctaaccattttaattgggtgaaattaaaatttaaatccaagcaataatttatccttctacttgtctttaaaatgatagactttcatatcatgcgattttacagaatcagaattctcagaggtaattttgagttctttgtcacttgatttatgactttagactttgtcatttcatggacttgtggaaaaagtaccatgctgaagtcaggagtctgggattaattaggtatttgataaaaacttgatagctagtctcggttacttagctatttgaccttgtacaagattccacaaatttctgggccacagtaaaatgaagatattaagaggtttgctagtttgctatctacctaacaggattaaggattaatctaaagataaaaggttacatgttaagtattttaaaggacaacacaacaacttattatagttgtatggatccagtttgccaattacattccaaaggtactttgtcggtgtaatagttgtagatatcagtaacattagcagtattgatttcattcgtctggttctttttgtttgtttattcttctttctctttctctctttgattctagacaggaaataatggttatttctgtttcatgccatgtgctaagcctggttttgagggagaagaaagtaaatctaagacatgcatggatcctagcaagcaaggccatgcctcgtagtagagaagaatgacacatatattaatcagtttgggaacaataaaagaaaaaataatgtagtaaactgtccataggcaatcagagcagaagatgttggaagatataagtactagagaaattttaaggaaaggaatgtggaacataattgttgggaagcataattttttaaagctctgtgactttttgttctgcaaaatatagtaaatatctgctatcaaatatatatatatatagatatatatttttttaagatggaatctcgctgtctcgcccaggctggagtgcagtggcgtgagctcggctcgctgcaagctccgcctcctgggttcatgccattctcccacctcagcctcccaagtagctgggactacaggtgtcccccaccaggcctggctaatttgttttttttgtatttttagtagagacggggtttcaccgtgttagccaggatggtctcgatctcctgacctcgtgatccacacgccttggcctcccaaagtgctgggattgcaggggtgagccaccgtgcccagcctcaaatatgttttttgttttgcttttgtcttttaaaaataaagcccttgataaaggaccttttataaaatacaagattaatcaagattagtgtaatataagcttacagctggataaatacatttctgttgtcatttcttagccttccaaagacagtatttaaaaattcacttggcaaacctttgtaaagggttttaggctttgaaagaatataaaggttcaaggaatgcagacatacctttgcaacagattattaaaagcatcatatgctaagcgtctaatatagtgttcatcatcttgcaaacaacttggtgaatgattgctggctcatttagcagggttataaaggaagtgtaaacaatttctagctatctcttgtaaaacgtattgtgccctgatcatttgtactttgcccaacctttgccagattataaactctacaagaaaaaatcacatttgttcaaataacctttttctcccaggaaggtttaatttatcaaggcaagcttcaccctgcacaaatagtcacggaggatactttggaatgagtctggcaagacagcataactctgcatctgctgtaacccagtgttaaattttcaaaggcttcttgtccctagtggattgtaggagatgtgcctggcatgagaaggaggaagtggtgaatggatgagtagtaccagcatgtatctgagaggaatataaagagtcattattatcctctttctggttgctgttgcagaaattcctaggagtagaaaacagtggagtgcttttattttgttttttgaaagggtagcttggtctttaaaaatgtttaatgatgataacatttttcattagtccagaaattcagcctgctgtttgcctatagaccttagtaaaagagctaattaatgattcagaccccaggcgtcagcaaacttcatctttctaccagataataagtaatttaggctttgcagaccatcggtctctgttgcaactactcaactctcagctgtgccattgtagtgcaaaagcagccatagacaatacgtaaacaaatgaatgtgcctgcgttcctgtaaaactttatttacaaaaacaagcagcaggccaaatttgcctatggacctttttttaccagcctctgtttaagactttcactggcatcattcagtttttctaaagacctgtttcttggcttattccttattcaccaagctaggttccagcgtaactgatgtgaacctggatattgaactaaccagagatgggtccactttcatatatttgatatttgtcagactgagataaaaatggaagtcgagacacaaaatctagaaaagatattgtttttgacattaaagagctaaacatctagacatttgatcagtcttgatgagtaaaagccattgggacaatttgaacttgttaagcaattccagtcttaaaagtttttgcacatctagttagaagtgttcaaaccagtataacatggccaagtcccatgatgtattagggacactctttgagtaacagtcagagaacttgagttctagtcctgcttgtccagatagctagcaagcatgtgacctgccagagcctctttccttacatgtgaaataagcatatgagaacttgccctgtttctttgataggattgctgggaaaccaaatgagaatatccagctaaagtagacacactgtgacacacttgagcccattaccaagttttacacctttctagtacttattgctatctgaaattatctgatttatggtggagactgtcatatctgacatgatcaggactagtagtttgtcagttcatcaattatataaataaacatttttaaaatacctgctttaaccagttttaaacaaaaatttaaattaaaacacttaaaacatttttaaacttaaaatatatcaatgtacattgctttgctaatcttttgatgaaggttcaaggctttttcttagagtctggattctctgattggcgttctgcttcatttagcttgaaaaatgggaagatgcatcacgtacatttctcaatgtatttatgattgagaaattgactaagaacttagacatttggaaaacaatctgaatgcagaatctgtctagatttttacatttttgaaaaccaatattttggccgggcatggtggctcacacctataatcccagccctttggggggccgacgcgggtggatcacgaggtcaggagattgagaccagcctggccaacatggtgaaaccctgtctctactaaaaatacaaaaaattagccgggcgtggtggcatgcgcctgtaatcccagttactcagggagttgaggcaggagaatcatttgaacctggtgggaggcggaggttgcagtgagctgagatggtgccattgcactcctgtctgggcaacagagtgagactccatctcaaaaacaaaaacaaacaaacaacaatatttaacagctgttgcacctaccctattcaacaataatttttagcaaactgattgagccattttaaagcattcaaatgttttctctttagttgtcttctaaaatacacatagccctggaaactttctaaattttttttcagttattaaaaatttgtgaatttgcttatcatatcacttccttgtatgacaaaaagacttgaagagatgtgagagctgaatggattagaaaaaggagaggtgtggttggtatgaggcatattgacagggaattaccaaaggcagatttgcactgtcacacaattttggcaagtgttaattctgttgaatgggaaaatcaataatgtttttttttttctttttctttttctttttctttttttttttttgagacagagtctcgctttgtcacccaggctggagtgcagtggcacgatctcagctcactgcaacctctgcctcctgggttcaagcaattctcctgccttggcctctgaagtagctgtgactacaggcacgtgccaccatgcctggctaatttttgaatttttagtagaaatggggtttccccatgttggccaggctggtcttgaactcctgacatcaagctatctgcccgcctcagcctcccaaagtgctggggttacaggctgagcaaccatgcctggccaataatggggttttaagagaaataaagcatatttgaaagtatgctcctgatcttaacggggcaaaatatctttttttttcccttcacaaaatatcttgaggtgctattttctagacagaattctgagatgcatggatagcccatggttttggcttagtataagtgcttttattctcttatgctagtttgtgtgttctcttgtttcattttattgaggctctctaatagaagtgctatgtcctgttttgtctgcaaagcatggcaaaaaaactggccaagaggattccaagtctgtctgaaggtaaacatgctgttagtggttggccatgagatctcaggcaggaggagcaaaaggcctcaaaatatcaagatgttttagagttcttcattcaacagatactgagtgtctgcccagagggcttatgtgctcaatgctagggatcagcactgaacatggagtggttggagtctcaattccaataccttatacaaagagctgtttactgcctatgaacctatcatgagctgtatttttctcctgtaagtattgtgtttatttgcttctacttccaggccaacacatatgaaaagtactggccattttaccagaagcaaggagggcattattttcccaaagatcatttgaaaaaggctgttgctgaaattgaagaaatgtgcaatattttaaaaacggaaggagtgacagtaaggaggcctgaccccattgactggtcattgaagtataaaactcctgattttgagtctacgggtaagtgatgtcagataactaaactgccagtgtctgaattttcaatttctttcttaatgtgtaaggggaaagctccaaaaaatttcttggagagtcctttgctttgctagttcttgaaaactttaaagatttatttaggaatggtttggtccatgttgatatgattaagatgtatacattctaaactccattccatctcgtggaatctccttgaaatgacaagttttcctaaactttatagccatttccttacataataacagtggattcgtttaattttcctcaagaacagaaattaaaaggggaatagaaacatttccattttatttttaactgacattgctgcatgactgttcttgtgccttaggtcactgttctaatttctagttttagattgatccttggctcaatttttatcttgtgataccgatagtcctttaagagctgtgtttctgtatagcaagaaaggagcttacaaatggtgaaagcttggtggttcaagatctctttgtacaaggactttattccttcacttttttttcttttcttttttttctgggcttcccccccaccacacaattcatgttaacaatctagtatgtgttattcgaattttttgctattttcatatatatatacacacatgtatttctagcaatttttttaaccaaaaaaagaggtaatattatatagacattttttgtttgtttgtttgagacagagtctcactctgtcgcccaggctggagtgtggtggcacaatctcggctcactgcagcctttgcctcttggttcaagtgattctcctgcctcagtctcccgagtagctaggattacaggcacgtgccaccatgcctggctaattgttttcgtattcttttagtagagatggggcttgaccatgttggccaggctgctcttgaagaggatcaagtgatccgcccgtcttggcctcccaaagtggtgggattacaggcatgagccactgtgcctggccctatatagaccttttttgtcttggaaattaacactactgaagttgtcatggaattttttggtctgacaggtttatacagtgcaatgcctcgagacatcctgatagttgtgggcaatgagattatcgaggctcccatggcatggcgttcacgcttctttgagtaccgagcgtacaggtcaattatcaaagactacttccaccgtggcgccaagtggacaacagctcctaagcccacaatggctgatgagctttataaccaggtgagtccctaattataggctagcttattactaacttttctaaatgatccacaaagagtaagatagagattctctgataccttgtatatattatgcattttagaaaccgaaaacatcatcttatttttaaaaagtgattattttatgatgaatatgataagagtaaatgatcctatgataataataataatggctaacactttttggtgcttaccttgttctgggtcctgggttaaaccctttatttacatcctcaatcctgtttgtttttcacaacaaccctaatcatactgtagtatcattccattagatggggaaaaacttgcctacaggtgtaccactgttcattagtggaaccagaaaagtcactagactgaagttcactttcttcttctagaaaaagaacctgatctacagttcaaattcacagtaaaatgaaatgtatgtcccttattaaatcagttaccatttgatcttttatagaaaaaaatttaaaaatcaaaatagcttctgggtttaaagacagaaataaataatgaattagttttgccactcccaatcaaatttggcaggggaaacatggcatctcgttttatggtatgagttaagctcgggaccaaattccttttctaaaagaacagaatgacttcatcctgtttactttccgtacggttcatggaatattctcagaatcagttactgcctctgtatcactttttttttttttttgagatggagtcttgctctgtcacccagactggagtgcagtggcgtgatctcggctcactgcagcctctgcctcccgggttccagcaattctcctgcctcagcctcctgggtagctgggattacaggtgcatgccaccatgcctgacgaatttttgtatttttagtagaaacggggtttcaccatgttggccaggctggtctcgaactcctgacctcaggtgatccacctgccttggcctcccaaagtgctgggattacaggcatgagccatctcacctggtgtgtaccatttttttctaagtacatagtgccccttcatcctcaggggatatgttccagactctcagtggatgctgatactgaactctatatattttgttttttcctgtacatatatacatacctatgataaagtttaatttacaaattaggcacagtaagagcctaacaacaataatgaataataaaatggaacaattatataaatatactttactaaaagttaggtgaatgtggtctctctgtttctctcaaaatatcttaatgttttgggacgacagttgactgaaggtaactgaaaccatggaaagtgaaatcatgggtaaaggaggactgttgtatcaggaaattactataatgctagtttcttgttttattgttgttttggtttatttatcatggacccgcttctttcccaggcatgttttagtctagaactgagtagtaatattttgggaaatgatgttaaactaattttcttagtactgtatgccttatgaataattttctcatgatccagtgcattgtgtgtgttcattcttgttccaattaggattatcccatccactctgtagaagacagacacaaattggctgctcagggaaaatttgtgacaactgagtttgagccatgctttgatgctgctgacttcattcgagctggaagagatatttttgcacagagaagccaggtgaacgcaggctgcctctgaaatttcacactatattattgtattctttacttccaaattaaaatattttcatcctaaatttttttcaccttgaatatttttagttttctagacatagaaccaaatatttatcgatcgtatgtctttcttttgttttcaggttacaaactacctaggcattgaatggatgcgtaggcatcttgctccagactacagagtgcatatcatctcctttaaagatcccaatcccatgcatattgatgctaccttcaacatcattggacctggtattgtgctttccaaccctgaccgaccatgtcaccaggtaagagatttcttgggactctggaaaagcaacagaatctagtaactaaaataattgccacttttattttaagcacttccatggttcctaatggttctaaatgacagattcagcagtactcaacattattatgatcaaacattggattccttatggcttattacaagatgtccaccatgcagaaatatacatagttgacacaataattagtatgggatcatcagactttggccacttgctgttgtcagagcctcaagtttgtgcatatgtgtgtatttttatcaaacgatggtgttataacttgcaacagtggttccacagcagcgaattttggacaagatcatccttgcatggccagggcaatgccactgggcagtggttgtattccctctacagtggggtagcctccctttggccaaccctgctctgtagggaaaagtgaagccactgcactgcagctggtctatccccttcacctgcagcctcctactttctgtccatagcctcctacttccagttaggtgatgagtgattttctgttacttgcaaggctgcagtacaacttttaaaaaccactgttatactgtgtcactgttcatttctgttttttatttttaaacccgatgaccatgactacttattcatttcattttattatcatttattcgtatagtaagtgggtatgtgaacacagggacggctaagttgtaaaaggtcactaaggacaatatggttctttgagaatgcatagctaacaactgtctttataccatggtcctagatacaaaatgatgggcaagaagtagaaggactgtgggtttgatgtagtcacatttttgttttcttgtaactaaataggaaatttttcaatttttaaaatgagaatttcttaaggacagtatctttggttttttaagtctctgaaacctgagaaaagttaagactatctttaaaagctgtaacatttctgttactttttaactttaatctggggattttatgtacatttttaattaggattcagacaaaatcacccaaatgtttagaaattttaatttctttcttttggaagctgagaagacagcttctcaaagagaattattactgataagggctattagagactaataataataatagtatatgtagatttaacggttttgggggttttttttggtcttacagattgatcttttcaagaaagcaggatggactatcattactcctccaacaccaatcatcccagacggtatgtttactttcatacactgttagactaaaataattactttagtgaccaaggatctttctcctatagagagcagcccaaatgttagcagcttagagaatgtgtttcctcagtaaggtgtgaagtggtgcttgggactgtgagcatcagaacaaggctgggacttgtgtttgcaactttttcatccatagaaaatgaagtaaggagaagacagaataaaacaacatcacgtaaagcaagatatgactttttttttttttttgagacagtgtcttgctttgtcacccaggcttgagtgcagttgtgcagtcacagctcactgcagcctcaagactcctgggctcaagtgatctttccactccagcttcctaagtagctgggactacaaatgcaggccactatgcccagcaagttatttttttttatttgtagagatgatgtcttgctgtgttccccagtgaggcaccatctctgggcaatagtctcaaactcctaggctcaaggaatcctcctgcctcagcctcccaaagtgctaggattataccatgcccagccaagatatgacttttaaaagaaaacagggtgaaattcaaatgtataatgagtacagattgattcataccatttatagataaattgttttaagattaaaataaatgttcacatggaaagtgaactactgaaagaactgagctgtcactttaatattcttcacttgtaaatccttgctttaaacaaaaatgatagcggacatggtttaacagttgttgctgtttttagatcatccactctggatgtcatccaaatggctttccatgaatgtcttaatgctagatgaaaaacgtgttatggtggatgccaatgaagttccaattcaaaagatgtttgaaaagctgggtatgtacaacaaatgaaacatgttgtcatacatgaaaacgttaaatgagaagaactaaagaaatgacatgctaggtttgataaatggtttgtctaattcaattttgattccttttagaggcaccaagttattatttcacagaaagtcagtatttttattttcaacacacgtagccccaacaagttggagatgcatcctgagctcctgagacatccccttaacaataagtttataaatcttatatgacttagccaacgttttggtgcccatgtgcagaaaaccacccctttgcaggtgagcagatagcttgttcagcccttcttcaaataagaaatcattgtgggtcctttaaaagtgtcctgtcatcacatatttcaaaggactcaaaagggtacggatgcagaagtgacttttatgtgtgataagcatagttaacaaagtagcgaaatgcaagaaagtgtgtcagtaaatcattcagttttgaactgaagagcaggaccaggttttacttaagtagtttacttatcctgatattcaaaatttagaccaatgattctagtattattgagaaaaatgttgaagggaaaggattttcatatgagctattataaaggggtgtgtgtgtgtattttgagacagagctgtgtcgcccaggctgtagtgtagtggcgtgacctcggctcactgcaacctacactttctgggttcaagcgattctcctgccgcagcctcctgagtagctgggattacaagcatacaccaccatgcctggctaattttgtatttttagtagagaggggcttggccaggctggtctcgaactcctgacctcaagtgatccatccacctatgcctcccatagcattgggattatgggtgtgagctaccatgcgcgactaggaaagtctttctgaatggctcatgccaccttcctctccctggctataccaatggaccctttagtgactttgtagcctatcctcctctcaaaataattagctccttgaggaagaataatagattttctttttaaaaccccactatatctaacacaacagattcttcctaaataccattggttaaataggccatgcacatcatagccttgtcattacagatggtaccagattaaactgattgttggatttgctttggtacctgtataaccatacaaacccagatattaaaacaccagctctgttccattgtttccttatggtggcctggtgaagttaatctgtatcagataaactctccttatatgtgaatatgtaaagtcagctttttaggtcagctaaattttgctttgcctactaaattaacatggtaaaattagaaacagtctgacaaagtagttaatgtataattctaaaaggccttgagattttagtacttgaccattttgaacatttggtaggtacatctgctcagtctattgacttgtgaatagtcaatagaacaaaacttcagagttctctgttgactttttggagaagattttatattagcagatgaaatatagttggtgaaaataaaattggaagagaaaatactattctgggttgggtatccttaaggattagaaccacaggactcctccaagtctgtaggcctactttctctatgagaatcgtcatgttagtccatctaactgacctcatctctctttcaatgcaggtatcactaccattaaagttaacattcgtaatgccaattccctgggaggaggcttccattgctggacctgcgatgtccggcgccgaggcaccttacagtcctacttggactgaacaggcctgatggagcttgtggctggcctcagatacacctaagaagcttaggggcaaggttcattctcctgctttaaaaagtgcatgaactgtagtgctttaaacaatcatctccttaacaggggtcgtaagcctggtttgcttctattacttttctttgacataaagaaaataacttctgctaggtattactctctactcctaaagttatttactatttggcttcaagtataaaattttggtgaatgtgtaccaagaaaaaattagtcacctgagtaacttggccactaataattaaccatctacctctgtttttaattttctttccaaaaggcagcttgaaatgttggtcctaatcttaattttttttcctcttctatagacttgagaatgtttttctctaaatgagagaaagacttagaatgtacacagatccaaaatagaatcagattatctctttttttctaaaggagagaaagacttagaacatacacagatcctaagtagaaccaggtaattgtctctttttctaataaggaatttgggtaatttttaattttttgttttttaaaaaataacctagactatgcaaaacatcaaagtgaattttccatgaatgtttttaatattctcatctcaacattgtgatatatgctactaaaaaccttttcatatacatcttacctcatttcaagtgaattattttaatctttttctctctttccaaaaatttaggaatgtttagtgtaattggatttcgctatcagttcccatccttaagttttgatattcaatatctgatagatacactgcatctttggtcatctaagatttgtttacaaatgtgcaaattatttagagcatagactttataagcattaaaaaaaactaatggaggtaaaacctaaatgcgatgtgaaataattttagtgttgataccgtatgtgtatttttattctaataaacttttgtgttccagattgaa

SEQ ID NO: 38151 - DNA, 213564 bp, Homo sapiens; identical to SEQ ID NO: 36372

SEQ ID NO: 38152 - DNA, 633367 bp, Homo sapiens; identical to SEQ ID NO: 36708

SEQ ID NO: 38153 - DNA, 16970 bp, Homo sapiens
cagacaccaacggtcggaaaccgccagacaccaacgctcggaatccacgccaggccacgacggagggcgactacctcccttctgaccctgctgctggcgttcggaaaaaacgcagtccggtgtgctctgattggtccaggctctttgacgtcacggactcgacctttgacagagccactaggcgaaaaggagagacgggaagtattttttccgccccgcccggaaagggtggagcacaacgtcgaaagcagccgttgggagcccaggaggcggggcgcctgtgggagccgtggagggaactttcccagtccccgaggcggatccggtgttgcatccttggagcgagctgagagctcgaggtgagctgggctcgcggtcgcccctctcgcgcgccctctttaagaaccacggcgtccaacctccctggaaatggggggaacatggccgaggcgcgtggcgaggccgcctcgtggaggccccggagcggcatcctcagcgccccagcgatccggtgcccattaggtgcgccttgaagccgaggcaagctccttcggggtgctgggctgcgggcaaagaattcggccctgtgaagagttgggttcggcctgtctcaggccctgcccacatcccatcacagggccgtggacttgaagccggaacgtgaaatccctatagactgaatgcatttccttcctacctgttctctctccccttttatttttatttttatattattttatttttaatttttactttatttttttgtagagacggggatttagctatgttgcccaagctggtctggaactccggagctcaagcagtccgcccgccttggccccccaaagcgctggaattacaggcgtaatgcactgtgcctggcctttaaaaaaaaattgaggttattttggggacagtagagcgtccagacacatcctaatttgcatagctgcgcagttttaaaaaatgcaatgcatttttacctgttagggtatgtgatttctggctagtaagctacaccgaatcttggctagcacagttgaattccatgtcagatttgtaaacgcaaatttgctctctgcatttaaatatattagatatatttaggtaactacatttaaatgtattgagacatttaaataaatttgccgtctgtatctaaatatctgaagtggaccaggtgcggtggctcacacctataatcccatcactttgggaggccaaggcaagtggatcatgaggtcaggagttcacgaccagcctggccaacatggtgaaatcccatttctactaaaaatacaaaaattagctgggcgtggtggcaggcgcctgtaatcctagctacttgggaggctgaggcaggagaatcgctggaacccaggagacagaggttgcagtgagctgagattgcaccactgcagtctagcctgggtgacacagcaagactccatctcaaaaaaaaaaaagaaaaaaaatcagaactggacctgtagcctgtagtgtgttgccaaataaacttatttttagagatacttctttccattttctgtgaggtcatctgcagtttcacatggtagacagactttggtgagattcttagcaacatagaatgaagagtaaagaggtttgtttatttcacaagggtttatttaaggcctacaatgtgttaaatgctgtaggaaatacccactgatttctcttttcatggaggtttcctgccttctcttaacgagtgatcaattaaactgtttactggaacttgctaagttagtgaacacacgggatacattctttggatgagcagacattggttgggcagaggagcaagaggagagcagtttagacagagacctgcttatacactgtagtgtttaaaagagcttgtgatgttcaggaaacagttgttcactgtgctgcaatataggggacggccagttgcggtggctcacacctgtaatcctagtgctttggaaggccaaggcgggcagatcacctgaggtcaggagttagaaaccagcctggccaacatggtgaaaccccatctctattaaaaacacaaaaattagctgagtgtaatggtgggtgcctataatcccagcaacttgggaggctgagacaggagaatcacttgaacttgggaggtggaggttgcagtgagccgagatcatgccattgcactctagcccaggtgagagggtgagactctgtctcaaataataataatagtaataataatgtaggggacttgatgaagggaaaggattagagagattctgaaaagaaggtagtttggggcccagtgatgactagattttaagtttcatatagtaggaagtggggcactagtaatttttcaagcagaaaaattatttgaccagattcgtgatttcaaaaatagctctggtgatagagtggaggatgggttggagcagggaataaggggaaatgaaaccgttataaaactcttaaagcgggccgggcgtggtggctaacgcctgtaatcccagcactttgggaggctgaggcaggcggatcacgaagtcaggagatcgagaccatcctggctaaaacggtgaaaccctgtctctactaaaaatacaaaaaattagctgggcatggtggtgggcgcctgtagtcccagccactcaggaggctgaggcaggagaatggcgtgaacccgggaggcagagcttgcagtgagccaagatcgtgccactacactccagcctgggcgacagggcgacagagcaagactccgtctcaaaaaaaaaaaaacaaaaaacaacaaaaaaaaactcttaaagcaagtacagcaagaactttgagggtctttgctaagacagcagctggcagcttcaatctggagtagggtatcaaaggcaactgtgtataaggaatagttatataactggtatccaatttctgagatgattttgactgaaaacattgtgtatttcccagcatactgttggtttttctaattatgtgggaaattatgttgcttttacttttttttttgctcattgcccagcctggggtgcaatgctgcaatctcagctcactgcaacctccgcctcccaggtttaagcgattctcctgccccagcctcccaagtagctggcattacaggcgcccaccaccatgcctggctaattttttatatttttggtagagacagggtttcacgatgttggccaggctggtctcaaactcctgatctcaagtgatccgcctgcctctgtgtcccaaattgctgggattacaggcatgagccaccgcaccggccatgctttcagttttcaagaaagaagacaccattattgccaaagattttggtaatttgagagatacaatgtatgttttctccatgtggatactaggtagtaaggatctgttgaatttgaagtgtctatccagaagtattttgggtacttgtttaaggattgtaaaacaatgtttccatttctggatataataaatgtatttgttaatataataaatgaatagattagacccgtaaactatttgcagtgttgagtcatttcccacagttaaaatcaggatgaaaatatatagctgaatacttgctttgtttcttgtaactgatttctttagtacagaacctgctaaggccatcaaacctattgatcggaagtcagtccatcagatttgctctgggccggtggtaccgagtctaagcactgcggtgaaggagttagtagaaaacagtctggatgctggtgccactaatattggtaagtttgggagagttttaagccacaagaaatgatcagtgaatgttgttgtagtcaagaaacatttgttattgaaataagactatcaagtgttgatgtagtaataaattattatttttaagttaaagttagcacctattatgtgcctagtacttagctaggtagtaataataataacaacagcttttattgtgttcttatggtgcgccaggcaggtgttatgctaagagttgcacagaaatatctcatttaatttgcagaatagctgggcgtggtgtttcacgcctgtaatcctagccctttgagaggctgaggtggggggattgcttgaagccaagagttcaagaccaacctggccaacatggtgagacctcgtctctattaaaaaataaagtaggccgggtgtggtggctcatgcctgtaatcccagcactttgggaggccaaggcgggtggatacctgaggtcaggaattcgagaccagcctgtccaaaatggtgaaactctgtctctactaaaaatacaaaaattagccagacctggtggcagaagcctgtaatcccagctactggggaggctcaggaatgagaattgtttaaacctgggaggtggaggttgcagtgaaccgagattgtgccactgcacggcagcctggggacagagcaagactccgtctcaaaacaataaaataaaataaaataaaataaaataaatcctggagtagtggctcacatctgtaatcccagcactttgggaggctgaggggggctgatgctttgaggtcaggagttcaagaccagcctaaccaacgtggtaaaaccctgtctctactaaaaatagaaaaattagccagatgtgatggtgcatggctgtaatctcagctcctcagaaggctgagggaggagaattgcttaaacctgggaggtggaggttgcagtgagccaagatcgattgtgccactgcattccagcctgggtgacaagagcaaaagtcaatctcaaaaaattaaaaaaaaaaaaaaaggaaagaaaaaaaagaaaatgacaaaataaaaagacaaaaaattattaatctgccaaataactttatgagatagaacttattacctccattttacagttgaggaaattaagggacagtaaattaccttttttggagattataaagctaataaaatagaatctaggaagtctgattccagaaccagttctgttttttttcttttttttttttttgagatggagttttgctcttgttgccgaggctgcggtgcaatggcacgatctcaactcactgcaacctccgcctcccaggttcaagcgattctcctgcctcagcctcaccagtagctgggattacaggcatgcaccaccacacctggctaattttgtatttttagtagagatagagtttctccatgttggtcaggctggtctcgaactactgacctcaggtgatccgctcgctttggtctcccaaagtgctgggattacaggcatgaaccaccgcgcctggcccccgttctccttactgggtatgttaaaattatttctttcaaaggaaaaggctggtcaaagtgcaacggtctttacaactaattgatcacaaccagttacagatttttttgttccttctccactccaactgcttcacttgactagcataaggaaaaaaaaaaaaagaggaaagaaagaaaatgctaaactatttaatctgggctagtaaatagccagaaagaactttataaaaatgaaatatacaaaatgacactagtatgtttaactaaaggtctagttacgacacttaaatttgcacgttataaataatatcaatataaaaactgatagcatgggtccatttttaataaatatataaatattttaaactttctagatctaaagcttaaggactatggagtggatctcattgaagtttcaggcaatggatgtggggtagaagaagaaaacttcgaaggcttaagtaagttaactttttctaatcctattataaaataattgggccacatgtcttagaattttgagtaacactgtcttgggaaacacaaaaacagttttttaaagccagttactagatatcatgtatatttgttgttatagcacttaagatatcttagtccttactttatactctctttcagctctgaaacatcacacatctaagattcaagagtttgccgacctacctcaggttgaaacttttggctttcggggggaagctctgagctcactttgtgcactgaggtgataaaatatttttatccattcacttgaccccttagaaaaacctctctgaaaattaattggaatcattattatttacagttttctgtctcaatatctcagcttccagcttctgaattctgttttgtctcactgccaatctaagtcctagtacttctgaaatgtgagcaataaatgaatgaaatgaagcaaatagtattgttaaaaaaattggttacccttattaaaacagtaacttctcaatttgaacataacatatagataataaatgatagttaccattggttttcattatcaatttttagggaaacatttcaccaaagcactatttaattatagcacagatactaaatttttataaataattatatgcacacacacacacacacatatatatacatatatatatatatatatatatatatatatatatatatttttttttttttttttttttttttagacagagtcacactctgtcacccaggctggagtgcagtggcacagtctcagctcactgcagtctctgcctcccaggttcaagtgactttcatgcctcagcctcctgaagagctgggactatagcgtgcaccaccactcctggctaatttttgtatttttagtagagatggggttttgccatgttgcccaggctggcctggaactccaggcctcaagtgatctgccctccttggcctcccaaagtgctggaattacaggcacgagccaccacaccctgccctacatatacattttaattataatatcttttggattctttaaaaaaatttttttaaatttttaaaaattctttaaaaaaattcttttaaaaaattttgtttgaagagtaataacaaaacaaatctctatttgagaatcaataaatcttgagatcatttatggttttgcaattcaacctgaaaaatgaagtcaaagcttttatcaaaacaaagcatgtttagtgctctctgtctcactgtcttttagatgccagaccttagattttatgatgactcctcaaccgtttagatctcggttatctcagagggatcatcagctttttaagaaaattttgagagaaaagcaagtgaagaaaagagtagtcagtgcccaacatcacggatctctcactgaacacaccatgcctggtattctctcacagtgatgtcaccatttctacctgccatgtatcggcgaaggttgggactcgactggtgtttgatcactatgggaaaatcatccagaaaaccccctacccccaccccagagggatgacagtcagtgtgaagcagttattttctacgctacctgtgcaccataaagaatttcaaaggaatattaagaaggtacagtaaattaatcctggttttcaagaatattggttaatgcacatgagcaaaagatttactaaagatgtttattcttcagttgattcccttcccctaatttattgagaaatgctttatttgcatttctcattaaagacttaacttcagaatgatttacttttttctttttatcacatagtgtttattaggactgggaaacatagtgagactctgtctctatgaaaaattaaaaaaaaaattgactgggcatggtggcatgcacctgtagttccagctacttgggaggctgaagtgggaggatcacttgagcccgggaacttgagactgcagtgagctatgattgcgtcactgcacttcagactgtgagacagagtaagaccctgtctggaaaaatatatatacatatatatacattttttttattttttatttttatctttttttgagatggagtctcactttggtgccctggttgcagtgcagtggcgcgatctcagttcactgcaacctccacctgccaagttcaagcgattctcctgcttcagccttctgagtagctaccattacaggcacgcgccaccacgcccagctaatttttgtattttcagtggagacggggttccaccatgttgtccaggctggccaggctggtcttgaattcctgccctcaggtgatccgcccacctcggcctctcaaagtgctgggattacaggtgtgagccaccatgcctgaccttatgtacttatatttttatgagaatatttctcttggttttctgataaatgagttactggaacccttatgaatttgaatgcaaatgaaacagctaaatgttatataattgttgtgtttaaaaagcagattataaaactgtctatattatatgattacagttttatgaaaacaaaacaacaggcctaaatgtgtatagtataaagactggaagagtcagcacttccatgttctcagcggttatccttggatgtgagatctcatgcactttttgctctcttctttgtgcctttccattttgcatgcatatttcttataatctaaaaagttacttaaacatatgcagctaaaaactttttttacttgtaaagcattcggtgctaattttaactttttttttttagacggagtcttctcactctgtcgcccaggctggagtgcagtggtgtgatcttggctcactgcaacctccgcctcctgggttcaagtgattctcctacctcagcctcccgagtagctgggattataggtgtgtgtcaccacacccagctaatttttgtatttttagtagagatggggtttcaccatgttggccaggctggtcttgcacccctgacctcaagtgatctgcccacctcagcctcccaaagtgctgggattacaggcgtgagccaccacgcccggctttttttttaaagcttttttgtaagtcagccagcaagaacacaggaggaagtactcaaatctcccttacacagctcggggctatgtcaggttttataagcgtagggtaatgaggtgtgatttgattggatcttgcaataaagtaatgctgggagatgtgatctgactggatcctgccatggggtgacgccaaaactcaatctgattggatcctggctcctgccttggggtgtctggttcttaaatcggtccgagctcttcaggctgagctcttaggttccactccacggtggcacgcttggttaacctgggcatgcacagggtacatgaccttcaacctgcgggtcgatggcaattgaaaaacaactgacaacttcattacataaaagttgaactgattcgggtgcggtgactcacgcctgtaatcccagcactttgggaggccaaggcaggtggatcacctgaggtcgaggagttcaagaccagcctggccaaaatggtgaaaccccgtctctactaaaaatataaatattagccaggcgtggtggcgcacccttgtaatcccagctaccccagaggctgaggcagcagaatgcttgaacctaggacgtggaggttgcagtgagctgagatcgtgccattgcactccagcctgggtgacaagagcgaaactccatcaaaaaaaaaaaaaaaaaaagttgaactagatttggtctgatgcagttacagatttacaaaccgcgtcccaccctcctgccgacaccttccactcctcattcttgagggattagggatggaggtcatgcttctgtatcgacttcatgctgactaggggcacttagtcccctaaagtgagaggaatgaaactcttgggcttctgagttcaaatgagttctggggtcacctggagtagcttgaaaggctggtattgttgtaatacaagctgaaggtggaagtgttggatcctggaggacaaacagctcaccatccatttaaataaataggaccaaaaagtaacagaacagtggccacgaggcgccccaacagaggaagaaaccaggtgaggtgtggtatagtggactcgactgccttctaaatctcagtggttggccaggtgcggtggctcacgcctgtaattccagcaaaagaagagccgaggcagggtgatcacgaggtcaggagttcaagaccagcctggcaaacatggtgaaaccccgtctctactgaaaatacaaaaattagccaggtgtggtggcgtgtgctgtagtcccagctactagggaggctgaggcaggagaattgcttgaacctgggaggcggaggttgcagtgagccgagattgtgccactgcactccagcctaggtaacagagcgggactccatctcagtcaatcaatctcagtggttgtactacccttgatatggttcagctccgtatccccacccaaatctcatgtcaaattgcaattcccagtgttgagggagggacctggtaggaggtgattggctcatggcggctgacgtcccccttgctgttctcatgatagtgagtgagcgctcatgggatctggttgtttagaagcatgcaccacctcccgcttcactctctctgtctctcctgctccaccatggccagaaacgtgcctgcttccccttcgccttctgccgtgattgtcagtttcctgaggcctccccagccatgcttcctgtacagcctgcagaactgtgagtcaattaaacctgttttcttcataaattccccagtttccagtagttctttatagcagtgtgaaaacagactaatggacccttctggttgaaggaatgtagccattctgcttgtttgactatttcctttctattcatctctatttcccgggaggtgtttatccaagtgcaataggagatattggtgactgcagagtcccctcagtgttctgctagtaaatagttgaaggttgatcagtgatctcctgcattttcagtctggcatggaaaagcccccatgtaactggtaaaggtatcagtaagcaccaggaggtatctaaatccaccaggagccataggcatcatgttgacgtccatttaccagtcttccctggcaagattctctgaattgtactgccttggccaaaagaggtatgggaggggctgggcacagtggctcacgcctgtaatcccagcattttgggagaccaattcgggtagatcattagaggtcaggggttcaagaccatcctggccaacatggtgacattccatctctactaaaaatacaaaaagttagctgggtttggtgttgggtgcctgtaatcccagctactcgggaggctgaggcaggataatcacttgaacctgggaggtggaggtggcagtgagctgagatctcgccattgcactccagcctgggcaacaagagcgaaacttcatctcaaaaaataaagaagtctgggtgcggtggctcgtgcctgtaatcccaggactttgggaggccaagacgggtggatcatgaggtcaggagttcaagaccagcctggcctagatggtgaaaccctgtctcgagtaaaaatacaaatattagctgggcatggtggcacacacctgtaatctcagctactcagaagtctgagacagaagaattgccaaaacccgggagggagaggttgcagtgagccgagatcgcgccactgcactctagcctgggcgacagagcaagactctgtctcgaaagaaagaaagagaaaggaaattccccagggaagtacctccgcttatttcatgaagaggtactgaaggaagcagaggcatgtggaggacttccccacctcgtgcagctatttgggccgtggcgtctgaaatttcttatttcagagtcacccctttgatgaccttggcagtggactgcagtcatctgtttaggcctctccatggcccgcgtcaatgccggtatttctgtctgttgcgcatttgatttccttgttgttggcatttagaaggccccctgtttcccagatcacaccacgggcatggaccgcagagattgcgtcttgtgagtctgtagaaacagtcaaggccttgtcctctcttaggtccagagctcaggttaatgcagattttcccggccgtctgtgctgaactccctgcggggaggctcctggctggtttcctgtaggtagacagctacacatcctgcccttcattggcttcttttcatgaagctcctgctgtctacaaaacatgtctcccttttcttcttgaaccacatctctgttattgaaactctagaagtcagccaggcacggtggctatgcctgtaatcccagcactttgggaggccaaggtgggcggatcacctgaggtcaggagttcaagaccagcctggccaacatggcgaaaccctgtctctaatacaaatactaaaattagccaagcatggtggccgctgcactccagcctgggcgacagagcaagactctgtctcaaataaagaaagagaaagtatcatgcttttcagagttctgtgggttgttatagtgaattatcaaacctgaggacgtggtgggaacctccaaatttgcagccagttggtgagaagtacatgcagtctgtggacacccaagcttgcagctgcatctgaagcgagggcagcctagcgggggctggtggccttaacctgtagcatttgatgtaacatcagggagttgacatcagaattacgtcacacaggccaggtgcagtggctcatgcttataatcccagcaattagaaaggcaagataagaagatcgcttgagcttcagtctgagcccgcagtgagctgtgaccgcaccactgcaccccagtctgggtgacagcacaagaccccgactccaaaaataaaaaagaaaaatcacaaagaattgcatggcagagcgcctgtctttcacagcttgaactgttgcaggaactttctttttttcttttttttctttttttttttgtgatggagtctcgctctgtcacccaggctggagtgcagtggcgcgatctcagctcactgcaggctccacctcctgggttcacaccattctcctgcctcagcctccggagtagctgggactataggcgcctgccaccgcgcccagctaattttttgtatttttagcagagatggggtttcaccatattagccaggatggtcttgatctcctgaccttgtgatccgcccgcctcagcctcccaaagtgctgggattacagtcctgagccaccgcgcctggcccttttttttttttttttttttgagaggggttggggagacatattctctgctggtgattctcctgcctggtctcgaactcctgctgggatcacaggcgtgagccaccacgcccagccacctttagagttttcttaccacctggttttcctctctcaatatctttctctcatttcctgctttaaaactctagcctggggtctgggcgcagtagctcatgcctataatcccagcactttgggagactgaggcgggtggatcacttgaggtcaggagtttgagaccagcctggccaacatggtgaaaccttgtctctactatttttacaaaagttagtcagacgtacaggcgggtgcctgtagtcccagctacttgggaggctgaggcaggagaatttgcttgaacgcggaggtgaaagttgcagggagccgaggttgtgccactgcactccagcctgggagacagagcgagactgtctccaaaacaaacaaacaaacaaacaaaaaaaccctgtagcttgggatcagccttctcttctattgtttttctttaaaaaataaaaattaaaaataggcttcaagtgatcctcccgccatgacctccaaaactgctgggattgtaggtgtgagcactgcacccagccttatgtttttttctacataaaaaacaacacaggattatcttccagagctaataaatatgttcaaataaccacaaccccattaaggaaaaatgtcacttgacagcaaataatcaatccagaccacaatatgatcacactcactgtgaaggtgagaaaagttcatctttattatgtttccccaagagatgcactgcactgttctcttgaaaacacacagctcatgtcctcctttagaacacacatcctctttaaagtaacatacaaacatgccaaaacaagataaaaaattccatctgaattctcacatttcaaacatacactaaatatcaaataaaaatttatttttacaagaatttaggggaactaccacatagctataaatgtaatatatacattaactaagtatcatagataaaaagtctgctcccttcagcagcatatgtagtaatagatacaaagattgaaaggtaaaagatttaggataaaaagaatcctctcttaaaaaggaaaacaaaattatatttatgtgtatataacagttataatacccatcacacagctttatagaaacagcatctattcaaaaataccagtatttccaaaatatttaaaataatatttaaagtaataacatttaaataaataaatatatttaataaatatttaaataaataaatatatttaataaatatttaaataaataaaataatatttaaataattctttgcccatctttttcgaaataaatcaataaaatagatagtatatattagacatgttagtatatatatctaagacatgttaaaaatcacaactgaattctcacaattcagtcacaaacctaaacagcaaataaaaatttctatgaccagaatttgggggaactaccaatagctataaatagaagagattattatggaagtatcatagataaaaagagtgctcgcttcaggagcacatataataatacagagaaaaatttaaagataataaaagatttaggataaaaagaattctcacttaaaaatgaaaagaaaattatctttatgtatatataacaactataactctcatcaaaaaactctacaggaacagcatgttttcaaaagtacaacaatttccaaactatttgaaataaacctattaatgattcaatggccaacattttccaaacaaaccaataaaatgcatagtgtgcatgaagctatctgttacagtctgtggcactcatatttcacaaagaattctgtgccaatctgagcccctgcactgtgccttcaaatgctcctggactgtggcaaccaagtccgtaagaaacaggacctccaggttccgccccagggaggttggcattcagcaatataaaaagggaggtggtgccgcaggaaagggtggaactggaaacactcctggtttcttacttttctccaaggactcctagaagtaccccaccccacccctgctccttggaggacaacgtgatcactgtattcagctctgtcaagaatggtccaggttcttctagatgatctgcacaaatggctcctctcctccttcctgatgtctgccattagcactggaataaagttcctgctgaaaatccacatctcccctgggtccggtgttctggaagtgagagagacaatgtcacacctcaaggagacagctctctagacaggaaggttattcacgtcccatgtcaagtctagctagagttcagagcaattgagaagtgcgattttatctcctgcctttcattctataccctgcttctgaaccatcgtgttcaactgtgaaactcacgctttggtgaccctgactccaaaacttaatacacccaaggtcagccccagtgatctgcttcatagcgaggactttgggtgggtcttcccagggagtagggcaccctcagagaatgtggctttggacttcatcacagctagggtcttttgtgtcacttcagatctaaacttgtaactgtgctagatctgtttctaatgtgacaacatcacaaaccacgagtccagaagcctaatccataatcctacctcctcatgacgaagtctcatgctctgtgctcaacatggttagctgcacaagatgtaaaccaaagcttcactgaaccctcgacccaaatcggtaactcaagtgcatcaatcataaagaacctccccgaactcagtatttatgattatttttgaggcagggtctcactctgtcgccccggctggagtgcagtggcaggatcagggctccctgcagccccgacctcccaggctccagcgatcctcctgcctcagcctcttgagtagttgggagtagagatgcctcccacatcgcctggctaatttttgtatttttgtggagaggggatatctcgccacgttgccgaggcttgaagccagatcaagcaattgggttccttggatttccgaaatagaccccaatattctgcctttaccccggaggatgcagatgtaccttctctcaggccgatgacctcaggcctccacggtccctggagctctaggaaaggtgggcgcgatctcgcgcccacacccagtgctctgggtcataagcctggatctggaaaaacaaatgcgctttgagaagacggggactccccaggatacccctctctcccctcgtccagcctccagcccacccgattcctccccacatcctccacctccccaggccccacccacctcctccaactcctccggggaaacccaagccctgcagcgcatggaacagaagaactggaaccgacgcttctggaacaaggctatctgagagcagttcttcctggccctcgggttcatgggacggcataactggaaccaatgcttagggcgcaagggtatgtgagagtgggtcttcccgtacaggaagtagaagatcttttgtttgggggcctcgtcgtcctcctccatgtcattggccagatagctgaggacagaaatcaggttgctgctcaggggcaccaccaggagagacctccggctgaggtcagcttcccagagaggaaggtaagggaccgtccctagctcaggactggcacccaccctgcagagagccacgccttcctcaggagggctctgctggacagagacctgatcaagggcatctcccactccttcaggatggagacaaaaacccaactggtgaccaagagtggtggcttaggcctggaatcccagcacactgggaggccgaagcaggaggatcacttgaggccaggagtttgagacaggcctgggcaacatagcaagacccttgtctctatt
